US011603532B2

(12) United States Patent
Vargeese et al.

(10) Patent No.: US 11,603,532 B2
(45) Date of Patent: Mar. 14, 2023

(54) OLIGONUCLEOTIDE COMPOSITIONS AND METHODS OF USE THEREOF

(71) Applicant: WAVE LIFE SCIENCES LTD., Singapore (SG)

(72) Inventors: Chandra Vargeese, Schwenksville, PA (US); Naoki Iwamoto, Brighton, MA (US); David Charles Donnell Butler, Medford, MA (US); Subramanian Marappan, Acton, MA (US); Genliang Lu, Winchester, MA (US); Jason Jingxin Zhang, Walpole, MA (US); Vinod Vathipadiekal, Stoneham, MA (US); Maria David Frank-Kamenetsky, Brookline, MA (US); Luciano Henrique Apponi, Chelsea, MA (US); Young Jin Cho, Belmont, MA (US)

(73) Assignee: WAVE LIFE SCIENCES LTD., Singapore (SG)

( * ) Notice: Subject to any disclaimer, the term of this patent is extended or adjusted under 35 U.S.C. 154(b) by 0 days.

(21) Appl. No.: 16/618,010

(22) PCT Filed: Jun. 1, 2018

(86) PCT No.: PCT/US2018/035687
§ 371 (c)(1),
(2) Date: Nov. 27, 2019

(87) PCT Pub. No.: WO2018/223056
PCT Pub. Date: Dec. 6, 2018

(65) Prior Publication Data
US 2020/0157545 A1 May 21, 2020

Related U.S. Application Data

(60) Provisional application No. 62/670,709, filed on May 11, 2018, provisional application No. 62/670,686, filed on May 11, 2018, provisional application No. 62/656,949, filed on Apr. 12, 2018, provisional application No. 62/514,769, filed on Jun. 2, 2017, provisional application No. 62/514,771, filed on Jun. 2, 2017.

(51) Int. Cl.
| | |
|---|---|
| C12N 15/11 | (2006.01) |
| C12N 15/113 | (2010.01) |
| A61K 31/712 | (2006.01) |

(52) U.S. Cl.
CPC ........ C12N 15/1137 (2013.01); A61K 31/712 (2013.01); *C12N 2310/14* (2013.01); *C12N 2310/315* (2013.01); *C12N 2310/343* (2013.01)

(58) Field of Classification Search
CPC .............. C12N 2310/14; C12N 15/113; C12N 15/111; C12N 2310/346; C12N 2330/30
See application file for complete search history.

(56) References Cited

U.S. PATENT DOCUMENTS

| | | |
|---|---|---|
| 5,268,464 A | 12/1993 | Brill |
| 5,270,468 A | 12/1993 | Khanna et al. |
| 5,750,669 A | 5/1998 | Rosch et al. |
| 7,598,227 B2 | 10/2009 | Crooke et al. |
| 7,750,141 B2 | 7/2010 | Crooke et al. |
| 8,470,987 B2 | 6/2013 | Wada et al. |
| 8,530,439 B2 | 9/2013 | Crooke et al. |
| 8,729,036 B2 | 5/2014 | Zamore et al. |
| 8,822,671 B2 | 9/2014 | Shimizu et al. |
| 8,859,755 B2 | 10/2014 | Wada et al. |
| 8,927,513 B2 | 1/2015 | Manoharan et al. |
| 9,157,082 B2 | 10/2015 | Mullick et al. |

(Continued)

FOREIGN PATENT DOCUMENTS

| | | |
|---|---|---|
| JP | 2003-238586 A | 8/2003 |
| JP | 2011-184318 A | 9/2011 |

(Continued)

OTHER PUBLICATIONS

U.S. Appl. No. 16/618,003, filed Nov. 27, 2019, Vargeese et al.
U.S. Appl. No. 16/624,896, filed Dec. 19, 2019, Butler et al.
U.S. Appl. No. 16/755,544, filed Apr. 10, 2020, Zhang et al.
U.S. Appl. No. 16/869,126, filed May 7, 2020, Vargeese et al.
U.S. Appl. No. 17/046,752, filed Oct. 9, 2020, Zhang et al.
U.S. Appl. No. 17/054,452, filed Nov. 10, 2020, Zhang et al.
U.S. Appl. No. 17/177,111, filed Feb. 16, 2021, Zhang et al.

(Continued)

*Primary Examiner* — Dana H Shin
(74) *Attorney, Agent, or Firm* — Choate, Hall & Stewart LLP; Brenda Herschbach Jarrell; Xiaodong Li

(57) ABSTRACT

Among other things, the present disclosure provides designed oligonucleotides, compositions, and methods thereof. In some embodiments, provided oligonucleotide compositions provide improved single-stranded RNA interference and/or RNase H-mediated knockdown. Among other things, the present disclosure encompasses the recognition that structural elements of oligonucleotides, such as base sequence, chemical modifications (e.g., modifications of sugar, base, and/or internucleotidic linkages) or patterns thereof, conjugation with additional chemical moieties, and/or stereochemistry [e.g., stereochemistry of backbone chiral centers (chiral internucleotidic linkages)], and/or patterns thereof, can have significant impact on oligonucleotide properties and activities, e.g., RNA interference (RNAi) activity, stability, delivery, etc. In some embodiments, the present disclosure provides methods for treatment of diseases using provided oligonucleotide compositions, for example, in RNA interference and/or RNase H-mediated knockdown.

20 Claims, 15 Drawing Sheets

Specification includes a Sequence Listing.

(56) References Cited

U.S. PATENT DOCUMENTS

| | | | |
|---|---|---|---|
| 9,163,239 B2 | 10/2015 | Prakash et al. | |
| 9,365,848 B2 | 6/2016 | Crooke et al. | |
| 9,394,333 B2 | 7/2016 | Wada et al. | |
| 9,476,044 B2 | 10/2016 | Tuschl et al. | |
| 9,593,333 B2 | 3/2017 | Alexander et al. | |
| 9,598,458 B2 | 3/2017 | Shimizu et al. | |
| 9,605,019 B2 | 3/2017 | Verdine et al. | |
| 9,617,547 B2 | 4/2017 | Gemba | |
| 9,624,496 B2 | 4/2017 | Crooke et al. | |
| 9,695,211 B2 | 7/2017 | Wada et al. | |
| 9,744,183 B2 | 8/2017 | Verdine et al. | |
| 9,982,257 B2 | 5/2018 | Butler et al. | |
| 10,144,933 B2 | 12/2018 | Gemba et al. | |
| 10,149,905 B2 | 12/2018 | Gemba et al. | |
| 10,160,969 B2 | 12/2018 | Meena et al. | |
| 10,167,309 B2 | 1/2019 | Shimizu et al. | |
| 10,280,192 B2 | 5/2019 | Verdine et al. | |
| 10,307,434 B2 | 6/2019 | Verdine et al. | |
| 10,322,173 B2 | 6/2019 | Gemba et al. | |
| 10,329,318 B2 | 6/2019 | Wada et al. | |
| 10,428,019 B2 | 10/2019 | Wada et al. | |
| 10,450,568 B2 | 10/2019 | Butler et al. | |
| 10,479,995 B2 | 11/2019 | Vargeese et al. | |
| 10,590,413 B2 | 3/2020 | Butler et al. | |
| 10,696,711 B2 | 6/2020 | Shimizu et al. | |
| 10,724,035 B2 | 7/2020 | Vargeese et al. | |
| 10,815,482 B2 | 10/2020 | Meena et al. | |
| 11,013,757 B2 | 5/2021 | Zhang et al. | |
| 11,034,958 B2 | 6/2021 | Fitzgerald et al. | |
| 11,136,346 B2 | 10/2021 | Shimizu et al. | |
| 2004/0208856 A1 | 10/2004 | Crooke et al. | |
| 2006/0264395 A1 | 11/2006 | Crooke et al. | |
| 2007/0155854 A1 | 7/2007 | Brunner et al. | |
| 2007/0292875 A1 | 12/2007 | Crooke et al. | |
| 2008/0200409 A1 | 8/2008 | Wilson et al. | |
| 2009/0023675 A1 | 1/2009 | McSwiggen et al. | |
| 2014/0323709 A1 | 10/2014 | Obika et al. | |
| 2016/0060625 A1 | 3/2016 | Mullick et al. | |
| 2016/0355808 A1* | 12/2016 | Khvorova | A61P 43/00 |
| 2017/0268004 A1 | 9/2017 | Mullick et al. | |
| 2017/0320903 A1 | 11/2017 | Watanabe et al. | |
| 2017/0340661 A1 | 11/2017 | Fitzgerald et al. | |
| 2017/0362270 A1 | 12/2017 | Stetsenko et al. | |
| 2019/0077817 A1 | 3/2019 | Butler et al. | |
| 2019/0127733 A1 | 5/2019 | Butler et al. | |
| 2019/0249173 A1 | 8/2019 | Vargeese et al. | |
| 2019/0264267 A1 | 8/2019 | Yang et al. | |
| 2019/0375774 A1 | 12/2019 | Butler et al. | |
| 2019/0390197 A1 | 12/2019 | Butler et al. | |
| 2020/0080083 A1 | 3/2020 | Vargeese et al. | |
| 2020/0157545 A1 | 5/2020 | Vargeese et al. | |
| 2020/0190515 A1 | 6/2020 | Vargeese et al. | |
| 2020/0231620 A1 | 7/2020 | Bowman et al. | |
| 2020/0299692 A1 | 9/2020 | Frank-Kamenetsky et al. | |
| 2020/0362337 A1 | 11/2020 | Dodart et al. | |
| 2020/0385420 A1 | 12/2020 | Shimizu et al. | |
| 2021/0032620 A1 | 2/2021 | Vargeese et al. | |
| 2021/0115444 A1 | 4/2021 | Meena et al. | |
| 2021/0130821 A1 | 5/2021 | Butler et al. | |
| 2021/0198305 A1 | 7/2021 | Vargeese et al. | |
| 2021/0228615 A1 | 7/2021 | Zhang et al. | |
| 2021/0254062 A1 | 8/2021 | Zhang et al. | |

FOREIGN PATENT DOCUMENTS

| | | | |
|---|---|---|---|
| WO | WO-2003/002587 | A2 | 1/2003 |
| WO | WO-2003/025139 | A2 | 3/2003 |
| WO | WO-2004/007718 | A2 | 1/2004 |
| WO | WO-2004/093783 | A2 | 11/2004 |
| WO | WO-2005/014609 | A2 | 2/2005 |
| WO | WO-2005/023828 | A1 | 3/2005 |
| WO | WO-2005/028494 | A1 | 3/2005 |
| WO | WO-2005/070859 | A1 | 8/2005 |
| WO | WO-2005/085272 | A1 | 9/2005 |
| WO | WO-2005/092909 | A1 | 10/2005 |
| WO | WO-2006/023880 | A2 | 3/2006 |
| WO | WO-2007/059816 | A1 | 5/2007 |
| WO | WO-2008/128686 | A1 | 10/2008 |
| WO | WO-2010/064146 | A2 | 6/2010 |
| WO | WO-2011/005761 | A1 | 1/2011 |
| WO | WO-2011/034072 | A1 | 3/2011 |
| WO | WO-2011/108682 | A1 | 9/2011 |
| WO | WO-2011/109427 | A2 | 9/2011 |
| WO | WO-2012/037254 | A1 | 3/2012 |
| WO | WO-2012/039448 | A1 | 3/2012 |
| WO | WO-2012/073857 | A1 | 6/2012 |
| WO | WO-2012/149495 | A1 | 11/2012 |
| WO | WO-2013/009735 | A1 | 1/2013 |
| WO | WO-2013/012758 | A1 | 1/2013 |
| WO | WO-2014/010250 | A1 | 1/2014 |
| WO | WO-2014/010718 | A1 | 1/2014 |
| WO | WO-2014/012081 | A2 | 1/2014 |
| WO | WO-2015/107425 | A2 | 7/2015 |
| WO | WO-2015/108046 | A1 | 7/2015 |
| WO | WO-2015/108047 | A1 | 7/2015 |
| WO | WO-2015/108048 | A1 | 7/2015 |
| WO | WO-2016/028187 | A1 | 2/2016 |
| WO | WO-2016/081444 | A1 | 5/2016 |
| WO | WO-2017/015555 | A1 | 1/2017 |
| WO | WO-2017/015575 | A1 | 1/2017 |
| WO | WO-2017/048620 | A1 | 3/2017 |
| WO | WO-2017/062862 | A2 | 4/2017 |
| WO | WO-2017/160741 | A1 | 9/2017 |
| WO | WO-2017/192664 | A1 | 11/2017 |
| WO | WO-2017/192679 | A1 | 11/2017 |
| WO | WO-2017/205880 | A1 | 11/2017 |
| WO | WO-2017/210647 | A1 | 12/2017 |
| WO | WO-2018/022473 | A1 | 2/2018 |
| WO | WO-2018/056871 | A1 | 3/2018 |
| WO | WO-2018/067973 | A1 | 4/2018 |
| WO | WO-2018/098264 | A1 | 5/2018 |
| WO | WO-2018/156056 | A1 | 8/2018 |
| WO | WO-2018/223056 | A1 | 12/2018 |
| WO | WO-2018/223073 | A1 | 12/2018 |
| WO | WO-2018/223081 | A1 | 12/2018 |
| WO | WO-2018/237194 | A1 | 12/2018 |
| WO | WO-2019/002237 | A1 | 1/2019 |
| WO | WO-2019/032607 | A1 | 2/2019 |
| WO | WO-2019/032612 | A1 | 2/2019 |
| WO | WO-2019/055951 | A1 | 3/2019 |
| WO | WO-2019/071028 | A1 | 4/2019 |
| WO | WO-2019/075357 | A1 | 4/2019 |
| WO | WO-2019/118638 | A2 | 6/2019 |
| WO | WO-2019/200185 | A1 | 10/2019 |
| WO | WO-2019/217784 | A1 | 11/2019 |
| WO | WO-2020/061200 | A1 | 3/2020 |
| WO | WO-2020/118246 | A1 | 6/2020 |
| WO | WO-2020/160336 | A1 | 8/2020 |
| WO | WO-2020/191252 | A1 | 9/2020 |
| WO | WO-2020/196662 | A1 | 10/2020 |
| WO | WO-2020/219981 | A2 | 10/2020 |
| WO | WO-2020/219983 | A2 | 10/2020 |
| WO | WO-2020/227691 | A2 | 11/2020 |
| WO | WO-2021/071788 | A2 | 4/2021 |
| WO | WO-2021/071858 | A1 | 4/2021 |
| WO | WO-2021/126734 | A1 | 6/2021 |
| WO | WO-2021/178237 | A2 | 9/2021 |
| WO | WO-2021/195467 | A2 | 9/2021 |
| WO | WO-2021/237223 | A1 | 11/2021 |

OTHER PUBLICATIONS

U.S. Appl. No. 17/311,285, filed Jun. 4, 2021, Zhang et al.
Belikova, A. M., et al., Synthesis of Ribonucleosides and Diribonucleoside phosphates containing 2-chloro-ethylamine and Nitrogen Mustard Residues, Terahedron Letters, 37:3557-3562 (1967).
Fokina, A. et al., Analysis of new charge-neutral DNA/RNA analogues phosphoryl guanidine oligonucleotides (PGO) by gel electrophoresis, Analytical Biochemistry, 555: 9-11 (2018).
International Search Report for PCT/US2018/035687, 4 pages (dated Oct. 4, 2018).
International Search Report for PCT/US2018/035712, 5 pages (dated Oct. 19, 2018).

(56) References Cited

OTHER PUBLICATIONS

International Search Report for PCT/US2018/035721, 5 pages (dated Oct. 18, 2018).
International Search Report for PCT/US2019/027109, 7 pages (dated Sep. 24, 2019).
International Search Report for PCT/US2019/031672, 5 pages (dated Oct. 10, 2019).
International Search Report for PCT/US2019/065058, 6 pages (dated May 4, 2020).
Jäger, A. et al., Oligonucleotide N-alkylphosphoramidates: synthesis and binding to polynucleotides, Biochemistry, 27(19):7237-46 (1988).
Koch, T., LNA Therapeutics—update, Navigate the phosphorothioate diastereoisomer space, Roche pRED RNA Therapeutics Research, EuroTIDES, PostillionConventionCenter, Amsterdam, Netherlands (Nov. 6-9, 2018).
Kupryushkin, M et al., 'Dodecyl-modified oligodeoxyribonucleotides as platform for oligonucleotide delivery into eukaryotic cells,' 13th Annual Meeting of the Oligonucleotide Therapeutics Society, (2017), abstract 057.
Kupryushkin, M. S. Phosphoryl Guanidines: A New Type of Nucleic Acid Analogues, Acta Naturae, 6(4): 116-118 (2014).
Kurata, C. et al., Characterization of high molecular weight impurities in synthetic phosphorothioate oligonucleotides, Bioorg. Med. Chem. Lett., 16:607-614 (2006).
Lebedeva, N. et al., Design of a New Fluorescent Oligonucleotide-Based Assay for a Highly Specific Real-Time Detection of Apurinic/Apyrimidinic Site Cleavage by Tyrosyl-DNA Phosphodiesterase 1, Bioconjugate Chem., 26(10):2046-2053 (2015).
Lee, M. Y. et al., Synthesis and SAR of sulfonyl- and phosphoryl amidine compounds as anti-resorptive agents, Bioorg. Med. Chem. Lett., 20:541-545 (2010).
Levina, A.S. et al., Impact of delivery method on antiviral activity of phosphodiester, phosphorothioate, and phosphoryl guanidine oligonucleotides in MDCK cells infected with H5N1 bird flu virus, Molecular Biology, 51(4): 633-638 (2017).
Ohkubo, A. et al., A new strategy for the synthesis of oligodeoxynucleotides directed towards perfect O-selective internucleotidic bond formation without base protection, Tetrahedron Letters, 45:363-366 (2004).
Ohkubo, A. et al., O-Selectivity and Utility of Phosphorylation Mediated by Phosphite Triester Intermediates in the N-Unprotected Phosphoramidite Method, J. Am. Chem., 126:10884-10896 (2004).
Prakash, T. P. et al., Identification of metabolically stable 5'-phosphate analogs that support single-stranded siRNA activity, Nucleic Acids Research, 43(6):2993-3011 (2015).
Sekine, M. et al., Proton-Block Strategy for the Synthesis of Oligodeoxynucleotides without Base Protection, Capping Reaction, and P—N Bond Cleavage Reaction, J. Org. Chem., 68:5478-5492 (2003).
Shen, W. et al., Acute hepatotoxicity of 2' fluoro-modified 5-10-5 gapmer phosphorothioate oligonucleotides in mice correlates with intracellular protein binding and the loss of DBHS proteins, Nucl. Acids Res., 46(5):2204-2217 (2018).
Skaric, V. and Raza, Z., The Homologation of 1-(2,3-Dihydroxypropyl)- into 1-(2,4-Dihydroxybutyl)-thymine, Croatica Chemica Acta, 52(1):51-59 (1979).
Skaric, V. et al., Aliphatic Thymidine and Deoxyuridine Analogs, Croatica Chemica Acta, 52(3):281-292 (1979).
Skvortsova, Y. V., et al., A new Antisense Phosphoryl Guanidine Oligo-2'-O-Methylribonucleotide Penetrates Into Intracellular Mycobacteria and Suppresses Target Gene Expression, 10:1-9 (2019).
Stetsenko, D. A., Phosphoryl Guanidines: New Chemical Analogues of Nucleic Acids, 4 pages (Aug. 2015), <https://scfh.ru/en/papers/phosphoryl-guanidines-new-chemical-analogues-of-nucleic-acids-/>. Retrieved Sep. 15, 2020.
Stetsenko, D.A. and Pyshnyi, D.V., Ex Siberia Semper Novi: Siberia Always Brings Us Something New, Phosphoryl Guanidines: New Chemical Analogues of Nucleic Acids, Science First Hand, N2(41): 2 pages (Aug. 30, 2015). URL: https://scfh.ru/en/papers/phosphoryl-guanidines-new-chemical-analogues-of-nucleic-acids-/.
WAVE Life Sciences Press Release, WAVE Life Sciences Announces Discontinuation of Suvodirsen Development for Duchenne Muscular Dystrophy, 2 pages (Dec. 16, 2019).
WAVE Life Sciences, Analyst & Investor Research Webcast (Aug. 2020), 64 pages.
Written Opinion for PCT/US2018/035687, 10 pages (dated Oct. 4, 2018).
Written Opinion for PCT/US2018/035712, 6 pages (dated Oct. 19, 2018).
Written Opinion for PCT/US2018/035721, 10 pages (dated Oct. 18, 2018).
Written Opinion for PCT/US2019/027109, 10 pages (dated Sep. 24, 2019).
Written Opinion for PCT/US2019/031672, 11 pages (dated Oct. 10, 2019).
Written Opinion for PCT/US2019/065058, 11 pages (dated May 4, 2020).
U.S. Appl. No. 17/375,658, filed Jul. 14, 2021, Vargeese et al.
U.S. Appl. No. 17/426,511, filed Jul. 28, 2021, Brown et al.
Anderson, B. A. et al., Towards next generation antisense oligonucleotides: mesylphosphoramidate modification improves therapeutic index and duration of effect of gapmer antisense oligonucleotides, Nucl. Acids. Res., 49(16):9026-9041 (2021).
PubChem SID: 226629328, 9 pages, date available: Feb. 2, 2015.
PubChem SID: 316086382, 8 pages, date available: Aug. 2, 2016, date modified: Jun. 20, 2019.
PubChem SID: 355354479, 7 pages, date available: Apr. 8, 2018.
PubChem SID: 368967557, 7 pages, date available: May 25, 2018.
Rigo, F. et al., Synthetic oligonucleotides recruit ILF2/3 to RNA transcripts to modulate splicing, Nat. Chem. Bio., 8:555-562 (2012).
U.S. Appl. No. 17/439,755, filed Sep. 15, 2021, Kandasamy et al.
U.S. Appl. No. 17/465,238, filed Feb. 9, 2021, Shimizu et al.
U.S. Appl. No. 17/605,997, filed Oct. 22, 2021, Byrne et al.
U.S. Appl. No. 17/605,998, filed Oct. 22, 2021, Byrne et al.
U.S. Appl. No. 17/609,330, filed Nov. 5, 2021, Liu et al.
Kozarski, M. et al., 7-Methylguanosine monophosphate analogues with 5'-(1,2,3-triazoyl) moiety: Synthesis and evaluation as the inhibitors of cNIIIB nucleotidase, Bioorg. Med. Chem., 26(1):191-199 (2018).
Pavlova, A. S. et al., SDS-PAGE procedure: Application for characterization of new entirely uncharged nucleic acids analogs, Electrophor., 39:670-674 (2018).

* cited by examiner

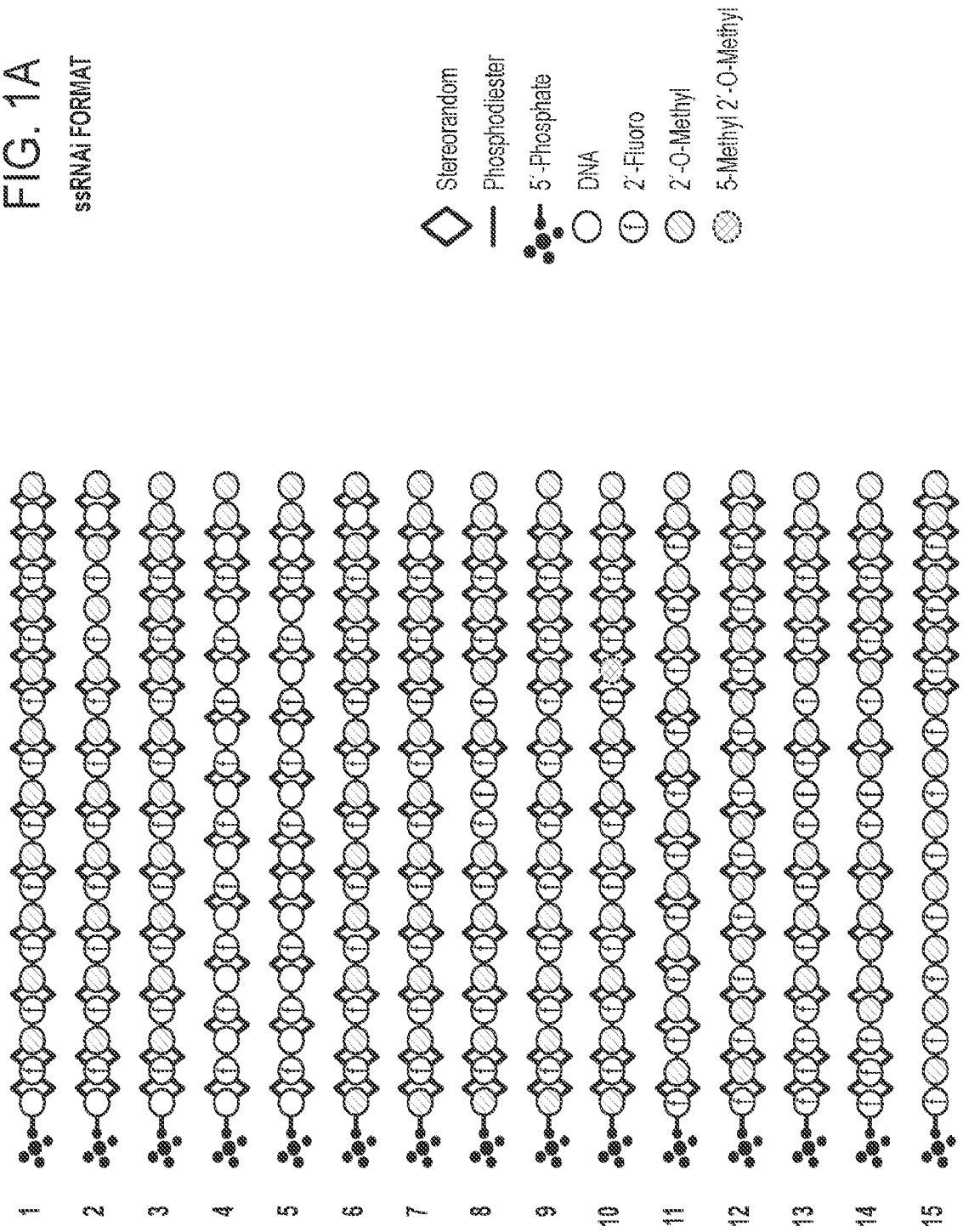

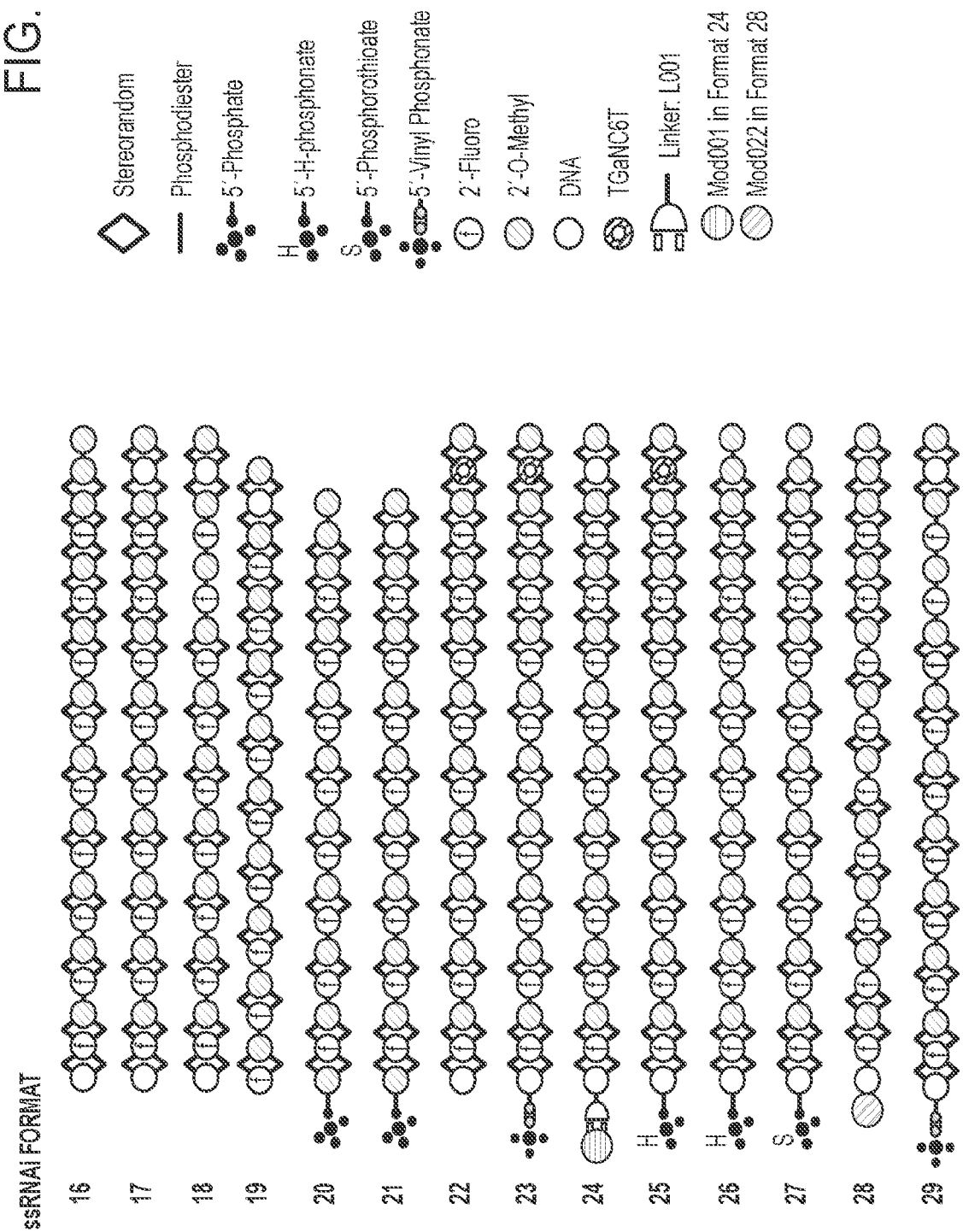

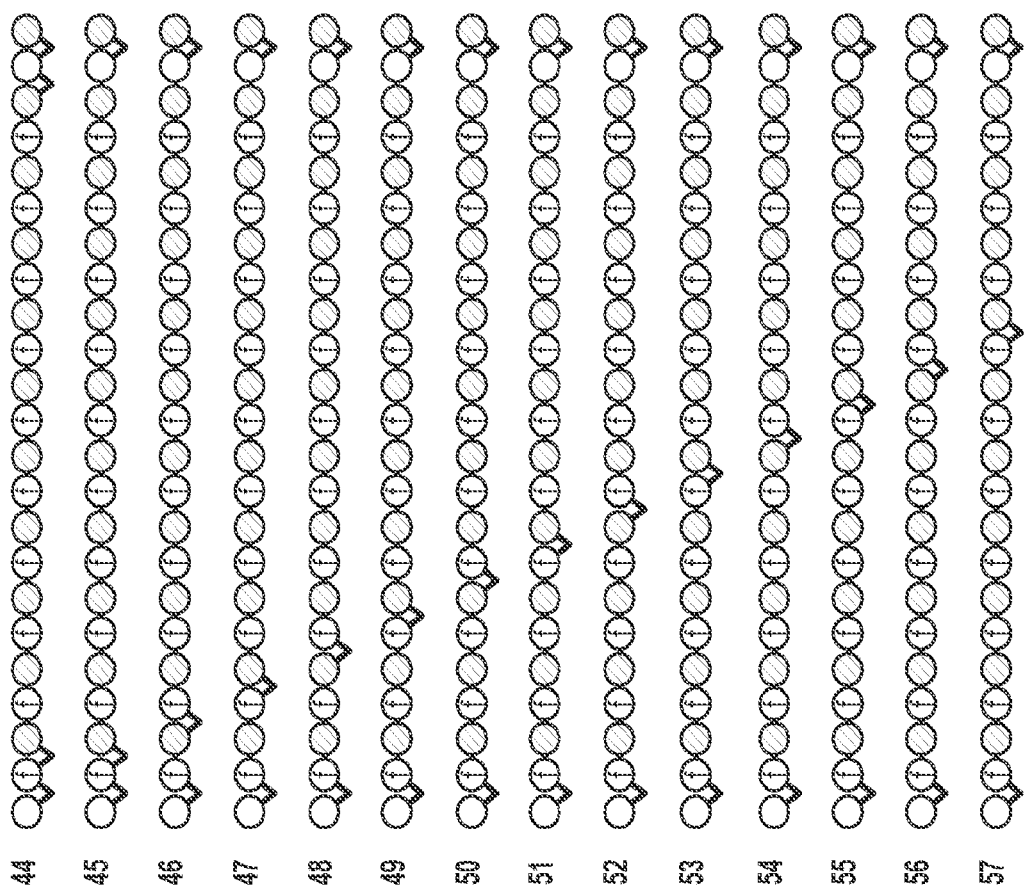

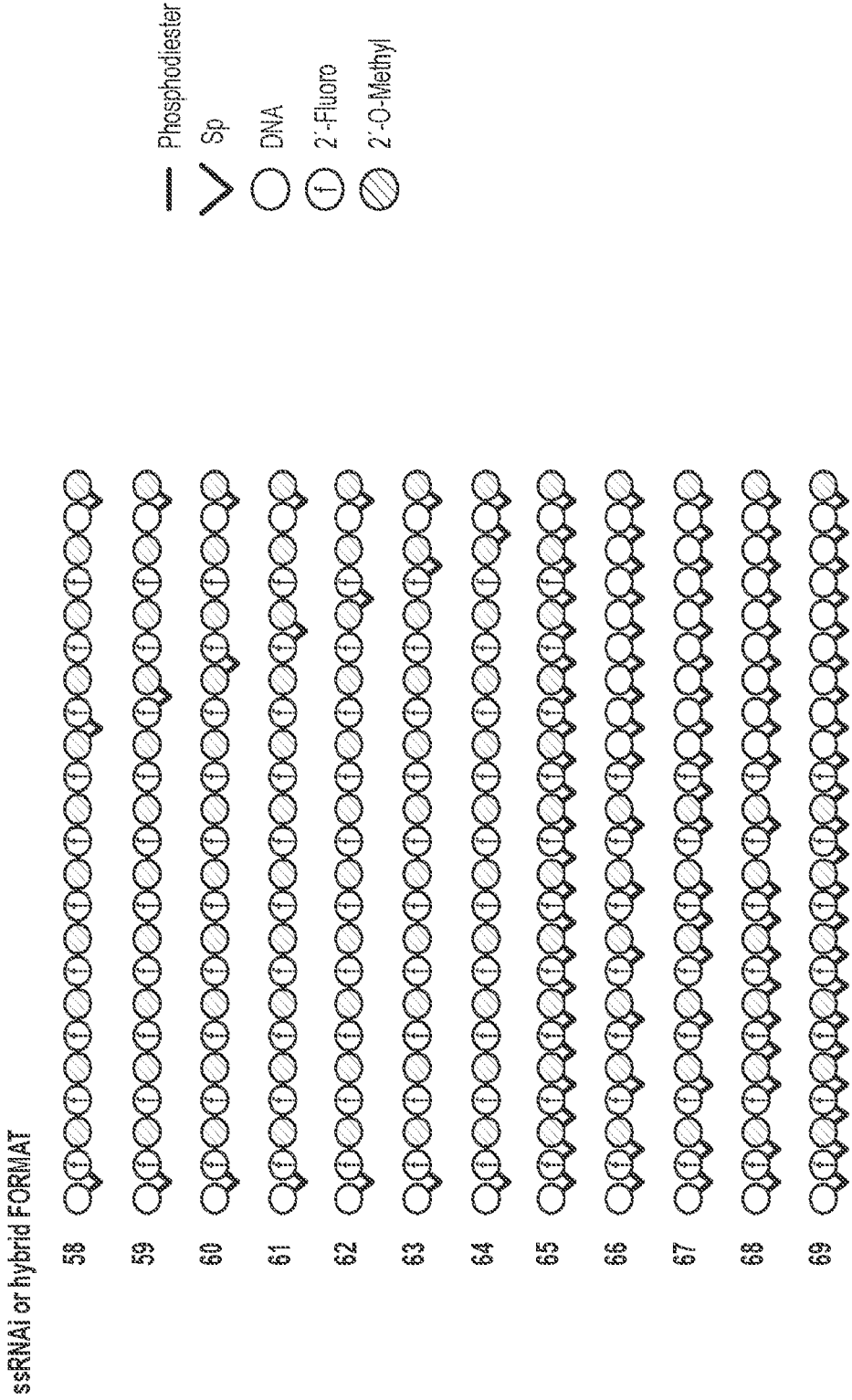

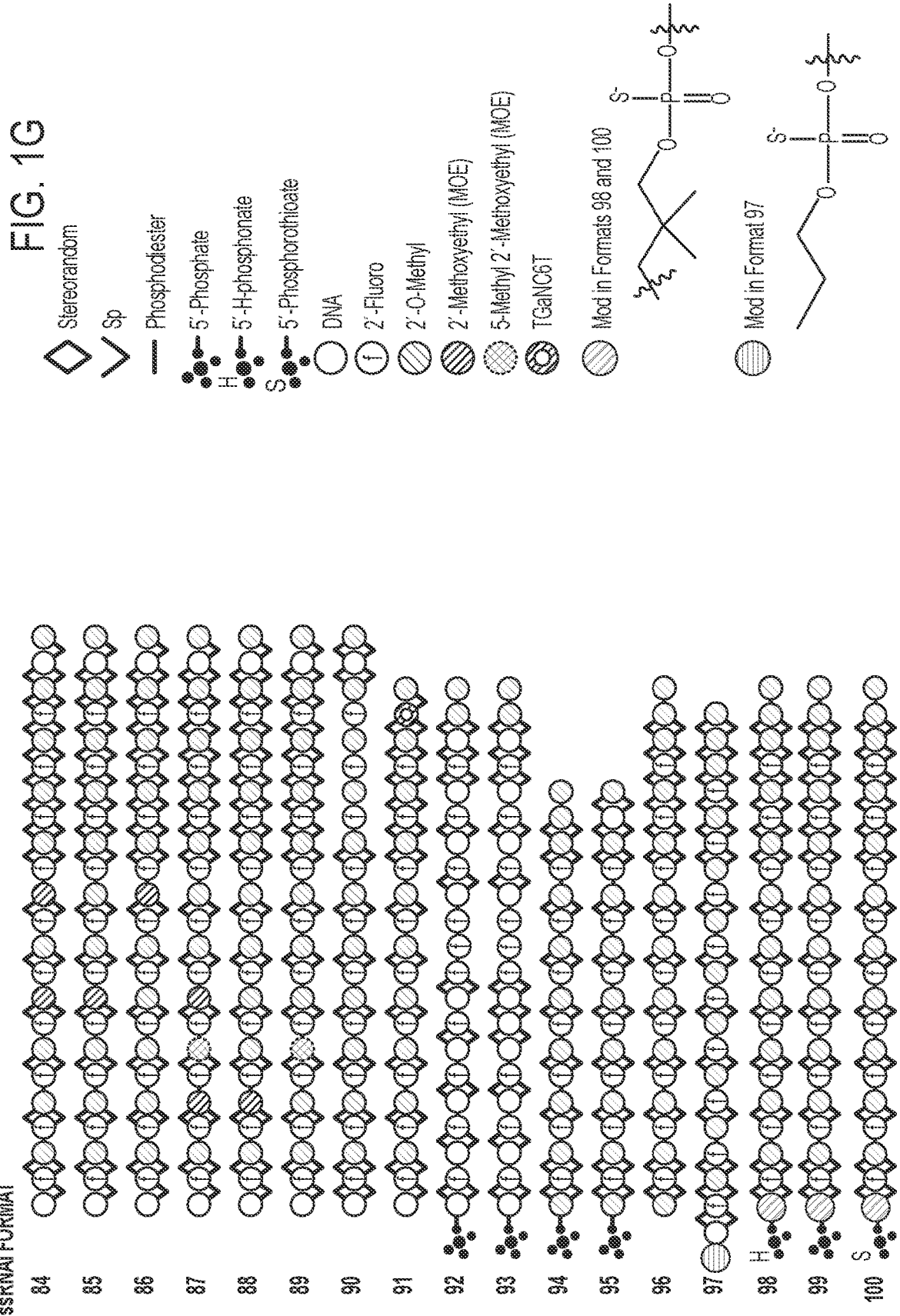

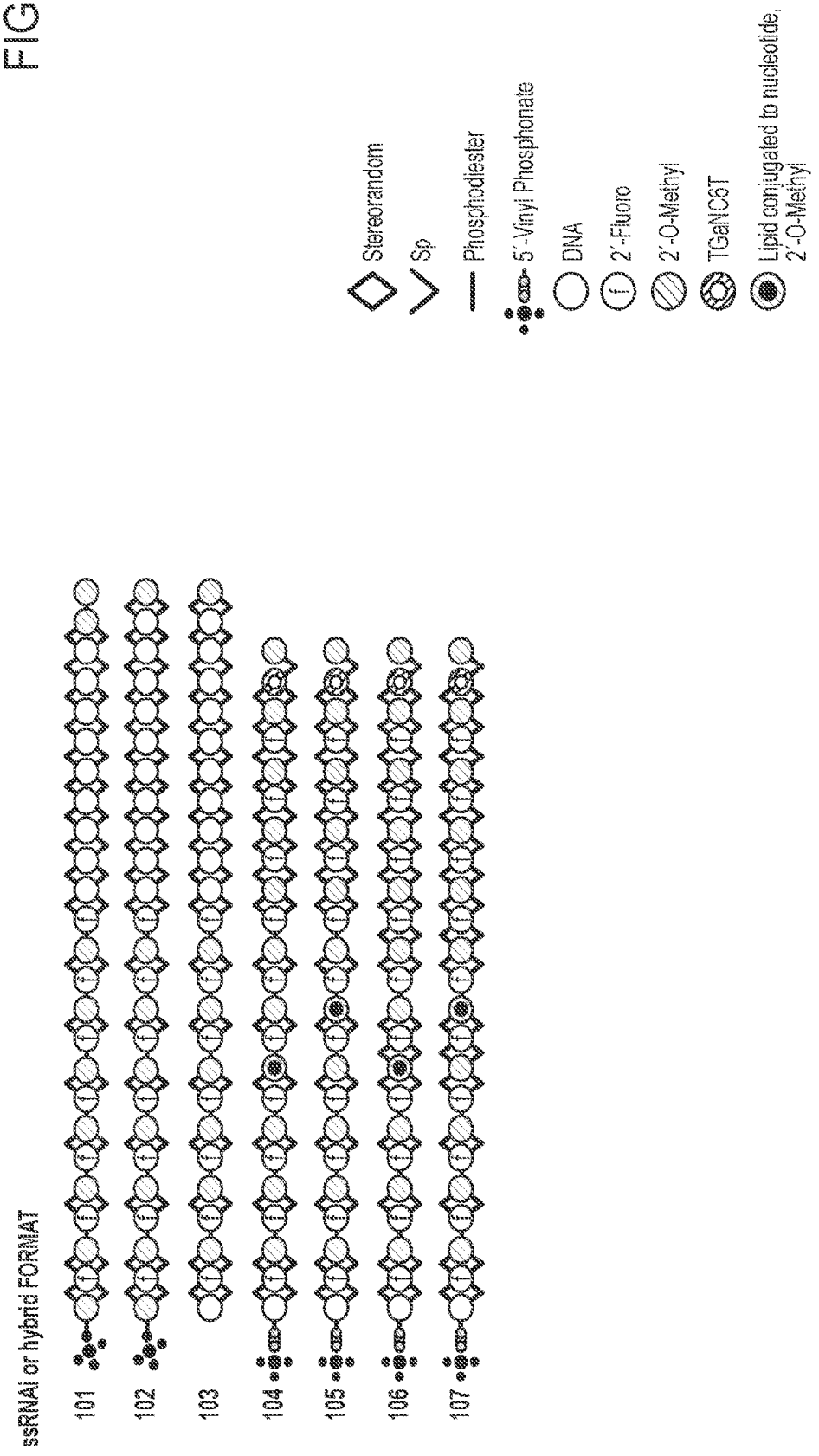

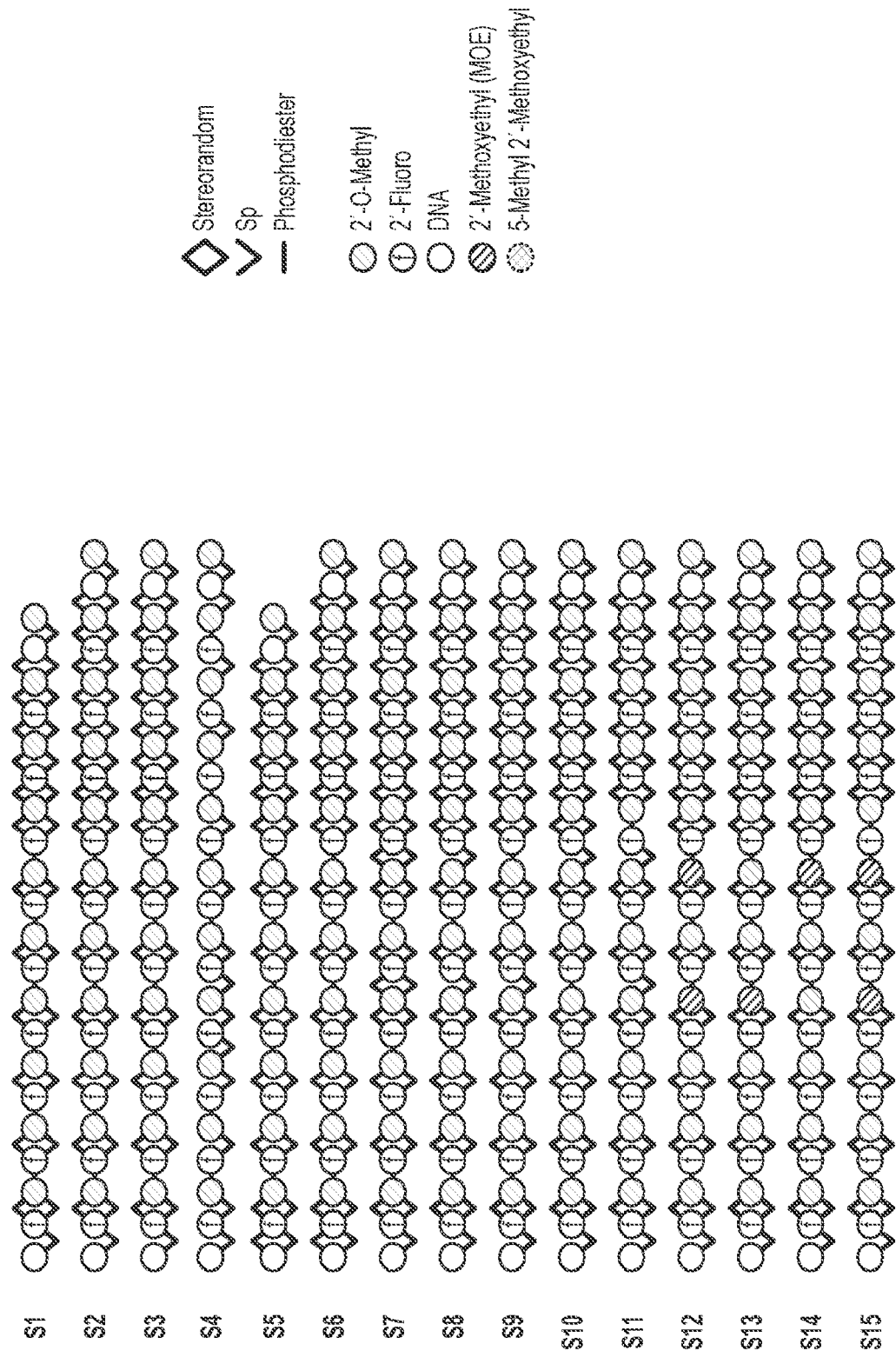

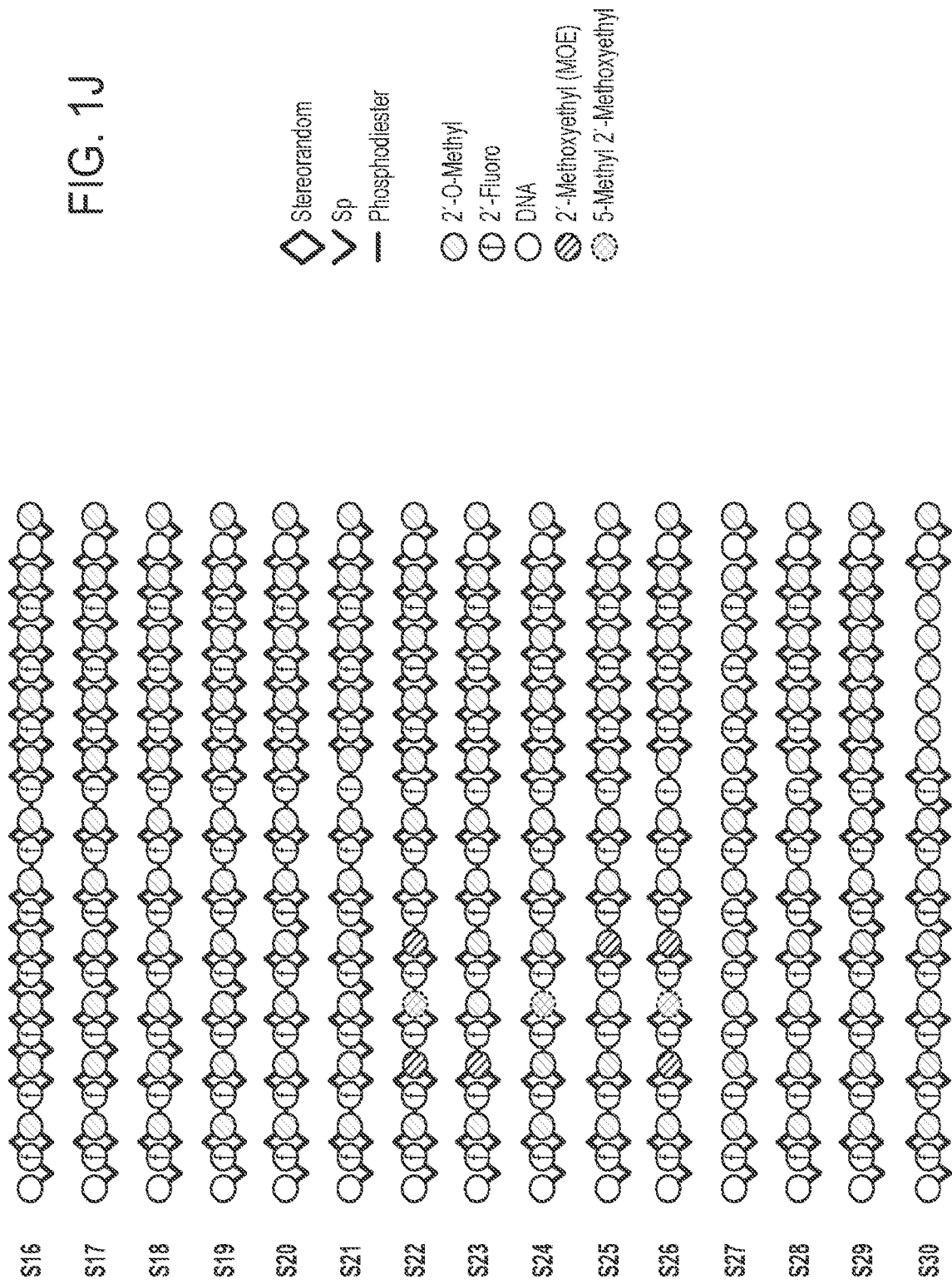

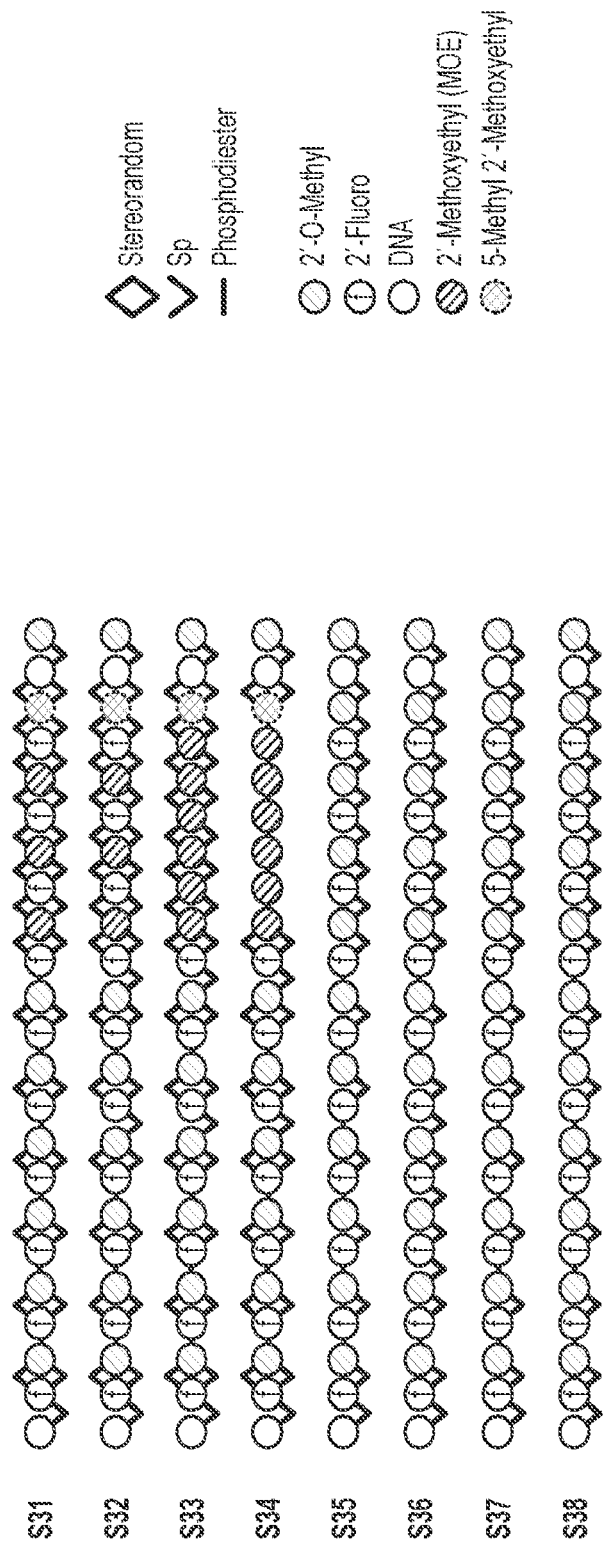

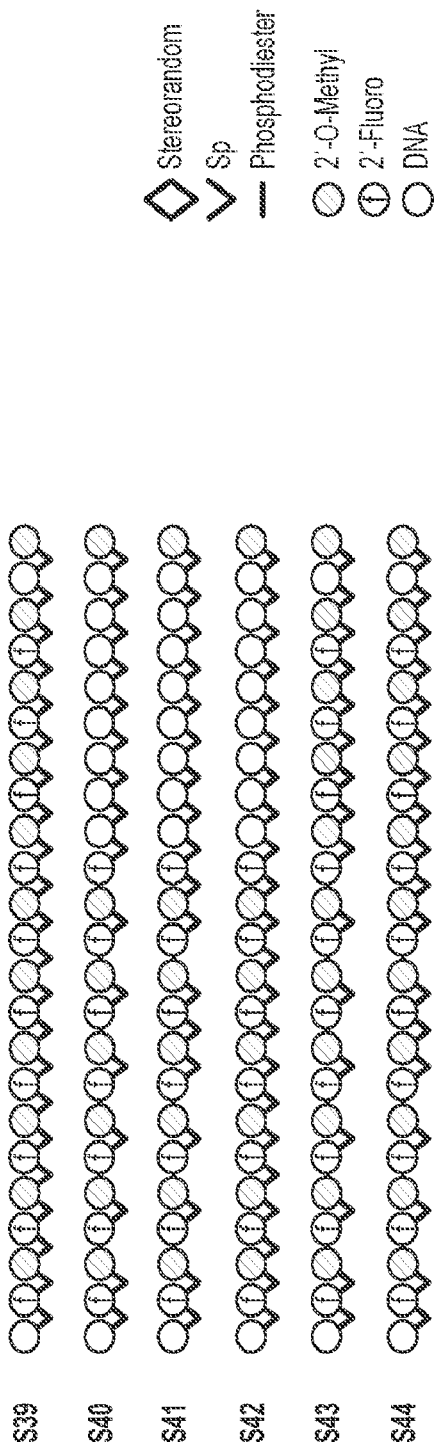

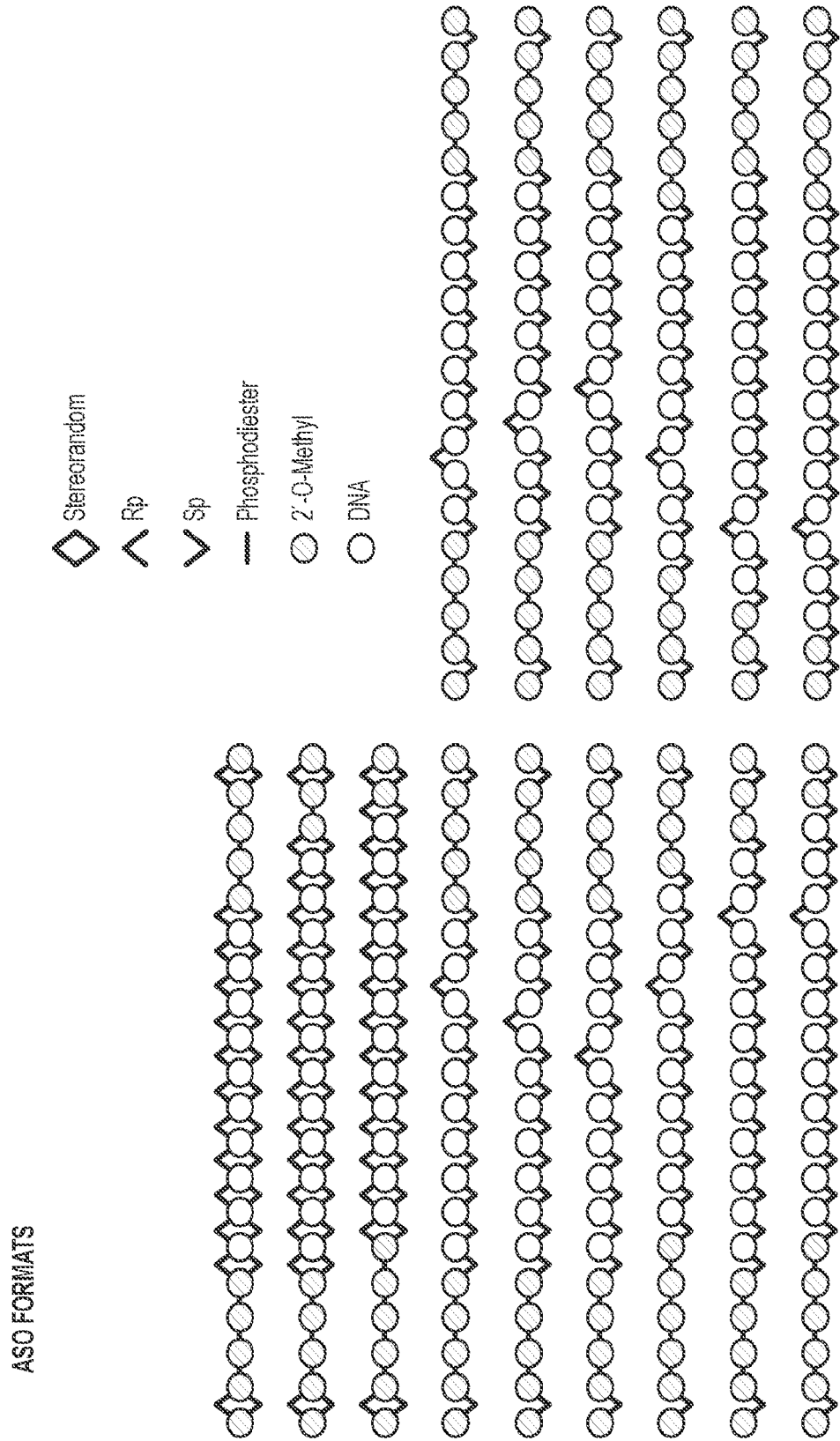

OLIGONUCLEOTIDE COMPOSITIONS AND METHODS OF USE THEREOF

CROSS-REFERENCE TO RELATED APPLICATIONS

This application is a U.S. National Stage Application of International PCT Application No. PCT/US18/35687, which claims priority to U. S. Provisional Application Nos. 62/514,769, filed Jun. 2, 2017, 62/514,771, filed Jun. 2, 2017, 62/656,949, filed Apr. 12, 2018, 62/670,686, filed May 11, 2018, and 62/670,709, filed May 11, 2018, the entirety of each of which is incorporated herein by reference.

SEQUENCE LISTING

The instant application contains a Sequence Listing which has been submitted electronically in ASCII format and is hereby incorporated by reference in its entirety. Said ASCII copy, created on Jun. 28, 2018, is named "SL.txt" and is 1,163,335 bytes in size.

BACKGROUND

Oligonucleotides which target a gene are useful in various applications, e.g., therapeutic, diagnostic, research and nanomaterials applications. The use of naturally-occurring nucleic acids (e.g., unmodified DNA or RNA) can be limited, for example, by their susceptibility to endo- and exo-nucleases.

SUMMARY

Among other things, the present disclosure encompasses the recognition that controlling structural elements of oligonucleotides, such as chemical modifications (e.g., modifications of a sugar, base and/or internucleotidic linkage) or patterns thereof, alterations in stereochemistry (e.g., stereochemistry of a backbone chiral internucleotidic linkage) or patterns thereof, and/or conjugation with an additional chemical moiety (e.g., a lipid moiety, a targeting moiety, carbohydrate moiety, a moiety that binds to a asialoglycoprotein receptor or ASGPR, e.g., a GalNAc moiety, etc.) can have a significant impact on oligonucleotide properties and/or activities. In some embodiments, the properties and/or activities include, but are not limited to, participation in, direction of a decrease in expression, activity or level of a gene or a gene product thereof, mediated, for example, by RNA interference (RNAi interference), single-stranded RNA interference (ssRNAi), RNase H-mediated knockdown, steric hindrance of translation, etc.

In some embodiments, the present disclosure demonstrates that compositions comprising oligonucleotides (and particularly single-stranded oligonucleotides) with controlled structural elements provide unexpected properties and/or activities.

In some embodiments, the present disclosure encompasses the recognition that stereochemistry, particularly stereochemistry of backbone chiral centers, can unexpectedly improve properties of oligonucleotides. In contrast to many prior observations that some structural elements that increase stability can also lower activity, for example, RNA interference, the present disclosure demonstrates that control of stereochemistry can, surprisingly, increase stability while not significantly decreasing activity.

In some embodiments, the present disclosure provides technologies (e.g., compounds, methods, etc.) for improving oligonucleotide stability while maintaining or increasing activity, including compositions of improved-stability oligonucleotides.

In some embodiments, the present disclosure provides oligonucleotides having certain 5'-end structures.

Among other things, the present disclosure demonstrates such oligonucleotides can have desired properties.

In some embodiments, the present disclosure provides 5'-end structures that, when used in accordance with the present disclosure, can provided oligonucleotides with high biological activities, e.g., RNAi activity.

Literature has reported that, in many cases, RNAi activity requires the presence of a 5'-phosphate (or modified phosphate) moiety; in some embodiments, the present disclosure demonstrates that, surprisingly, an oligonucleotide with an unmodified 5'-end (i.e., with a 5'-OH), can achieve comparable RNAi activity to an otherwise identical oligonucleotide comprising a 5'-phosphate (or modified phosphate) moiety. Thus, among other things, the present disclosure, in some embodiments, provides oligonucleotides whose sequence is directed to an RNAi target site, which oligonucleotides may include one or more other structural features, as described herein and/or otherwise known in the art, that are useful (or are not detrimental) for RNAi activity, wherein the oligonucleotides have a 5'-OH moiety.

In some embodiments, the present disclosure encompasses the recognition that various additional chemical moieties, such as lipid moieties and/or carbohydrate moieties, when incorporated into oligonucleotides, can improve one or more oligonucleotide properties, such as knock down of the target gene or a gene product thereof. In some embodiments, an additional chemical moiety is optional. In some embodiments, an oligonucleotide can comprise more than one additional chemical moiety. In some embodiments, an oligonucleotide can comprise two or more additional chemical moieties, wherein the additional chemical moieties are identical or non-identical, or of the same category (e.g., targeting moiety, carbohydrate moiety, a moiety that binds to ASPGR, lipid moiety, etc.) or not of the same category. In some embodiments, certain additional chemical moieties facilitate delivery of oligonucleotides to desired cells, tissues and/or organs. In some embodiments, certain additional chemical moieties facilitate internalization of oligonucleotides and/or increase oligonucleotide stability.

In some embodiments, the present disclosure provides technologies for incorporating various additional chemical moieties into oligonucleotides. In some embodiments, the present disclosure provides, for example, reagents and methods for introducing additional chemical moieties through nucleobases (e.g., by covalent linkage, optionally via a linker, to a site on a nucleobase).

In some embodiments, the present disclosure demonstrates that surprisingly high target specificity can be achieved with oligonucleotides whose structures include one or more features as described herein.

In some embodiments, the present disclosure provides technologies, e.g., oligonucleotide compositions and methods thereof, that achieve allele-specific suppression, wherein transcripts from one allele of a particular target gene is selectively knocked down relative to at least one other allele of the same gene.

Among other things, the present disclosure provides structural elements, technologies and/or features that can be incorporated into oligonucleotides and can impart or tune one or more properties thereof (e.g., relative to an otherwise identical oligonucleotide lacking the relevant technology or feature). In some embodiments, the present disclosure documents that one or more provided technologies and/or features can usefully be incorporated into oligonucleotide(s) of various sequences.

In some embodiments, the present disclosure demonstrates that certain provided structural elements, technologies and/or features are particularly useful for oligonucleotides that participate in and/or direct RNAi mechanisms (e.g., RNAi agents). Regardless, however, the teachings of the present disclosure are not limited to oligonucleotides that participate in or operate via any particular mechanism. In some embodiments, the present disclosure pertains to any oligonucleotide, useful for any purpose, which operates through any mechanism, and which comprises any sequence, structure or format (or portion thereof) described herein. In some embodiments, the present disclosure provides an oligonucleotide, useful for any purpose, which operates through any mechanism, and which comprises any sequence, structure or format (or portion thereof) described herein, including, but not limited to, any 5'-end structure; 5'-end region; a first region (including but not limited to, a seed region); a second region (including, but not limited to, a post-seed region); and a 3'-end region (which can be a 3'-terminal dinucleotide and/or a 3'-end cap); an optional additional chemical moiety (including but not limited to a targeting moiety, a carbohydrate moiety, a moiety that binds APGR, and a lipid moiety); stereochemistry or patterns of stereochemistry; modification or pattern of modification; internucleotidic linkage or pattern of internucleotidic linkages; modification of sugar(s) or pattern of modifications of sugars; modification of base(s) or patterns of modifications of bases. In some embodiments, provided oligonucleotides may participate in (e.g., direct) RNAi mechanisms. In some embodiments, provided oligonucleotides may participate in RNase H (ribonuclease H) mechanisms. In some embodiments, provided oligonucleotides may act as translational inhibitors (e.g., may provide steric blocks of translation).

In some embodiments, provided oligonucleotides may participate in exon skipping mechanisms. In some embodiments, provided oligonucleotides may be aptamers. In some embodiments, provided oligonucleotides may bind to and inhibit the function of a protein, small molecule, nucleic acid or cell. In some embodiments, provided oligonucleotides may participate in forming a triplex helix with a double-stranded nucleic acid in the cell. In some embodiments, provided oligonucleotides may bind to genomic (e.g., chromosomal) nucleic acid. In some embodiments, provided oligonucleotides may bind to genomic (e.g., chromosomal) nucleic acid, thus preventing or decreasing expression of the nucleic acid (e.g., by preventing or decreasing transcription, transcriptional enhancement, modification, etc.). In some embodiments, provided oligonucleotides may bind to DNA quadruplexes. In some embodiments, provided oligonucleotides may be immunomodulatory. In some embodiments, provided oligonucleotides may be immunostimulatory. In some embodiments, provided oligonucleotides may be immunostimulatory and may comprise a CpG sequence. In some embodiments, provided oligonucleotides may be immunostimulatory and may comprise a CpG sequence and may be useful as an adjuvant. In some embodiments, provided oligonucleotides may be immunostimulatory and may comprise a CpG sequence and may be useful as an adjuvant in treating a disease (e.g., an infectious disease or cancer). In some embodiments, provided oligonucleotides may be therapeutic. In some embodiments, provided oligonucleotides may be non-therapeutic. In some embodiments, provided oligonucleotides may be therapeutic or non-therapeutic. In some embodiments, provided oligonucleotides are useful in therapeutic, diagnostic, research and/or nanomaterials applications. In some embodiments, provided oligonucleotides may be useful for experimental purposes. In some embodiments, provided oligonucleotides may be useful for experimental purposes, e.g., as a probe, in a microarray, etc. In some embodiments, provided oligonucleotides may participate in more than one biological mechanism; in certain such embodiments, for example, provided oligonucleotides may participate in both RNAi and RNase H mechanisms.

In some embodiments, provided oligonucleotides are directed to a target (e.g., a target sequence, a target RNA, a target mRNA, a target pre-mRNA, a target gene, etc.). A target gene is a gene with respect to which expression and/or activity of one or more gene products (e.g., RNA and/or protein products) are intended to be altered. In many embodiments, a target gene is intended to be inhibited. Thus, when an oligonucleotide as described herein acts on a particular target gene, presence and/or activity of one or more gene products of that gene are altered when the oligonucleotide is present as compared with when it is absent.

In some embodiments, a target is a specific allele with respect to which expression and/or activity of one or more products (e.g., RNA and/or protein products) are intended to be altered. In many embodiments, a target allele is one whose presence and/or expression is associated (e.g., correlated) with presence, incidence, and/or severity, of one or more diseases and/or conditions. Alternatively or additionally, in some embodiments, a target allele is one for which alteration of level and/or activity of one or more gene products correlates with improvement (e.g., delay of onset, reduction of severity, responsiveness to other therapy, etc) in one or more aspects of a disease and/or condition.

In some embodiments, where presence and/or activity of a particular allele (a disease-associated allele) is associated (e.g., correlated) with presence, incidence and/or severity of one or more disorders, diseases and/or conditions, a different allele of the same gene exists and is not so associated, or is associated to a lesser extent (e.g., shows less significant, or statistically insignificant correlation). In some such embodiments, oligonucleotides and methods thereof as described herein may preferentially or specifically target the associated allele relative to the one or more less-associated/unassociated allele(s), thus mediating allele-specific suppression.

In some embodiments, a target sequence is a sequence to which an oligonucleotide as described herein binds. In many embodiments, a target sequence is identical to, or is an exact complement of, a sequence of a provided oligonucleotide, or of consecutive residues therein (e.g., a provided oligonucleotide includes a target-binding sequence that is identical to, or an exact complement of, a target sequence). In some embodiments, a target-binding sequence is an exact complement of a target sequence of a transcript (e.g., pre-mRNA, mRNA, etc.). A target-binding sequence/target sequence can be of various lengths to provided oligonucleotides with desired activities and/or properties. In some embodiments, a target binding sequence/target sequence comprises 5-50 (e.g., 10-40, 15-30, 15-25, 16-25, 17-25, 18-25, 19-25, 20-25, 10, 11, 12, 13, 14, 15, 16, 17, 18, 19, 20, 21, 22, 23, 24, 25, or more) bases. In some embodiments, a small number of differences/mismatches is tolerated between (a relevant portion of) an oligonucleotide and its target sequence, including but not limited to the 5' and/or 3'-end regions of the target and/or oligonucleotide sequence. In many embodiments, a target sequence is present within a target gene. In many embodiments, a target sequence is present within a transcript (e.g., an mRNA and/or a pre-mRNA) produced from a target gene.

In some embodiments, a target sequence includes one or more allelic sites (i.e., positions within a target gene at which allelic variation occurs). In some embodiments, an allelic site is a mutation. In some embodiments, an allelic site is a SNP. In some such embodiments, a provided oligonucleotide binds to one allele preferentially or specifically relative to one or more other alleles. In some embodiments, a provided oligonucleotide binds preferentially to a disease-associated allele. For example, in some embodiments, an oligonucleotide (or a target-binding sequence portion thereof) provided herein has a sequence that is, fully or at least in part, identical to, or an exact complement of a particular allelic version of a target sequence.

In some embodiments, an oligonucleotide (or a target-binding sequence portion thereof) provided herein has a sequence that is identical to, or an exact complement of a target sequence comprising an allelic site, or an allelic site, of a disease-associated allele. In some embodiments, an oligonucleotide provided herein has a target binding sequence that is an exact complement of a target sequence comprising an allelic site of a transcript of an allele (in many embodiments, a disease-associated allele), wherein the allelic site is a mutation. In some embodiments, an oligonucleotide provided herein has a target binding sequence that is an exact complement of a target sequence comprising an allelic site of a transcript of an allele (in many embodiments, a disease-associated allele), wherein the allelic site is a SNP. In some embodiments, a sequence is any sequence disclosed herein.

Unless otherwise noted, all sequences (including, but not limited to base sequences and patterns of chemistry, modification, and/or stereochemistry) are presented in 5' to 3' order.

In some embodiments, the present disclosure provides compositions and methods related to an oligonucleotide which is specific to a target and which has any format, structural element or base sequence of any oligonucleotide disclosed herein.

In some embodiments, the present disclosure provides compositions and methods related to an oligonucleotide which is specific to a target and which has or comprises the base sequence of any oligonucleotide disclosed herein, or a region of at least 15 contiguous nucleotides of the base sequence of any oligonucleotide disclosed herein, wherein the first nucleotide of the base sequence or the first nucleotide of the at least 15 contiguous nucleotides can be optionally replaced by T or DNA T. In some embodiments, the oligonucleotide is capable of directing ssRNAi.

In some embodiments, the present disclosure provides compositions and methods for RNA interference directed by a single-stranded RNAi agent. In some embodiments, oligonucleotides of such compositions can have a format, structural element or base sequence of an oligonucleotide disclosed herein.

In some embodiments, the present disclosure provides compositions and methods for RNase H-mediated knockdown of a target gene RNA directed by an oligonucleotide (e.g., an antisense oligonucleotide).

Provided oligonucleotides and oligonucleotide compositions can have any format, structural element or base sequence of any oligonucleotide disclosed herein. In some embodiments, a structural element is a 5'-end structure, 5'-end region, 5'-nucleotide, seed region, post-seed region, 3'-end region, 3'-terminal dinucleotide, 3'-end cap, or any portion of any of these structures, GC content, long GC stretch, and/or any modification, chemistry, stereochemistry, pattern of modification, chemistry or stereochemistry, or a chemical moiety (e.g., including but not limited to, a targeting moiety, a lipid moiety, a GalNAc moiety, a carbohydrate moiety, etc.), any component, or any combination of any of the above.

In some embodiments, the present disclosure provides compositions and methods of use of an oligonucleotide.

In some embodiments, the present disclosure provides compositions and methods of use of an oligonucleotide which can direct both RNA interference and RNase H-mediated knockdown of a target gene RNA. In some embodiments, oligonucleotides of such compositions can have a format, structural element or base sequence of an oligonucleotide disclosed herein.

In some embodiments, an oligonucleotide directing a particular event or activity participates in the particular event or activity, e.g., a decrease in the expression, level or activity of a target gene or a gene product thereof. In some embodiments, an oligonucleotide is deemed to "direct" a particular event or activity when presence of the oligonucleotide in a system in which the event or activity can occur correlates with increased detectable incidence, frequency, intensity and/or level of the event or activity.

In some embodiments, a provided oligonucleotide comprises any one or more structural elements of an oligonucleotide as described herein, e.g., a base sequence (or a portion thereof of at least 15 contiguous bases); a pattern of internucleotidic linkages (or a portion thereof of at least 5 contiguous internucleotidic linkage); a pattern of stereochemistry of internucleotidic linkages (or a portion thereof of at least 5 contiguous internucleotidic linkages); a 5'-end structure; a 5'-end region; a first region; a second region; and a 3'-end region (which can be a 3'-terminal dinucleotide and/or a 3'-end cap); and an optional additional chemical moiety; and, in some embodiments, at least one structural element comprises a chirally controlled chiral center. In some embodiments, a 3'-terminal dinucleotide can comprise two total nucleotides. In some embodiments, an oligonucleotide further comprises a chemical moiety selected from, as non-limiting examples, a targeting moiety, a carbohydrate moiety, a GalNAc moiety, a lipid moiety, and any other chemical moiety described herein or known in the art. In some embodiments, a moiety that binds APGR is a moiety of GalNAc, or a variant, derivative or modified version thereof, as described herein and/or known in the art. In some embodiments, an oligonucleotide is a single-stranded RNAi agent. In some embodiments, a first region is a seed region. In some embodiments, a second region is a post-seed region.

In some embodiments, a provided oligonucleotide comprises any one or more structural elements of a single-stranded RNAi agent as described herein, e.g., a 5'-end structure; a 5'-end region; a seed region; a post-seed region (the region between the seed region and the 3'-end region); and a 3'-end region (which can be a 3'-terminal dinucleotide and/or a 3'-end cap); and an optional additional chemical moiety; and, in some embodiments, at least one structural element comprises a chirally controlled chiral center. In some embodiments, a 3'-terminal dinucleotide can comprise two total nucleotides. In some embodiments, an oligonucleotide further comprises a chemical moiety selected from, as non-limiting examples, a targeting moiety, a carbohydrate moiety, a GalNAc moiety, and a lipid moiety. In some embodiments, a moiety that binds APGR is any GalNAc, or variant, derivative or modification thereof, as described herein or known in the art.

In some embodiments, a provided oligonucleotide comprises any one or more structural elements of an oligonucleotide as described herein, e.g., a 5'-end structure, a 5'-end region, a first region, a second region, a 3'-end region, and an optional additional chemical moiety, wherein at least one structural element comprises a chirally controlled chiral center. In some embodiments, the oligonucleotide comprises a span of at least 5 total nucleotides without 2'-modifications. In some embodiments, the oligonucleotide further comprises an additional chemical moiety selected from, as non-limiting examples, a targeting moiety, a carbohydrate moiety, a GalNAc moiety, and a lipid moiety. In some embodiments, a provided oligonucleotide is capable of directing RNA interference. In some embodiments, a provided oligonucleotide is capable of directing RNase H-mediated knockdown. In some embodiments, a provided oligonucleotide is capable of directing both RNA interference and RNase H-mediated knockdown. In some embodiments, a first region is a seed region. In some embodiments, a second region is a post-seed region.

In some embodiments, a provided oligonucleotide comprises any one or more structural elements of a single-stranded RNAi agent, e.g., a 5'-end structure, a 5'-end region, a seed region, a post-seed region, and a 3'-end region and an optional additional chemical moiety, wherein at least one structural element comprises a chirally controlled chiral center; and, in some embodiments, the oligonucleotide is also capable of directing RNase H-mediated knockdown of a target gene RNA. In some embodiments, the oligonucleotide comprises a span of at least 5 total 2'-deoxy nucleotides. In some embodiments, the oligonucleotide further comprises a chemical moiety selected from, as non-limiting examples, a targeting moiety, a carbohydrate moiety, a GalNAc moiety, and a lipid moiety, and any other additional chemical moiety described herein.

In some embodiments, the present disclosure demonstrates that oligonucleotide properties can be modulated through chemical modifications. In some embodiments, the present disclosure provides an oligonucleotide composition comprising a first plurality of oligonucleotides which have a common base sequence and comprise one or more internucleotidic linkage, sugar, and/or base modifications. In some embodiments, the present disclosure provides an oligonucleotide composition capable of directing single-stranded RNA interference and comprising a first plurality of oligonucleotides which have a common base sequence and comprise one or more internucleotidic linkage, and/or one or more sugar, and/or one or more base modifications. In some embodiments, an oligonucleotide or oligonucleotide composition is also capable of directing RNase H-mediated knockdown of a target gene RNA. In some embodiments, the present disclosure demonstrates that oligonucleotide properties, e.g., activities, toxicities, etc., can be modulated through chemical modifications of sugars, nucleobases, and/or internucleotidic linkages. In some embodiments, the present disclosure provides an oligonucleotide composition comprising a plurality of oligonucleotides which have a common base sequence, and comprise one or more modified internucleotidic linkages (or "non-natural internucleotidic linkages", linkages that can be utilized in place of a natural phosphate internucleotidic linkage (—OP(O)(OH)O—, which may exist as a salt form (—OP(O)(O$^-$)O—) at a physiological pH) found in natural DNA and RNA), one or more modified sugar moieties, and/or one or more natural phosphate linkages. In some embodiments, provided oligonucleotides may comprise two or more types of modified internucleotidic linkages. In some embodiments, a provided oligonucleotide comprises a non-negatively charged internucleotidic linkage. In some embodiments, a non-negatively charged internucleotidic linkage is a neutral internucleotidic linkage. In some embodiments, a neutral internucleotidic linkage comprises a triazole, alkyne, or cyclic guanidine moiety. Such moieties an optionally substituted. In some embodiments, a provided oligonucleotide comprises a neutral internucleotidic linkage and another internucleotidic linkage which is not a neutral backbone. In some embodiments, a provided oligonucleotide comprises a neutral internucleotidic linkage and a phosphorothioate internucleotidic linkage. In some embodiments, provided oligonucleotide compositions comprising a plurality of oligonucleotides are chirally controlled and level of the plurality of oligonucleotides in the composition is controlled or pre-determined, and oligonucleotides of the plurality share a common stereochemistry configuration at one or more chiral internucleotidic linkages. For example, in some embodiments, oligonucleotides of a plurality share a common stereochemistry configuration at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50 or more chiral internucleotidic linkages, each of which is independently Rp or Sp; in some embodiments, oligonucleotides of a plurality share a common stereochemistry configuration at each chiral internucleotidic linkages. In some embodiments, a chiral internucleotidic linkage where a controlled level of oligonucleotides of a composition share a common stereochemistry configuration (independently in the Rp or Sp configuration) is referred to as a chirally controlled internucleotidic linkage. In some embodiments, a modified internucleotidic linkage is a non-negatively charged (neutral or cationic) internucleotidic linkage in that at a pH, (e.g., human physiological pH (~7.4), pH of a delivery site (e.g., an organelle, cell, tissue, organ, organism, etc.), etc.), it largely (e.g., at least 5%, 10%, 20%, 30%, 40%, 50%, 60%, 70%, 80%, 90%, etc.; in some embodiments, at least 30%; in some embodiments, at least 40%; in some embodiments, at least 50%; in some embodiments, at least 60%; in some embodiments, at least 70%; in some embodiments, at least 80%; in some embodiments, at least 90%; in some embodiments, at least 99%; etc.;) exists as a neutral or cationic form (as compared to an anionic form (e.g., —O—P(O)(O$^-$)—O— (the anionic form of natural phosphate linkage), —O—P(O)(S$^-$)—O— (the anionic form of phosphorothioate linkage), etc.)), respectively. In some embodiments, a modified internucleotidic linkage is a neutral internucleotidic linkage in that at a pH, it largely exists as a neutral form. In some embodiments, a modified internucleotidic linkage is a cationic internucleotidic linkage in that at a pH, it largely exists as a cationic form. In some embodiments, a pH is human physiological pH (~7.4). In some embodiments, a modified internucleotidic linkage is a neutral internucleotidic linkage in that at pH 7.4 in a water solution, at least 90% of the internucleotidic linkage exists as its neutral form. In some embodiments, a modified internucleotidic linkage is a neutral internucleotidic linkage in that in a water solution of the oligonucleotide, at least 50%, 60%, 70%, 80%, 90%, 95%, or 99% of the internucleotidic linkage exists in its neutral form. In some embodiments, the percentage is at least 90%. In some embodiments, the percentage is at least 95%. In some embodiments, the percentage is at least 99%. In some embodiments, a non-negatively charged internucleotidic linkage, e.g., a neutral internucleotidic linkage, when in its neutral form has no moiety with a pKa that is less than 8, 9, 10, 11. 12, 13, or 14. In some embodiments, pKa of an internucleotidic linkage in the present disclosure can be represented by pKa of CH$_3$-the internucleotidic linkage-CH$_3$ (i.e., replacing the two nucleoside units connected by the internucleotidic linkage with two —CH$_3$ groups). Without wishing to be bound by any particular theory, in at least some cases, a neutral internucleotidic linkage in an oligonucleotide can provide improved properties and/or activities, e.g., improved delivery, improved resistance to exonucleases and endonucleases, improved cellular uptake, improved endosomal escape and/or improved nuclear uptake, etc., compared to a comparable nucleic acid which does not comprises a neutral internucleotidic linkage.

In some embodiments, a non-negatively charged internucleotidic linkage has the structure of e.g., of formula I-n-1, I-n-2, I-n-3, II, II-a-1, II-a-2, II-b-1, II-b-2, II-c-1, II-c-2, II-d-1, II-d-2, etc. In some embodiments, a non-negatively charged internucleotidic linkage comprises a triazole or alkyne moiety. In some embodiments, a non-negatively charged internucleotidic linkage comprises a cyclic guanidine moiety. In some embodiments, a modified internucleotidic linkage comprising a cyclic guanidine moiety has the structure of:

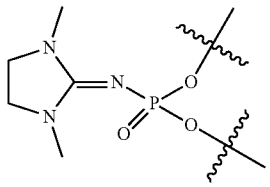

In some embodiments, a neutral internucleotidic linkage comprising a cyclic guanidine moiety is chirally controlled. In some embodiments, the present disclosure pertains to a composition comprising an oligonucleotide comprising at least one neutral internucleotidic linkage and at least one phosphorothioate internucleotidic linkage.

In some embodiments, the present disclosure pertains to a composition comprising an oligonucleotide comprising at least one neutral internucleotidic linkage and at least one phosphorothioate internucleotidic linkage, wherein the phosphorothioate internucleotidic linkage is a chirally controlled internucleotidic linkage in the Sp configuration.

In some embodiments, the present disclosure pertains to a composition comprising an oligonucleotide comprising at least one neutral internucleotidic linkage and at least one phosphorothioate internucleotidic linkage, wherein the phosphorothioate is a chirally controlled internucleotidic linkage in the Rp configuration.

In some embodiments, the present disclosure pertains to a composition comprising an oligonucleotide comprising at least one neutral internucleotidic linkage selected from a neutral internucleotidic linkage comprising an optionally substituted triazolyl group, a neutral internucleotidic linkage comprising an optionally substituted alkynyl group, and a neutral internucleotidic linkage comprising a Tmg group

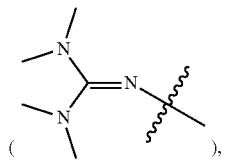

and at least one phosphorothioate.

In some embodiments, the present disclosure pertains to a composition comprising an oligonucleotide comprising at least one neutral internucleotidic linkage selected from a neutral internucleotidic linkage comprising an optionally substituted triazolyl group, a neutral internucleotidic linkage comprising an optionally substituted alkynyl group, and a neutral internucleotidic linkage comprising a Tmg group, and at least one phosphorothioate, wherein the phosphorothioate is a chirally controlled internucleotidic linkage in the Sp configuration.

In some embodiments, the present disclosure pertains to a composition comprising an oligonucleotide comprising at least one neutral internucleotidic linkage selected from a neutral internucleotidic linkage comprising an optionally substituted triazolyl group, a neutral internucleotidic linkage comprising an optionally substituted alkynyl group, and a neutral internucleotidic linkage comprising a Tmg group, and at least one phosphorothioate, wherein the phosphorothioate is a chirally controlled internucleotidic linkage in the Rp configuration.

Various types of internucleotidic linkages differ in properties. Without wishing to be bound by any theory, the present disclosure notes that a natural phosphate linkage (phosphodiester internucleotidic linkage) is anionic and may be unstable when used by itself without other chemical modifications in vivo; a phosphorothioate internucleotidic linkage is anionic, generally more stable in vivo than a natural phosphate linkage, and generally more hydrophobic; a neutral internucleotidic linkage such as one exemplified in the present disclosure comprising a cyclic guanidine moiety is neutral at physiological pH, can be more stable in vivo than a natural phosphate linkage, and more hydrophobic.

In some embodiments, a chirally controlled neutral internucleotidic linkage sis neutral at physiological pH, chirally controlled, stable in vivo, hydrophobic, and may increase endosomal escape.

In some embodiments, provided oligonucleotides comprise one or more regions, e.g., a block, wing, core, 5'-end, 3'-end, middle, seed, post-seed region, etc. In some embodiments, a region (e.g., a block, wing, core, 5'-end, 3'-end, middle region, etc.) comprises a non-negatively charged internucleotidic linkage, e.g., of formula I-n-1, I-n-2, I-n-3, II, II-a-1, II-a-2, II-b-1, II-b-2, II-c-1, II-c-2, II-d-1, II-d-2, etc. In some embodiments, a region comprises a neutral internucleotidic linkage. In some embodiments, a region comprises an internucleotidic linkage which comprises a triazole or alkyne moiety. In some embodiments, a region comprises an internucleotidic linkage which comprises a cyclic guanidine guanidine. In some embodiments, a region comprises an internucleotidic linkage which comprises a cyclic guanidine moiety. In some embodiments, a region comprises an internucleotidic linkage having the structure of

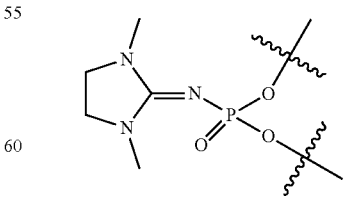

In some embodiments, such internucleotidic linkages are chirally controlled.

In some embodiments, the present disclosure provides an oligonucleotide composition comprising a first plurality of oligonucleotides which have a common base sequence and comprise one or more internucleotidic linkage, sugar, and/or base modifications.

In some embodiments, the present disclosure provides an oligonucleotide composition capable of directing single-stranded RNA interference and comprising a first plurality of oligonucleotides which have a common base sequence and comprise one or more internucleotidic linkage, and/or one or more sugar, and/or one or more base modifications. In some embodiments, an oligonucleotide or oligonucleotide composition is also capable of directing RNase H-mediated knockdown of a target gene RNA.

In some embodiments, a nucleotide is a natural nucleotide. In some embodiments, a nucleotide is a modified nucleotide. In some embodiments, a nucleotide is a nucleotide analog. In some embodiments, a base is a modified base. In some embodiments, a base is protected nucleobase, such as a protected nucleobase used in oligonucleotide synthesis. In some embodiments, a base is a base analog. In some embodiments, a sugar is a modified sugar. In some embodiments, a sugar is a sugar analog. In some embodiments, an internucleotidic linkage is a modified internucleotidic linkage. In some embodiments, a nucleotide comprises a base, a sugar, and an internucleotidic linkage, wherein each of the base, the sugar, and the internucleotidic linkage is independently and optionally naturally-occurring or non-naturally occurring. In some embodiments, a nucleoside comprises a base and a sugar, wherein each of the base and the sugar is independently and optionally naturally-occurring or non-naturally occurring. Non-limiting examples of nucleotides include DNA (2'-deoxy) and RNA (2'-OH) nucleotides; and those which comprise one or more modifications at the base, sugar and/or internucleotidic linkage. Non-limiting examples of sugars include ribose and deoxyribose; and ribose and deoxyribose with 2'-modifications, including but not limited to 2'-F, LNA, 2'-OMe, and 2'-MOE modifications. In some embodiments, an internucleotidic linkage can have a structure of Formula I as described in the present disclosure. In some embodiments, an internucleotidic linkage is a moiety which does not a comprise a phosphorus but serves to link two natural or non-natural sugars.

In some embodiments, the present disclosure provides chirally controlled oligonucleotide compositions that have an improved property and/or activity when compared to a reference condition, e.g., absence of the composition, or presence of a reference composition (e.g., a stereorandom composition of oligonucleotides having the same base sequence and chemical modifications).

In some embodiments, the present disclosure provides a chirally controlled oligonucleotide composition that directs a greater decrease of the expression, activity and/or level of a gene or a gene product thereof, single-stranded RNA interference and/or RNase H-mediated knockdown, when compared to a reference condition, e.g., absence of the composition, or presence of a reference composition (e.g., a stereorandom composition of oligonucleotides having the same base sequence and chemical modifications).

In some embodiments, an oligonucleotide composition comprising a plurality of oligonucleotides is stereorandom in that oligonucleotides of the plurality do not share a common stereochemistry at any chiral internucleotidic linkage. In some embodiments, an oligonucleotide composition comprising a plurality of oligonucleotides is chirally controlled in that oligonucleotides of the plurality share a common stereochemistry at one or more chiral internucleotidic linkages. In some embodiments, an oligonucleotide composition comprising a first plurality of oligonucleotides which is chirally controlled has a decreased susceptibility to endo- and exo-nucleases relative to an oligonucleotide composition comprising a first plurality of oligonucleotides which is stereorandom.

In some embodiments, an oligonucleotide composition is capable of directing a decrease in the expression and/or level of a target gene or its gene product. In some embodiments, an oligonucleotide composition is capable of directing single-stranded RNA interference. In some embodiments, an oligonucleotide composition is capable of directing RNase H-mediated knockdown. In some embodiments, an oligonucleotide composition is capable of directing RNase H-mediated knockdown and RNA interference of a target gene RNA. In some embodiments, an oligonucleotide composition is capable of directing RNase H-mediated knockdown of a first RNA target and RNA interference of a second RNA target, wherein the first and second RNA target are the same or different.

In some embodiments, a composition comprises a multimer of two or more of any: oligonucleotides of a first plurality and/or oligonucleotides of a second plurality, wherein the oligonucleotides of the first and second plurality can independently direct knockdown of the same or different targets independently via RNA interference and/or RNase H-mediated knockdown.

In some embodiments, the present disclosure provides an oligonucleotide composition comprising a first plurality of oligonucleotides which share:

1) a common base sequence;
2) a common pattern of backbone linkages;
3) common stereochemistry independently at at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, or 50 chiral internucleotidic linkages ("chirally controlled internucleotidic linkages");

which composition is chirally controlled in that level of the first plurality of oligonucleotides in the composition is predetermined.

In some embodiments, an oligonucleotide composition comprising a plurality of oligonucleotides (e.g., a first plurality of oligonucleotides) is chirally controlled in that oligonucleotides of the plurality share a common stereochemistry independently at one or more chiral internucleotidic linkages. In some embodiments, oligonucleotides of the plurality share a common stereochemistry configuration at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50 or more chiral internucleotidic linkages, each of which is independently Rp or Sp In some embodiments, oligonucleotides of the plurality share a common stereochemistry configuration at each chiral internucleotidic linkages. In some embodiments, a chiral internucleotidic linkage where a predetermined level of oligonucleotides of a composition share a common stereochemistry configuration (independently Rp or Sp) is referred to as a chirally controlled internucleotidic linkage.

In some embodiments, a predetermined level of oligonucleotides of a provided composition, e.g., a first plurality of oligonucleotides of certain example compositions, comprise 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50 or more chirally controlled internucleotidic linkages.

In some embodiments, at least 5 internucleotidic linkages are chirally controlled; in some embodiments, at least 10 internucleotidic linkages are chirally controlled; in some embodiments, at least 15 internucleotidic linkages are chirally controlled; in some embodiments, each chiral internucleotidic linkage is chirally controlled.

In some embodiments, 1%-100% of chiral internucleotidic linkages are chirally controlled. In some embodiments, at least 5%, 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% of chiral internucleotidic linkages are chirally controlled.

In some embodiments, the present disclosure provides an oligonucleotide composition comprising a first plurality of oligonucleotides which share:

1) a common base sequence;
2) a common pattern of backbone linkages; and
3) a common pattern of backbone chiral centers, which composition is a substantially pure preparation of a single oligonucleotide in that a predetermined level of the oligonucleotides in the composition have the common base sequence and length, the common pattern of backbone linkages, and the common pattern of backbone chiral centers.

In some embodiments, the common pattern of backbone chiral centers comprises at least one internucleotidic linkage comprising a chirally controlled chiral center.

In some embodiments, a predetermined level of oligonucleotides is at least 1%, 5%, 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% of all oligonucleotides in a provided composition. In some embodiments, a predetermined level of oligonucleotides is at least 1%, 5%, 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% of all oligonucleotides in a provided composition that are of or comprise a common base sequence. In some embodiments, all oligonucleotides in a provided composition that are of or comprise a common base sequence are at least 1%, 5%, 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% of all oligonucleotides in the composition. In some embodiments, a predetermined level of oligonucleotides is at least 1%, 5%, 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% of all oligonucleotides in a provided composition that are of or comprise a common base sequence, base modification, sugar modification and/or modified internucleotidic linkage. In some embodiments, all oligonucleotides in a provided composition that are of or comprise a common base sequence, base modification, sugar modification and/or modified internucleotidic linkage are at least 1%, 5%, 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% of all oligonucleotides in the composition. In some embodiments, a predetermined level of oligonucleotides is at least 1%, 5%, 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% of all oligonucleotides in a provided composition that are of or comprise a common base sequence, pattern of base modification, pattern of sugar modification, and/or pattern of modified internucleotidic linkage. In some embodiments, all oligonucleotides in a provided composition that are of or comprise a common base sequence, pattern of base modification, pattern of sugar modification, and/or pattern of modified internucleotidic linkage are at least 1%, 5%, 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% of all oligonucleotides in the composition. In some embodiments, a predetermined level of oligonucleotides is at least 1%, 5%, 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% of all oligonucleotides in a provided composition that share a common base sequence, a common pattern of base modification, a common pattern of sugar modification, and/or a common pattern of modified internucleotidic linkages. In some embodiments, all oligonucleotides in a provided composition that share a common base sequence, a common pattern of base modification, a common pattern of sugar modification, and/or a common pattern of modified internucleotidic linkages are at least 1%, 5%, 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% of all oligonucleotides in the composition.

In some embodiments, a predetermined level is 1-100%. In some embodiments, a predetermined level is at least 1%. In some embodiments, a predetermined level is at least 5%. In some embodiments, a predetermined level is at least 10%. In some embodiments, a predetermined level is at least 20%. In some embodiments, a predetermined level is at least 30%. In some embodiments, a predetermined level is at least 40%. In some embodiments, a predetermined level is at least 50%. In some embodiments, a predetermined level is at least 60%. In some embodiments, a predetermined level is at least 10%. In some embodiments, a predetermined level is at least 70%. In some embodiments, a predetermined level is at least 80%. In some embodiments, a predetermined level is at least 90%. In some embodiments, a predetermined level is at least $5*(\frac{1}{2}^g)$, wherein g is the number of chirally controlled internucleotidic linkages. In some embodiments, a predetermined level is at least $10*(\frac{1}{2}^g)$, wherein g is the number of chirally controlled internucleotidic linkages. In some embodiments, a predetermined level is at least $100*(\frac{1}{2}^g)$, wherein g is the number of chirally controlled internucleotidic linkages. In some embodiments, a predetermined level is at least $(0.80)^g$, wherein g is the number of chirally controlled internucleotidic linkages. In some embodiments, a predetermined level is at least $(0.80)^g$, wherein g is the number of chirally controlled internucleotidic linkages. In some embodiments, a predetermined level is at least $(0.80)^g$, wherein g is the number of chirally controlled internucleotidic linkages. In some embodiments, a predetermined level is at least $(0.85)^g$, wherein g is the number of chirally controlled internucleotidic linkages. In some embodiments, a predetermined level is at least $(0.90)^g$, wherein g is the number of chirally controlled internucleotidic linkages. In some embodiments, a predetermined level is at least $(0.95)^g$, wherein g is the number of chirally controlled internucleotidic linkages. In some embodiments, a predetermined level is at least $(0.96)^g$, wherein g is the number of chirally controlled internucleotidic linkages. In some embodiments, a predetermined level is at least $(0.97)^g$, wherein g is the number of chirally controlled internucleotidic linkages. In some embodiments, a predetermined level is at least $(0.98)^g$, wherein g is the number of chirally controlled internucleotidic linkages. In some embodiments, a predetermined level is at least $(0.99)^g$, wherein g is the number of chirally controlled internucleotidic linkages. In some embodiments, to determine level of oligonucleotides having g chirally controlled internucleotidic linkages in a composition, product of diastereopurity of each of the g chirally controlled internucleotidic linkages: (diastereopurity of chirally controlled internucleotidic linkage 1)*(diastereopurity of chirally controlled internucleotidic linkage 2)* ... *(diastereopurity of chirally controlled internucleotidic linkage g) is utilized as the level, wherein diastereopurity of each chirally controlled internucleotidic linkage is independently represented by diastereopurity of a dimer comprising the same internucleotidic linkage and nucleosides flanking the internucleotidic linkage and prepared under comparable methods as the oligonucleotides (e.g., comparable or preferably identical oligonucleotide preparation cycles, including comparable or preferably identical reagents and reaction conditions).

In some embodiments, levels of oligonucleotides and/or diastereopurity can be determined by analytical methods, e.g., chromatographic, spectrometric, spectroscopic methods or any combinations thereof.

Among other things, the present disclosure encompasses the recognition that stereorandom oligonucleotide preparations contain a plurality of distinct chemical entities that differ from one another, e.g., in the stereochemical structure (or stereochemistry) of individual backbone chiral centers within the oligonucleotide chain. Without control of stereochemistry of backbone chiral centers, stereorandom oligonucleotide preparations provide uncontrolled compositions comprising undetermined levels of oligonucleotide stereoisomers. Even though these stereoisomers may have the same base sequence and/or chemical modifications, they are different chemical entities at least due to their different backbone stereochemistry, and they can have, as demonstrated herein, different properties, e.g., sensitivity to nucleases, activities, distribution, etc. In some embodiments, a particular stereoisomer may be defined, for example, by its base sequence, its length, its pattern of backbone linkages, and its pattern of backbone chiral centers. In some embodiments, the present disclosure demonstrates that improvements in properties and activities achieved through control of stereochemistry within an oligonucleotide can be comparable to, or even better than those achieved through use of chemical modification.

In some embodiments, a provided oligonucleotide, e.g., an oligonucleotide capable of directing a decrease in the expression and/or level of a target gene or its gene product, an oligonucleotide capable of directing single-stranded RNA interference (e.g., a single-stranded RNAi agent, ssRNA or ssRNAi), or an oligonucleotide capable of directing single-stranded RNA interference and RNase H-mediated knockdown, etc, is represented by the structure: 5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-(N26-PX26-N27-PX27)$_{yz}$-(CAP)$_{zz}$-3', wherein each variable is independently as described in the present disclosure.

In some embodiments, PX0 is a 5'-end structure. In some embodiments, each of PX1 to PX26 is independently an internucleotidic linkage. In some embodiments, PX27 is an internucleotidic linkage or OH. In some embodiments, N1 to N27 independently represent a nucleoside. In some embodiments, N1-PX1 to N27-PX27 independently represent a nucleotide. Any nucleoside can be the same or different than any adjacent nucleoside. Any nucleotide can be the same or different than any adjacent nucleotide. In some embodiments, wherein any of mz to yz>1, each base of N18 to N27 can be the same or different; and/or each nucleoside of N18 to N27 can be the same or different and can independently comprise the same or different modification (e.g., 2'-modification). In some embodiments, each of mz, nz, pz, rz, sz, tz, vz and wz can independently be 0 to 10. In some embodiments: if, in -(N18-PX18)$_{mz}$—, mz>1, then each N18 can be the same or different and/or each PX18 can be the same or different; if, in -(N19-PX19)$_{nz}$—, nz>1, each N19 can be the same or different and/or each PX19 can be the same or different; if, in -(N20-PX20)$_{pz}$—, pz>1, then each N20 can be the same or different and/or each PX20 can be the same or different; if, in -(N21-PX21)$_{rz}$—, rz>1, then each N21 can be the same or different and/or each PX21 can be the same or different; if, in -(N22-PX22)$_{sz}$—, sz>1, then each N22 can be the same or different and/or each PX22 can be the same or different; if, in -(N23-PX23)$_{tz}$—, tz>1, then each N23 can be the same or different and/or each PX23 can be the same or different; if, in -(N24-PX24)$_{vz}$-, vz>1, then each N24 can be the same or different and/or each PX24 can be the same or different; if, in -(N25-PX25)$_{wz}$—, wz>1, then each N25 can be the same or different and/or each PX26 can be the same or different; if, in -(N26-PX26-N27-PX27)$_{yz}$—, yz>1, then each N26 can be the same or different and each N27 can be the same or different, and each N26 and N27 can be the same or different and/or each PX26 can be the same or different and/or each PX27 can be the same or different and/or each PX26 and PX27 can be the same or different; etc.

In some embodiments, each N or PX can independently and optionally further comprise one or more additional chemical moiety, e.g., a targeting moiety, a carbohydrate moiety, a GalNAc moiety, a lipid moiety, etc.

In some embodiments, each of PX1 to PX27 independently represents an internucleotidic linkage, wherein each of PX1 to PX27 can be the same or different. In some embodiments, each of PX1 to PX27 independently represents an internucleotidic linkage which is a phosphorodiester, a phosphorothioate, a phosphorothioate in the Sp configuration, a phosphorothioate in the Rp configuration, an internucleotidic linkage, an internucleotidic linkage in the Sp configuration, or an internucleotidic linkage in the Rp configuration, wherein each of PX1 to PX27 can be the same or different.

In some embodiments, a 3'-end region is represented by: -(N26-PX26-N27-PX27)$_{yz}$-(CAP)$_{zz}$, wherein yz=1 and zz=0, or yz=0 and zz=1, or yz=1 and zz=1; -(N26-PX26-N27-PX27)$_{yz}$, wherein yz=1; —(CAP)$_{zz}$, wherein zz=1; or -(N26-PX26-N27-PX27)$_{yz}$-(CAP)$_{zz}$, wherein yz=1 and zz=1.

In some embodiments, PX27 represents an internucleotidic linkage, or —OH. In some embodiments, zz=0, yz=1 and PX27 is —OH. In some embodiments, zz=1 and yz=1, and PX27 is an internucleotidic linkage.

In some embodiments, PX27 represents an internucleotidic linkage which is a phosphorodiester, a phosphorothioate, a phosphorothioate in the Sp configuration, a phosphorothioate in the Rp configuration, an internucleotidic linkage, an internucleotidic linkage in the Sp configuration, or an internucleotidic linkage in the Rp configuration. In some embodiments, PX27 is —OH.

In some embodiments, wherein zz=1 (e.g., in the presence of a CAP), PX27 represents an an internucleotidic linkage which is a phosphorodiester, a phosphorothioate, a phosphorothioate in the Sp configuration, a phosphorothioate in the Rp configuration, an internucleotidic linkage, an internucleotidic linkage in the Sp configuration, or an internucleotidic linkage in the Rp configuration.

In some embodiments, an oligonucleotide comprises, in 5' to 3' order, a 5'-end region, a seed region, a post-seed region, and a 3-end region, optionally further comprising an additional chemical moiety.

In some embodiments, a 5'-end region is the entire portion of an oligonucleotide which is 5' to the seed region. In some embodiments, a 3'-end region is the entire portion of an oligonucleotide which is 3' to the post-seed region.

In some embodiments, a 5'-end region is represented by any of: PX0-, PX0-N1-, PX0-N1-PX1-, PX0-N1-PX1-N2-, PX0-N1-PX1-N2-PX2-, PX0-N1-PX1-N2-PX2-N3-, or PX0-N1-PX1-N2-PX2-N3-PX3-.

In some embodiments, a 5'-end region is represented by any of: PX0-, PX0-N1-, or PX0-N1-PX1-.

In some embodiments, a 5'-end structure is represented by any of: PX0-, PX0-N1-, or PX0-N1-PX1-.

In some embodiments, a 5'-end structure is represented by PX0-.

In some embodiments, a 5'-end structure is a 5'-end group.

In some embodiments, a 5'-end structure comprises a 5'-end group.

In some embodiments, —N1-PX1- represents a 5' nucleotide moiety. In some embodiments, —N1- represents a 5' nucleoside.

In some embodiments, a 5'-end nucleoside is -N1-.

In some embodiments, a 5'-end nucleotide is -N1-PX1-.

In some embodiments, a provided oligonucleotide can comprise a 5'-end region, 5'-end structure, 5'-end group, 5'-end nucleoside, or 5'-end nucleotide described herein or known in the art.

In some embodiments, —PX0-, -PX0-N1-, and -PX0-N1-PX1- is represented by a structure described herein of a 5'-end structure, 5'-end region, 5'-nucleotide, modified 5'-nucleotide, 5'-nucleotide analog, or 5'-nucleoside, modified 5'-nucleoside or 5'-nucleoside analog.

In some embodiments, —N2-PX2-N3-PX3-N4-PX4-N5-PX5-N6-PX6-N7-PX7-represents a seed region. In some embodiments, —N2-PX2-N3-PX3-N4-PX4-N5-PX5-N6-PX6-represents a seed region. In some embodiments, —N3-PX3-N4-PX4-N5-PX5-N6-PX6-N7-PX7-represents a seed region. In some embodiments, —N2-PX2-N3-PX3-N4-PX4-N5-PX5-N6-PX6-N7-PX7-N8-PX8- represents a seed region. In some embodiments, —N3-PX3-N4-PX4-N5-PX5-N6-PX6-N7-PX7-N8-PX8- represents a seed region. In some embodiments, —N3-PX3-N4-PX4-N5-PX5-N6-PX6- represents a seed region. In some embodiments, —N4-PX4-N5-PX5-N6-PX6-N7-PX7-N8-PX8- represents a seed region.

In some embodiments, —N7-PX7-N8-PX8-N9-PX9-N10-PX10-N11-PX11-N12-PX12-N13-PX13-N14-PX14-N15-PX15-N16-PX16-N17-PX17-(N18-PX18)m-(N19-PX19)$_{pz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- represents a post-seed region (e.g., a region between a seed region and 3'-end region).

In some embodiments, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{pz}$-(N20-PX20)$_{pz}$-(N21-PX21)$_{rz}$-(N22-PX22)$_{sz}$-(N23-PX23)$_{rz}$-(N24-PX24)$_{vz}$-(N25-PX25)$_{wz}$- represents a post-seed region.

In some embodiments, —N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{pz}$-(N20-PX20)$_{pz}$-(N21-PX21)$_{rz}$-(N22-PX22)$_{sz}$-(N23-PX23)$_{rz}$-(N24-PX24)$_{vz}$-(N25-PX25)$_{wz}$- represents a post-seed region.

In some embodiments, —N2-PX2-N3-PX3-N4-PX4-N5-PX5-N6-PX6-N7-PX7-represents a seed region, and -N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{pz}$-(N20-PX20)$_{pz}$-(N21-PX21)$_{rz}$-(N22-PX22)$_{sz}$-(N23-PX23)$_{rz}$-(N24-PX24)$_{vz}$-(N25-PX25)$_{wz}$- represents a post-seed region.

In some embodiments, —N2-PX2-N3-PX3-N4-PX4-N5-PX5-N6-PX6- represents a seed region, and -N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{pz}$-(N20-PX20)$_{pz}$-(N21-PX21)$_{rz}$-(N22-PX22)$_{sz}$-(N23-PX23)$_{rz}$-(N24-PX24)$_{vz}$-(N25-PX25)$_{wz}$- represents a post-seed region.

In some embodiments, —N3-PX3-N4-PX4-N5-PX5-N6-PX6-N7-PX7- represents a seed region, and -N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{pz}$-(N20-PX20)$_{pz}$-(N21-PX21)$_{rz}$-(N22-PX22)$_{sz}$-(N23-PX23)$_{rz}$-(N24-PX24)$_{vz}$-(N25-PX25)$_{wz}$- represents a post-seed region.

In some embodiments, —N2-PX2-N3-PX3-N4-PX4-N5-PX5-N6-PX6-N7-PX7-N8-PX8-represents a seed region, and -N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{pz}$-(N20-PX20)$_{pz}$-(N21-PX21)$_{rz}$-(N22-PX22)$_{sz}$-(N23-PX23)$_{rz}$-(N24-PX24)$_{vz}$-(N25-PX25)$_{wz}$- represents a post-seed region.

In some embodiments, —N3-PX3-N4-PX4-N5-PX5-N6-PX6-N7-PX7-N8-PX8-represents a seed region, and -N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{pz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- represents a post-seed region.

In some embodiments, —N3-PX3-N4-PX4-N5-PX5-N6-PX6- represents a seed region, and -N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- represents a post-seed region.

In some embodiments, —N4-PX4-N5-PX5-N6-PX6-N7-PX7-N8-PX8- represents a seed region, and -N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21), 7-(N22-PX22)$_{sz}$-(N23-PX23)$_{tz}$-(N24-PX24)$_{vz}$-(N25-PX25)$_{wz}$- represents a post-seed region.

In some embodiments, 5'-PX0-N1-PX1- represents a 5'-end region; —N2-PX2-N3-PX3-N4-PX4-N5-PX5-N6-PX6-N7- represents a seed region; -PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- represents a post-seed region; and -(N26-PX26-N27-PX27)$_{yz}$-(CAP)$_{zz}$-3' represents a 3'-end region.

In some embodiments, 5'-PX0-N1-PX1- represents a 5'-end region; —N2-PX2-N3-PX3-N4-PX4-N5-PX5-N6-PX6- represents a seed region; —N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$ represents a post-seed region; and -(N26-PX26-N27-PX27)$_{yz}$-(CAP)$_{zz}$-3' represents a 3'-end region.

In some embodiments, 5'-PX0-N1-PX1-N2-PX2- represents a 5'-end region; —N3-PX3-N4-PX4-N5-PX5-N6-

PX6-N7-PX7- represents a seed region; —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$ represents a post-seed region; and -(N26-PX26-N27-PX27)$_{yz}$-(CAP)$_{zz}$-3' represents a 3'-end region.

In some embodiments, 5'-PX0-N1-PX1-N2-PX2- represents a 5'-end region; —N3-PX3-N4-PX4-N5-PX5-N6-PX6-N7-PX7-N8-PX8- represents a seed region; —N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N2 I -PX21)$_{rz}$-(N22-PX22)$_{sz}$-(N23-PX23)$_{tz}$-(N24-PX24)$_{vz}$-(N25-PX25)$_{wz}$ represents a post-seed region; and -(N26-PX26-N27-PX27)$_{yz}$-(CAP)$_{zz}$-3' represents a 3'-end region.

In some embodiments, 5'-PX0-N1-PX1- represents a 5'-end region; —N2-PX2-N3-PX3-N4-PX4-N5-PX5-N6-PX6-N7-PX7-N8- represents a seed region; -PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$ represents a post-seed region; and -(N26-PX26-N27-PX27)$_{yz}$-(CAP)$_{zz}$-3' represents a 3'-end region.

In some embodiments, 5'-PX0-N1-PX1-N2-PX2- represents a 5'-end region; —N3-PX3-N4-PX4-N5-PX5-N6-PX6- represents a seed region; —N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$ represents a post-seed region; and -(N26-PX26-N27-PX27)$_{yz}$-(CAP)$_{zz}$-3' represents a 3'-end region.

In some embodiments, each of mz, nz, pz, rz, sz, tz, vz and wz is independently 0 to 10.

In some embodiments, each of mz, nz, pz, rz, sz, tz, vz and wz can independently be 0 to 10, and the total length of the oligonucleotide is no more than about 49 nucleotides. In some embodiments, each of mz, nz, pz, rz, sz, tz, vz and wz can independently be 0 to 10, and the total length of the oligonucleotide is no more than about 45 nucleotides. In some embodiments, each of mz, nz, pz, rz, sz, tz, vz and wz can independently be 0 to 10, and the total length of the oligonucleotide is no more than about 40 nucleotides. In some embodiments, each of mz, nz, pz, rz, sz, tz, vz and wz can independently be 0 to 10, and the total length of the oligonucleotide is no more than about 35 nucleotides. In some embodiments, each of mz, nz, pz, rz, sz, tz, vz and wz can independently be 0 to 10, and the total length of the oligonucleotide is no more than about 30 nucleotides. In some embodiments, each of mz, nz, pz, rz, sz, tz, vz and wz can independently be 0 to 10, and the total length of the oligonucleotide is no more than about 25 nucleotides. In some embodiments, each of mz, nz, pz, rz, sz, tz, vz and wz can independently be 0 to 10, and the total length of the oligonucleotide is no more than about 23 nucleotides. In some embodiments, each of mz, nz, pz, rz, sz, tz, vz and wz can independently be 0 to 10, and the total length of the oligonucleotide is no more than about 21 nucleotides.

In some embodiments, -(N26-PX26-N27-PX27)$_{yz}$-represents a 3'-terminal dinucleotide, wherein $_{yz}$ is 1. When yz=0, the 3'-terminal dinucleotide is absent. When yz=1, the 3'-terminal dinucleotide is present.

In some embodiments, —(CAP)$_{zz}$- represents an optional 3'-end cap, wherein zz is 0 or 1. When zz=0, the CAP is absent. When zz=1, the CAP is present.

In some embodiments, if yz=1, then zz=0. In some embodiments, if yz=0, zz=1. In some embodiments, yz=1 and zz=1, indicating that the molecule comprises both a 3'-terminal dinucleotide and a CAP.

In some embodiments, a 5'-end structure, a 5'-end region, 5' nucleotide moiety, seed region, post-seed region, 3'-terminal dinucleotide and/or 3'-end cap independently have any structure described herein or known in the art. In some embodiments, any structure for a 5'-end described herein or known in the art and/or any structure for a 5' nucleotide moiety described herein or known in the art and/or any structure for a seed region described herein or known in the art and/or any structure for a post-seed region described herein or known in the art and/or any structure for a 3'-terminal dinucleotide described herein or known in the art and/or any structure for a 3'-end cap described herein or known in the art can be combined.

In some embodiments, a provided oligonucleotide comprises one or more blocks. In some embodiments, a provided oligonucleotide comprise one or more blocks, wherein a block comprises one or more consecutive nucleosides, and/or nucleotides, and/or sugars, or bases, and/or internucleotidic linkages. In some embodiments, a block encompasses an entire seed region or a portion thereof. In some embodiments, a block encompasses an entire post-seed region or a portion thereof.

In some embodiments, provided oligonucleotides are blockmers.

In some embodiments, provided oligonucleotide are altmers.

In some embodiments, provided oligonucleotides are altmers comprising alternating blocks. In some embodiments, a blockmer or an altmer can be defined by chemical modifications (including presence or absence), e.g., base modifications, sugar modification, internucleotidic linkage modifications, stereochemistry, etc., or patterns thereof.

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides comprise one or more blocks comprising two or more different internucleotidic linkages. In some embodiments, provided oligonucleotides comprise one or more blocks comprising two or more total modified internucleotidic linkages and natural phosphate linkages. In some embodiments, provided oligonucleotides comprise one or more blocks comprising two or more different modified internucleotidic linkages. In some embodiments, provided oligonucleotides comprise alternating blocks comprising two or more different internucleotidic linkages. In some embodiments, provided oligonucleotides comprise alternating blocks comprising two or more total modified internucleotidic linkages and natural phosphate linkages. In some embodiments, provided oligonucleotides comprise alternating blocks comprising two or more different modified internucleotidic linkages. In some embodiments, a block comprising modified internucleotidic linkages have pattern of backbone chiral centers as described herein. In some embodiments, each block comprising modified internucleotidic linkages has the same pattern of backbone chiral centers. In some embodiments, blocks comprising modified internucleotidic linkages have different patterns of backbone chiral centers. In some embodiments, blocks comprising modified internucleotidic linkages have different length and/or modifications. In some embodiments, blocks comprising modified internucleotidic linkages have the same length and/or modifications. In some embodiments, blocks comprising modified internucleotidic linkages have the same length. In some embodiments, blocks comprising modified internucleotidic linkages have the same internucleotidic linkages.

In some embodiments, provided oligonucleotides are capable of directing single-stranded RNA interference and comprise a first block in the seed region (seed region-block), and a second block in the post-seed region (post-seed region-block), each of which independently comprise one or more modified internucleotidic linkages. In some embodiments, each of the seed region- and post-seed region-blocks independently comprises 2, 3, 4, 5, 6, 7 or more modified internucleotidic linkages. In some embodiments, a seed region-block comprises 4 or more modified internucleotidic linkages. In some embodiments, a seed region-block comprises 5 or more modified internucleotidic linkages. In some embodiments, a seed region-block comprises 6 or more modified internucleotidic linkages. In some embodiments, a seed region-block comprises 7 modified internucleotidic linkages. In some embodiments, a post-seed region-block comprises 4 or more modified internucleotidic linkages. In some embodiments, a post-seed region-block comprises 5 or more modified internucleotidic linkages. In some embodiments, a post-seed region-block comprises 6 or more modified internucleotidic linkages. In some embodiments, a post-seed region-block comprises 7 or more modified internucleotidic linkages. In some embodiments, each of the seed region- and post-seed region-blocks independently comprises at least 4 modified internucleotidic linkages. In some embodiments, each of the seed region- and post-seed region-blocks independently comprises at least 5 modified internucleotidic linkages. In some embodiments, each of the seed region- and post-seed region-blocks independently comprises at least 6 modified internucleotidic linkages. In some embodiments, each of the seed region- and post-seed region-blocks independently comprises at least 7 modified internucleotidic linkages. In some embodiments, modified internucleotidic linkages within a block are consecutive. In some embodiments, each linkage of the seed region-block is independently a phosphorothioate linkage. In some embodiments, each linkage of the seed region-block is independently chirally controlled. In some embodiments, each linkage of the seed region-block is Sp. In some embodiments, each linkage of the post-seed region-block is independently a modified internucleotidic linkage. In some embodiments, each linkage of the post-seed region-block is independently a phosphorothioate linkage. In some embodiments, each linkage of the post-seed region-block is independently chirally controlled. In some embodiments, each linkage of the post-seed region-block is Sp.

In some embodiments, provided oligonucleotides comprise one or more sugar modifications. In some embodiments, a sugar modification is at the 2'-position. In some embodiments, a sugar modification is selected from: 2'-F, 2'-OMe, and 2'-MOE. 2'-F is also designated 2' Fluoro. 2'-OMe is also designated 2'-O-Methyl. 2'-MOE is also designated 2'-Methoxyethyl or MOE.

In some embodiments, provided oligonucleotides are capable of directing single-stranded RNA interference and comprise a first block in the seed region (seed region-block), and a second block in the post-seed region (post-seed region-block), each of which independently comprise one or more 2'-F. In some embodiments, each of the seed region- and post-seed region-blocks independently comprises 2, 3, 4, 5, 6, 7 or more 2'-F. In some embodiments, each of the seed region- and post-seed region-blocks independently comprises 2, 3, 4, 5, 6, 7 or more consecutive 2'-F. In some embodiments, a seed region-block comprises 4 or more 2'-F. In some embodiments, a seed region-block comprises 5 or more 2'-F. In some embodiments, a seed region-block comprises 6 or more 2'-F. In some embodiments, a seed region-block comprises 7 2'—F. In some embodiments, a post-seed region-block comprises 4 or more 2'-F. In some embodiments, a post-seed region-block comprises 5 or more 2'-F. In some embodiments, a post-seed region-block comprises 6 or more 2'-F. In some embodiments, a post-seed region-block comprises 7 or more 2'-F. In some embodiments, each of the seed region- and post-seed region-blocks independently comprises at least 4 2'—F. In some embodiments, each of the seed region- and post-seed region-blocks independently comprises at least 5 2'—F. In some embodiments, each of the seed region- and post-seed region-blocks independently comprises at least 6 2'—F. In some embodiments, each of the seed region- and post-seed region-blocks independently comprises at least 7 2'—F. In some embodiments, 2'-F within a block are consecutive.

In some embodiments, an oligonucleotide comprises one, two, three, four, five, six, seven, eight, nine, ten, or more 2'-F. In some embodiments, an oligonucleotide comprises two, three, four, five, six, seven, eight, nine, ten, or more consecutive sugar moieties comprising 2'-F.

In some embodiments, an oligonucleotide comprises only two 2'-F. In some embodiments, an oligonucleotide comprises only two 2'-F, wherein the two nucleotides are at the 2nd and 14th positions. Non-limiting examples of such oligonucleotides include: oligonucleotides of Format 70, FIG. 1F, and WV-7540 and WV-7543.

In some embodiments, an oligonucleotide comprises only two 2'-F, wherein the two nucleotides are at the 2nd and 14th positions, and wherein the first nucleotide (5'-end nucleotide or -N1-PX1-) is 2'-deoxy. Non-limiting examples of such an oligonucleotide include: Format 70, FIG. 1F, and WV-7540 and WV-7543.

In some embodiments, an oligonucleotide comprises only two 2'-F, wherein the two nucleotides are at the 2nd and 14th positions, and wherein the first nucleotide (5'-end nucleotide or -N1-PX1-) is 2'-deoxy T. Non-limiting examples of such an oligonucleotide include: Format 70, FIG. 1F, and WV-7540 and WV-7543.

In some embodiments, an oligonucleotide comprises only two 2'-F, wherein the two nucleotides are at the 2nd and 14th positions, and wherein the first nucleotide (5'-end nucleotide or -N1-PX1-) is 2'-deoxy, and the 5'-end structure (PX0) is —OH. Non-limiting examples of such an oligonucleotide include: oligonucleotides of Format 70, FIG. 1F, and WV-7540 and WV-7543.

In some embodiments, an oligonucleotide comprises only two 2'-F, wherein the two nucleotides are at the 2nd and 14th positions, and wherein the first nucleotide (5'-end nucleotide or -N1-PX1-) is 2'-deoxy T, and the 5'-end structure (PX0) is —OH. Non-limiting examples of such an oligonucleotide include: Format 70, FIG. 1F, and WV-7540 and WV-7543.

In some embodiments herein, in reference to an oligonucleotide, "first" (e.g., first nucleotide) refers to the 5' end of the oligonucleotide, and "last" or "end" (e.g., last nucleotide or end nucleotide) refers to the 3' end.

In some embodiments, provided oligonucleotides comprise sugars with a particular modification which alternate with sugars with no modification or a different modification. In some embodiments, sugars with a particular modification appear in one or more blocks.

In some embodiments, provided oligonucleotides comprise one or more blocks comprising sugars with a particular 2' modification which alternate with sugars which independently have no modification or have a different modification. In some embodiments, provided oligonucleotides comprise one or more blocks comprising sugars with a 2'-F modification which alternate with sugars which independently have no modification or have a different modification. In some embodiments, provided oligonucleotides comprise one or more blocks comprising sugars with a 2'-OMe modification which alternate with sugars which independently have no modification or a different modification. In some embodiments, provided oligonucleotides one or more blocks comprising sugars with a 2'-OMe modification which alternate with sugars with a 2'-F modification.

In some embodiments, a block of sugars has or comprises a pattern of 2'-modifications of any of: ff, ffm, fffmm, fffmmm, fffmmmm, fffmmmmm, fffmmmmmm, fffmmmmmmf, fffmmmmmmff, fffmmmmmmffm, fffmmmmmmffmm, fffmmmmmmffmmf, fffmmmmmmffmmfm, fffmmmmmmffmmfmf, fffmmmmmmffmmfmfm, fffmmmmmmffmmfmfmf, fffmmmmmmffmmfmfmfm, fffmmmmmmffmmfmfmfmf, fffmmmmmmffmmfmfmfmmm, ffmmffmm, ffmmmmmmffmmfmfmfmmm, fmfmfmfmfmfmfm, fmfmfmfmfmfmfmf, fmfmfmfmfmfmfmfm, fmfmfmfmfmfmfmfmf, fmfmfmfmfmfmfmfmfm, fmfmfmfmfmfmfmfmfmf, fmfmfmfmfmfmfmfmfmfm, fmfmfmfmfmfmfmfmfmmm, fmfmfmfmfmfmfmfmmm, fmfmfmfmfmfmfmfmmm, fmfmfmfmfmfmfmmm, fmfmfmfmfmfmmm, fmmffmm, fmmmmmmffmmfmfmfmmm, mff, mffm, mffmf, mffmff, mffmffm, mffmmffmm, mfmfm, mfmfmfmfmfmfffmfmfmfmmm, mfmfmfmfmfmfmfmfm, mfmfmfmfmfmfmfmfmmm, mfmfmfmfmfmfmfmfmmm, mfmfmfmfmfmfmfmfmmm, mfmfmfmfmfmfmmm, mfmfmfmfmfmfmmm, mfmfmfmfmfmmfm, mfmfmfmfmfmmmm, mfmfmfmfmmm, mfmfmfmfmmmfm, mfmfmfmfmmmfmmmm, mfmfmfmmm, mfmfmfmmmfmfmmm, mfmfmfmmmmfmfm, mfmfmmmfmfmfm, mfmfmmmfmfmmmfm, mfmfmmmmfmfmfm, mfmfmmmmfmfmmm, mfmmmmfmfmfmmm, mfmmm, mfmmmfmfmfmfmmm, mfmmmmfmfmfmmm, mfmmmmfmfmmmfm, mfmmmmfmmmfmfm, mfmmmmfmmmfmfmfm, mfmmmmmfmfmfm, mmffm, mmffmm, mmffmm, mmffmmf, mmffmmff, mmffmmffm, mmffmmffmm, mmffmmfmfmmm, mmm, mmmffmmfmfmmm, mmmfmfmfmfmfm, mmmffmfmfmfmmm, mmmfmfmfmmmfm, mmmfmfmfmmm, mmmfmmmfmfmmmfm, mmmfmmmfmfmmm, mmmfmmmmfmfm, mmmfmmmfmfmfm, mmmmfmmmfmfmmm, mmm, mmmm, mmmmm, mmmmmffmmfmfmfmmm, mmmmmfmfmfmfm, mmmmm, mmmmmmffmmfmfmfmmm, mfmf, mfmf, mfmfmf, fmfm, fmfmfm, fmfmfmf, dfdf, dfdfdf, dfdfdfdf, fdfd, fdfdfd, fdfdfdfd, dfdfmfmf, dfmfmf, mfdfmf, or dfmfdf, wherein m indicates a 2'-OMe, f indicates a 2'-F, and d indicates no substitution at 2'-position. In some embodiments, a seed region and/or post-seed region can comprise a block of sugar modifications.

In some embodiments, a block is a stereochemistry block. In some embodiments, a block is an Rp block in that each internucleotidic linkage of the block is Rp. In some embodiments, a seed region-block is an Rp block. In some embodiments, a post-seed region-block is an Rp block. In some embodiments, a block is an Sp block in that each internucleotidic linkage of the block is Sp. In some embodiments, a seed region-block is an Sp block. In some embodiments, a post-seed region-block is an Sp block. In some embodiments, provided oligonucleotides comprise both Rp and Sp blocks. In some embodiments, provided oligonucleotides comprise one or more Rp but no Sp blocks. In some embodiments, provided oligonucleotides comprise one or more Sp but no Rp blocks. In some embodiments, provided oligonucleotides comprise one or more PO blocks wherein each internucleotidic linkage of the block is a natural phosphate linkage.

In some embodiments, a seed region-block is an Sp block wherein each sugar moiety comprises a 2'-F modification. In some embodiments, a seed region-block is an Sp block wherein each of internucleotidic linkage is a modified internucleotidic linkage and each sugar moiety comprises a 2'-F modification. In some embodiments, a seed region-block is an Sp block wherein each of internucleotidic linkage is a phosphorothioate linkage and each sugar moiety comprises a 2'-F modification. In some embodiments, a seed region-block comprises 4 or more nucleoside units. In some embodiments, a nucleoside unit is a nucleoside. In some embodiments, a seed region-block comprises 5 or more nucleoside units. In some embodiments, a seed region-block comprises 6 or more nucleoside units. In some embodiments, a seed region-block comprises 7 or more nucleoside units. In some embodiments, a post-seed region-block is an Sp block wherein each sugar moiety comprises a 2'-F modification. In some embodiments, a post-seed region-block is an Sp block wherein each of internucleotidic linkage is a modified internucleotidic linkage and each sugar moiety comprises a 2'-F modification. In some embodiments, a post-seed region-block is an Sp block wherein each of internucleotidic linkage is a phosphorothioate linkage and each sugar moiety comprises a 2'-F modification. In some embodiments, a post-seed region-block comprises 4 or more nucleoside units. In some embodiments, a post-seed region-block comprises 5 or more nucleoside units. In some embodiments, a post-seed region-block comprises 6 or more nucleoside units. In some embodiments, a post-seed region-block comprises 7 or more nucleoside units. In some embodiments, a seed region and/or post-seed region can comprise a block. In some embodiments, a seed region and/or post-seed region comprises a stereochemistry block.

In some embodiments, a type of nucleoside in a region, a block, or an oligonucleotide is followed by a specific type of internucleotidic linkage, e.g., natural phosphate linkage, modified internucleotidic linkage, Rp chiral internucleotidic linkage, Sp chiral internucleotidic linkage, etc. In some embodiments, A is followed by a Sp internucleotidic linkage. In some embodiments, A is followed by a Rp internucleotidic linkage. In some embodiments, A is followed by a natural phosphate linkage (PO). In some embodiments, U is followed by a Sp internucleotidic linkage. In some embodiments, U is followed by a Rp internucleotidic linkage. In some embodiments, U is followed by a natural phosphate linkage (PO). In some embodiments, C is followed by a Sp internucleotidic linkage. In some embodiments, C is followed by a Rp internucleotidic linkage. In some embodiments, C is followed by a natural phosphate linkage (PO). In some embodiments, G is followed by a Sp internucleotidic linkage. In some embodiments, G is followed by a Rp internucleotidic linkage. In some embodiments, G is followed by a natural phosphate linkage (PO). In some embodiments, C and U are followed by Sp internucleotidic linkages. In some embodiments, C and U are followed by Rp internucleotidic linkages. In some embodiments, C and U are followed by natural phosphate linkages (PO). In some embodiments, A and G are followed by Sp internucleotidic linkages. In some embodiments, A and G are followed by Rp internucleotidic linkages. In some embodiments, A and G are followed by natural phosphate linkages (PO).

In some embodiments, provided oligonucleotides comprise alternating blocks comprising modified sugar moieties and unmodified sugar moieties. In some embodiments, modified sugar moieties comprise 2'-modifications. In some embodiments, provided oligonucleotides comprise alternating 2'-OMe modified sugar moieties and unmodified sugar moieties.

In some embodiments, provided oligonucleotides comprise one or more 2'-F modified sugar moieties whose 3'-internucleotidic linkages are modified internucleotidic linkages. In some embodiments, a modified internucleotidic linkage is phosphorothioate. In some embodiments, a modified internucleotidic linkage is chirally controlled and is Rp. In some embodiments, a modified internucleotidic linkage is chirally controlled and is Sp. In some embodiments, provided oligonucleotides comprise one or more 2'—OR$^1$ modified sugar moieties whose 3'-internucleotidic linkages are natural phosphate linkages.

In some embodiments, a provided oligonucleotide has a pattern of backbone chiral centers which comprises or is (Sp)m(Rp)n, (Rp)n(Sp)m, (Np)t(Rp)n(Sp)m, or (Sp)t(Rp)n(Sp)m (unless otherwise specified, description of patterns of modifications and stereochemistry are from 5' to 3' as typically used in the art). In some embodiments, a provided pattern of backbone chiral centers comprises or is (Sp)m(Rp)n. In some embodiments, a provided pattern of backbone chiral centers comprises or is (Rp)n(Sp)m. In some embodiments, a provided pattern of backbone chiral centers comprises or is (Np)t(Rp)n(Sp)m. In some embodiments, a provided pattern of backbone chiral centers comprises or is (Np)tRp(Sp)m. In some embodiments, a provided pattern of backbone chiral centers comprises or is (Sp)tRp(Sp)m. In some embodiments, a provided pattern of backbone chiral centers comprises repeating (Sp)m(Rp)n, (Rp)n(Sp)m, (Np)t(Rp)n(Sp)m, or (Sp)t(Rp)n(Sp)m units. In some embodiments, a repeating unit is (Sp)m(Rp)n. In some embodiments, a repeating unit is SpRp. In some embodiments, a repeating unit is SpSpRp. In some embodiments, a repeating unit is SpRpRp. In some embodiments, a repeating unit is RpRpSp. In some embodiments, a repeating unit is (Rp)n(Sp)m. In some embodiments, a repeating unit is (Np)t(Rp)n(Sp)m. In some embodiments, a repeating unit is (Sp)t(Rp)n(Sp)m.

In some embodiments, t, n and m each are independently 1-20. In some embodiments, n is 1. In some embodiments, m is at least 2, 3, 4, 5, 6, 7, 8, 9, 10, 11, 12, 13, 14, or 15. In some embodiments, m is 2, 3, 4, 5, 6, 7, 8, 9, 10, 11, 12, 13, 14, or 15. In some embodiments, t is at least 2, 3, 4, 5, 6, 7, 8, 9, 10, 11, 12, 13, 14, or 15. In some embodiments, t is 2, 3, 4, 5, 6, 7, 8, 9, 10, 11, 12, 13, 14, or 15. In some embodiments, each of m and t is independently at least 2, 3, 4, 5, 6, 7, 8, 9, 10, 11, 12, 13, 14, or 15. In some embodiments, each of m and t is independently 2, 3, 4, 5, 6, 7, 8, 9, 10, 11, 12, 13, 14, or 15. In some embodiments, at least one of m and t is at least 5, 6, 7, 8, 9, 10, 11, 12, 13, 14, or 15. In some embodiments, m is at least 5, 6, 7, 8, 9, 10, 11, 12, 13, 14, or 15. In some embodiments, t is at least 5, 6, 7, 8, 9, 10, 11, 12, 13, 14, or 15.

In some embodiments, a region comprising a pattern, or a repeating pattern, of backbone chiral centers of (Sp)m(Rp)n, (Rp)n(Sp)m, (Np)t(Rp)n(Sp)m, or (Sp)t(Rp)n(Sp)m (structurally starting from the first, and ending at the last, internucleotidic linkage of the internucleotidic linkages which have the pattern, or the repeating pattern, of (Sp)m(Rp)n, (Rp)n(Sp)m, (Np)t(Rp)n(Sp)m, or (Sp)t(Rp)n(Sp)m, respectively; a "(repeating) (Sp)m(Rp)n region", a "(repeating) (Rp)n(Sp)m region", a "(repeating) (Np)t(Rp)n(Sp)m region", or a "(repeating) (Sp)t(Rp)n(Sp)m region", respectively, depending on repeating or not. For example, a (Sp)t(Rp)n(Sp)m region ((Sp)7(Rp)1(Sp)3) in WV-2555: mA*SmGmCmUmU*SC*ST*ST*SG*ST*SC*SC*RA*SG*SC*SmUmUmUmA*SmU (SEQ ID NO:1)) comprises no 2'—OR sugar modifications. In some embodiments, each sugar moieties in the region is —CH$_2$— at the 2'-position. In some embodiments, each sugar moieties in the region is an unmodified, natural, 2'-deoxyribose moiety of DNA. In some embodiments, a region comprising a pattern, or a repeating pattern, of backbone chiral centers which comprises or is (Sp)m(Rp)n, (Rp)n(Sp)m, (Np)t(Rp)n(Sp)m, or (Sp)t(Rp)n(Sp)m is flanked by a 5'-end region, which structurally ends with a nucleoside moiety (which nucleoside moiety, at its 3'-end, is connected to the first internucleotidic linkage of the region comprising a pattern, or a repeating pattern, of backbone chiral centers which comprises or is (Sp)m(Rp)n, (Rp)n(Sp)m, (Np)t(Rp)n(Sp)m, or (Sp)t(Rp)n(Sp)m. For example, a flanking 5'-end region in WV-2555: mA*SmGmCmUmU*SC*ST*ST*SG*ST*SC*SC*RA*SG*SC*SmUmUmUmA*SmU (SEQ ID NO:1)). In some embodiments, a region comprising a pattern, or a repeating pattern, of backbone chiral centers which comprises or is (Sp)m(Rp)n, (Rp)n(Sp)m, (Np)t(Rp)n(Sp)m, or (Sp)t(Rp)n(Sp)m is flanked by a 3'-end region, which structurally starts with a nucleoside moiety (which nucleoside moiety, at its 5'-end, is connected to the last internucleotidic linkage of the region comprising a pattern, or a repeating pattern, of backbone chiral centers which comprises or is (Sp)m(Rp)n, (Rp)n(Sp)m, (Np)t(Rp)n(Sp)m, or (Sp)t(Rp)n(Sp)m. For example, a flanking 3'-end region in WV-2555: mA*SmGmCmUmU*SC*ST*ST*SG*ST*SC*SC*RA*SG*SC*SmUmUmUmA*SmU (SEQ ID NO:1)). In some embodiments, a region comprising a pattern, or a repeating pattern, of backbone chiral centers which comprises or is (Sp)m(Rp)n, (Rp)n(Sp)m, (Np)t(Rp)n(Sp)m, or (Sp)t(Rp)n(Sp)m is flanked by a 5'-end and a 3'-end region. In some embodiments, the flanking 5'-end region and/or the 3'-end region comprise a modified internucleotidic linkage. In some embodiments, the flanking 5'-end region and/or the 3'-end region comprise a modified internucleotidic linkage comprising a Sp linkage phosphorus. In some embodiments, the flanking 5'-end region and/or the 3'-end region comprise a Sp phosphorothioate linkage. In some embodiments, the flanking 5'-end region and/or the 3'-end region comprise one or more natural phosphate linkages. In some embodiments, the flanking 5'-end region and/or the 3'-end region comprise one or more consecutive natural phosphate linkages. In some embodiments, the flanking 5'-end comprises only one modified internucleotidic linkage which is the 5'-end internucleotidic linkage, and one or more consecutive natural phosphate linkages (for example, in WV-2555: mA*SmGmCmUmU*SC*ST* ST*SG*ST*SC*SC*RA*SG*SC*SmUmUmUmA*SmU (SEQ ID NO:1) (SOOOSSSSSSSRSSSOOOS)). In some embodiments, the flanking 3'-end comprises only one modified internucleotidic linkage which is the 3'-end internucleotidic linkage, and one or more consecutive natural phosphate linkages (for example, in WV-2555: mA*SmGmCmUmU*SC*ST*ST*SG*ST*SC*SC*RA* SG*SC*SmUmUmUmA*SmU (SEQ ID NO:1) (SOOOSSSSSSSRSSSOOOS)). In some embodiments, the flanking 5'-end region and/or the 3'-end region comprise 2'-modified sugar units. In some embodiments, each sugar unit in the 5'-end region and/or the 3'-end region is independently modified. In some embodiments, each sugar unit in the 5'-end region and/or the 3'-end region independently comprises a 2'-modification (for example, in WV-2555: mA*SmGmCmUmU*SC*ST*ST*SG*ST*SC*SC*RA* SG*SC*SmUmUmUmA*SmU. In some embodiments, each sugar unit in the 5'-end region and/or the 3'-end region comprises the same 2'-modification. In some embodiments, a 2'-modification is 2'—OR, wherein R is optionally substituted $C_{1-6}$ aliphatic. In some embodiments, a 2'-modification is 2'-OMe. In some embodiments, a 2'-modification is 2'-MOE. In some embodiments, a 2'-modification is a LNA modification (which comprises a type of C2-C4 bridge).

In some embodiments, a provided pattern of backbone chiral centers comprises (Rp/Sp)-(All Rp or All Sp)-(Rp/Sp). In some embodiments, a provided pattern of backbone chiral centers comprises (Rp)-(All Sp)-(Rp). In some embodiments, a provided pattern of backbone chiral centers comprises (Sp)-(All Sp)-(Sp). In some embodiments, a provided pattern of backbone chiral centers comprises (Sp)-(All Rp)-(Sp). In some embodiments, a provided pattern of backbone chiral centers comprises (Rp/Sp)-(repeating (Sp)m(Rp)n)-(Rp/Sp). In some embodiments, a provided pattern of backbone chiral centers comprises (Rp/Sp)-(repeating SpSpRp)-(Rp/Sp).

In some embodiments, a provided pattern of backbone chiral centers is (Rp/Sp)-(All Rp or All Sp)-(Rp/Sp). In some embodiments, a provided pattern of backbone chiral centers is (Sp)-(All Sp)-(Sp). In some embodiments, each chiral internucleotidic linkage is Sp. In some embodiments, a provided pattern of backbone chiral centers is (Rp)-(All Sp)-(Rp). In some embodiments, a provided pattern of backbone chiral centers is (Sp)-(All Rp)-(Sp). In some embodiments, a provided pattern of backbone chiral centers is (Rp/Sp)-(repeating (Sp)m(Rp)n)-(Rp/Sp). In some embodiments, a provided pattern of backbone chiral centers is (Rp/Sp)-(repeating SpSpRp)-(Rp/Sp).

In some embodiments, a seed region and/or post-seed region, or any portion thereof, can comprise a pattern of backbone chiral centers.

In some embodiments, provided oligonucleotides comprise internucleotidic linkages of a particular type which alternate with internucleotidic linkages of a different type. In some embodiments, internucleotidic linkages of various types include, but are not limited to, phosphodiester, phosphorothioate, stereorandom phosphorothioate, stereocontrolled phosphorothioate (Rp or Sp), phosphodithioate, or any other type of internucleotidic linkage described herein or known in the art.

In some embodiments, the present disclosure provides an oligonucleotide composition comprising a first plurality of oligonucleotides which:

1) have a common base sequence; and
2) comprise one or more modified sugar moieties and modified internucleotidic linkages.

In some embodiments, the present disclosure provides an oligonucleotide composition comprising a first plurality of oligonucleotides capable of directing single-stranded RNA interference which:

1) have a common base sequence complementary to a target sequence in a transcript; and
2) comprise one or more modified sugar moieties and modified internucleotidic linkages.

In some embodiments, a reference condition is absence of the composition. In some embodiments, a reference condition is presence of a reference composition. Example reference compositions comprising a reference plurality of oligonucleotides are extensively described in this disclosure. In some embodiments, oligonucleotides of the reference plurality have a different structural elements (chemical modifications, stereochemistry, etc.) compared with oligonucleotides of the first plurality in a provided composition. In some embodiments, a provided oligonucleotide composition comprising a first plurality of oligonucleotide is chirally controlled in that the first plurality of oligonucleotides comprise one or more chirally controlled internucleotidic linkages. In some embodiments, a provided oligonucleotide composition comprising a first plurality of oligonucleotide is chirally controlled in that the first plurality of oligonucleotides comprise 1-20 chirally controlled internucleotidic linkages. In some embodiments, the first plurality of oligonucleotides comprise 2, 3, 4, 5, 6, 7, 8, 9, 10, 11, 12, 13, 14, or 15 chirally controlled internucleotidic linkages. In some embodiments, a reference composition is a stereorandom preparation of oligonucleotides having the same chemical modifications. In some embodiments, a reference composition is a mixture of stereoisomers while a provided composition is a single-stranded RNAi agent of one stereoisomer. In some embodiments, oligonucleotides of the reference plurality have the same base sequence as oligonucleotide of the first plurality in a provided composition. In some embodiments, oligonucleotides of the reference plurality have the same chemical modifications as oligonucleotide of the first plurality in a provided composition. In some embodiments, oligonucleotides of the reference plurality have the same sugar modifications as oligonucleotide of the first plurality in a provided composition. In some embodiments, oligonucleotides of the reference plurality have the same base modifications as oligonucleotide of the first plurality in a provided composition. In some embodiments, oligonucleotides of the reference plurality have the same internucleotidic linkage modifications as oligonucleotide of the first plurality in a provided composition. In some embodiments, oligonucleotides of the reference plurality have the same base sequence and the same chemical modifications as oligonucleotide of the first plurality in a provided composition. In some embodiments, oligonucleotides of the reference plurality have the same stereochemistry as oligonucleotide of the first plurality in a provided composition but different chemical modifications, e.g., base modification, sugar modification, internucleotidic linkage modifications, etc.

In some embodiments, the present disclosure provides a composition comprising an oligonucleotide, wherein the oligonucleotide is complementary or substantially complementary to a target RNA sequence, has a length of about 15 to about 49 total nucleotides, wherein the oligonucleotide comprises at least one non-natural base, sugar and/or internucleotidic linkage.

In some embodiments, the present disclosure provides an oligonucleotide composition comprising a single-stranded RNAi agent, wherein the single-stranded RNAi agent is complementary or substantially complementary to a target RNA sequence, has a length of about 15 to about 49 total nucleotides, and is capable of directing target-specific RNA interference, wherein the single-stranded RNAi agent comprises at least one non-natural base, sugar and/or internucleotidic linkage.

In some embodiments, the length is 15 to 49, about 17 to about 49, 17 to 49, about 19 to about 29, 19 to 29, about 19 to about 25, 19 to 25, about 19 to about 23, or 19 to 23 total nucleotides.

In some embodiments, the present disclosure provides an oligonucleotide composition comprising a first plurality of oligonucleotides which:
1) have a common base sequence complementary or substantially complementary to a target sequence in a transcript; and
2) comprise one or more modified sugar moieties and modified internucleotidic linkages, the oligonucleotide composition being characterized in that, when it is contacted with the transcript, knockdown of the transcript is improved relative to that observed under reference conditions selected from the group consisting of absence of the composition, presence of a reference composition, and combinations thereof.

In some embodiments, the present disclosure provides an oligonucleotide composition comprising a first plurality of oligonucleotides capable of directing single-stranded RNA interference which:
1) have a common base sequence complementary to a target sequence in a transcript; and
2) comprise one or more modified sugar moieties and modified internucleotidic linkages,
the oligonucleotide composition being characterized in that, when it is contacted with the transcript in a RNA interference system, RNAi-mediated knockdown of the transcript is improved relative to that observed under reference conditions selected from the group consisting of absence of the composition, presence of a reference composition, and combinations thereof.

In some embodiments, the present disclosure provides an oligonucleotide composition comprising a first plurality of oligonucleotides, wherein oligonucleotides of the first plurality are of a particular oligonucleotide type defined by:
1) base sequence;
2) pattern of backbone linkages;
3) pattern of backbone chiral centers; and
4) pattern of backbone phosphorus modifications.

In some embodiments, the present disclosure provides an oligonucleotide composition comprising a first plurality of oligonucleotides capable of directing single-stranded RNA interference, wherein oligonucleotides of the first plurality are of a particular oligonucleotide type defined by:
1) base sequence;
2) pattern of backbone linkages;
3) pattern of backbone chiral centers; and
4) pattern of backbone phosphorus modifications.

In some embodiments, the present disclosure provides an oligonucleotide composition comprising a first plurality of oligonucleotides of an oligonucleotide type, wherein the oligonucleotide type is defined by:
1) base sequence;
2) pattern of backbone linkages;
3) pattern of backbone chiral centers; and
4) pattern of backbone phosphorus modifications,
which composition is chirally controlled in that it is enriched, relative to a substantially racemic preparation of oligonucleotides having the same base sequence, for oligonucleotides of the particular oligonucleotide type, the oligonucleotide composition being characterized in that, when it is contacted with the transcript, knockdown of the transcript is improved relative to that observed under reference conditions selected from the group consisting of absence of the composition, presence of a reference composition, and combinations thereof.

In some embodiments, the present disclosure provides an oligonucleotide composition comprising a first plurality of oligonucleotides which are capable of directing single-stranded RNA interference and are of an oligonucleotide type, wherein the oligonucleotide type is defined by:
1) base sequence;
2) pattern of backbone linkages;
3) pattern of backbone chiral centers; and
4) pattern of backbone phosphorus modifications,
which composition is chirally controlled in that it is enriched, relative to a substantially racemic preparation of oligonucleotides having the same base sequence, for oligonucleotides of the particular oligonucleotide type,
the oligonucleotide composition being characterized in that, when it is contacted with the transcript in a RNA interference system, RNAi-mediated knockdown of the transcript is improved relative to that observed under reference conditions selected from the group consisting of absence of the composition, presence of a reference composition, and combinations thereof.

In some embodiments, a provided oligonucleotide has any of the Formats illustrated in FIG. 1, or any structural element illustrated in any of the Formats illustrated in FIG. 1.

In some embodiments, a provided single-stranded RNAi agent has any of the Formats illustrated in FIG. 1, or any structural element illustrated in any of the Formats illustrated in FIG. 1.

Among other things, the present disclosure presents data showing that various oligonucleotides of the disclosed Formats are capable of directing a decrease in the expression and/or level of a target gene or its gene product, when targeted against any of several different sequences, in any of several different genes. In some embodiments, the present disclosure presents data showing that various RNAi agents of the disclosed Formats are capable of directing RNA interference against any of many different sequences, in any of many different genes.

In some embodiments, an oligonucleotide is of Format 1. In some embodiments, an oligonucleotide is of Format 2. In some embodiments, an oligonucleotide is of Format 3. In some embodiments, an oligonucleotide is of Format 4. In some embodiments, an oligonucleotide is of Format 5. In some embodiments, an oligonucleotide is of Format 6. In some embodiments, an oligonucleotide is of Format 7. In some embodiments, an oligonucleotide is of Format 8. In some embodiments, an oligonucleotide is of Format 9. In some embodiments, an oligonucleotide is of Format 10. In some embodiments, an oligonucleotide is of Format 11. In some embodiments, an oligonucleotide is of Format 12. In some embodiments, an oligonucleotide is of Format 13. In some embodiments, an oligonucleotide is of Format 14. In some embodiments, an oligonucleotide is of Format 15. In some embodiments, an oligonucleotide is of Format 16. In some embodiments, an oligonucleotide is of Format 17. In some embodiments, an oligonucleotide is of Format 18. In some embodiments, an oligonucleotide is of Format 19. In some embodiments, an oligonucleotide is of Format 20. In some embodiments, an oligonucleotide is of Format 21. In some embodiments, an oligonucleotide is of Format 22. In some embodiments, an oligonucleotide is of Format 23. In some embodiments, an oligonucleotide is of Format 24. In some embodiments, an oligonucleotide is of Format 25. In some embodiments, an oligonucleotide is of Format 26. In some embodiments, an oligonucleotide is of Format 27. In some embodiments, an oligonucleotide is of Format 28. In some embodiments, an oligonucleotide is of Format 29. In some embodiments, an oligonucleotide is of Format 30. In some embodiments, an oligonucleotide is of Format 31. In some embodiments, an oligonucleotide is of Format 32. In some embodiments, an oligonucleotide is of Format 33. In some embodiments, an oligonucleotide is of Format 34. In some embodiments, an oligonucleotide is of Format 35. In some embodiments, an oligonucleotide is of Format 36. In some embodiments, an oligonucleotide is of Format 37. In some embodiments, an oligonucleotide is of Format 38. In some embodiments, an oligonucleotide is of Format 39. In some embodiments, an oligonucleotide is of Format 40. In some embodiments, an oligonucleotide is of Format 41. In some embodiments, an oligonucleotide is of Format 42. In some embodiments, an oligonucleotide is of Format 43. In some embodiments, an oligonucleotide is of Format 44. In some embodiments, an oligonucleotide is of Format 45. In some embodiments, an oligonucleotide is of Format 46. In some embodiments, an oligonucleotide is of Format 47. In some embodiments, an oligonucleotide is of Format 48. In some embodiments, an oligonucleotide is of Format 49. In some embodiments, an oligonucleotide is of Format 50. In some embodiments, an oligonucleotide is of Format 51. In some embodiments, an oligonucleotide is of Format 52. In some embodiments, an oligonucleotide is of Format 53. In some embodiments, an oligonucleotide is of Format 54. In some embodiments, an oligonucleotide is of Format 55. In some embodiments, an oligonucleotide is of Format 56. In some embodiments, an oligonucleotide is of Format 57. In some embodiments, an oligonucleotide is of Format 58. In some embodiments, an oligonucleotide is of Format 59. In some embodiments, an oligonucleotide is of Format 60. In some embodiments, an oligonucleotide is of Format 61. In some embodiments, an oligonucleotide is of Format 62. In some embodiments, an oligonucleotide is of Format 63. In some embodiments, an oligonucleotide is of Format 64. In some embodiments, an oligonucleotide is of Format 65. In some embodiments, an oligonucleotide is of Format 66. In some embodiments, an oligonucleotide is of Format 67. In some embodiments, an oligonucleotide is of Format 68. In some embodiments, an oligonucleotide is of Format 69. In some embodiments, an oligonucleotide is of Format 70. In some embodiments, an oligonucleotide is of Format 71. In some embodiments, an oligonucleotide is of Format 72. In some embodiments, an oligonucleotide is of Format 73. In some embodiments, an oligonucleotide is of Format 74. In some embodiments, an oligonucleotide is of Format 75. In some embodiments, an oligonucleotide is of Format 76. In some embodiments, an oligonucleotide is of Format 77. In some embodiments, an oligonucleotide is of Format 78. In some embodiments, an oligonucleotide is of Format 79. In some embodiments, an oligonucleotide is of Format 80. In some embodiments, an oligonucleotide is of Format 81. In some embodiments, an oligonucleotide is of Format 82. In some embodiments, an oligonucleotide is of Format 83. In some embodiments, an oligonucleotide is of Format 84. In some embodiments, an oligonucleotide is of Format 85. In some embodiments, an oligonucleotide is of Format 86. In some embodiments, an oligonucleotide is of Format 87. In some embodiments, an oligonucleotide is of Format 88. In some embodiments, an oligonucleotide is of Format 89. In some embodiments, an oligonucleotide is of Format 90. In some embodiments, an oligonucleotide is of Format 91. In some embodiments, an oligonucleotide is of Format 92. In some embodiments, an oligonucleotide is of Format 93. In some embodiments, an oligonucleotide is of Format 94. In some embodiments, an oligonucleotide is of Format 95. In some embodiments, an oligonucleotide is of Format 96. In some embodiments, an oligonucleotide is of Format 97. In some embodiments, an oligonucleotide is of Format 98. In some embodiments, an oligonucleotide is of Format 99. In some embodiments, an oligonucleotide is of Format 100. In some embodiments, an oligonucleotide is of Format 101. In some embodiments, an oligonucleotide is of Format 102. In some embodiments, an oligonucleotide is of Format 103. In some embodiments, an oligonucleotide is of Format 104. In some embodiments, an oligonucleotide is of Format 105. In some embodiments, an oligonucleotide is of Format 106. In some embodiments, an oligonucleotide is of Format 107. Various non-limiting examples of formats of stereocontrolled (chirally controlled) oligonucleotides are shown in Tables 71A to 71C. In some embodiments, an oligonucleotide is of Format S1. In some embodiments, an oligonucleotide is of Format S2. In some embodiments, an oligonucleotide is of Format S3. In some embodiments, an oligonucleotide is of Format S4. In some embodiments, an oligonucleotide is of Format S5. In some embodiments, an oligonucleotide is of Format S6. In some embodiments, an oligonucleotide is of Format S7. In some embodiments, an oligonucleotide is of Format S8. In some embodiments, an oligonucleotide is of Format S9. In some embodiments, an oligonucleotide is of Format S10. In some embodiments, an oligonucleotide is of Format S11. In some embodiments, an oligonucleotide is of Format S12. In some embodiments, an oligonucleotide is of Format S13. In some embodiments, an oligonucleotide is of Format S14. In some embodiments, an oligonucleotide is of Format S15. In some embodiments, an oligonucleotide is of Format S16. In some embodiments, an oligonucleotide is of Format S17. In some embodiments, an oligonucleotide is of Format S18. In some embodiments, an oligonucleotide is of Format S19. In some embodiments, an oligonucleotide is of Format S20. In some embodiments, an oligonucleotide is of Format S21. In some embodiments, an oligonucleotide is of Format S22. In some embodiments, an oligonucleotide is of Format S23. In some embodiments, an oligonucleotide is of Format S24. In some embodiments, an oligonucleotide is of Format S25. In some embodiments, an oligonucleotide is of Format S26. In some embodiments, an oligonucleotide is of Format S27. In some embodiments, an oligonucleotide is of Format S28. In some embodiments, an oligonucleotide is of Format S29. In some embodiments, an oligonucleotide is of Format S30. In some embodiments, an oligonucleotide is of Format S31. In some embodiments, an oligonucleotide is of Format S32. In some embodiments, an oligonucleotide is of Format S33. In some embodiments, an oligonucleotide is of Format S34. In some embodiments, an oligonucleotide is of Format S35. In some embodiments, an oligonucleotide is of Format S36. In some embodiments, an oligonucleotide is of Format S37. In some embodiments, an oligonucleotide is of Format S38. In some embodiments, an oligonucleotide is of Format S39. In some embodiments, an oligonucleotide is of Format S40. In some embodiments, an oligonucleotide is of Format S41. In some embodiments, an oligonucleotide is of Format S42. In some embodiments, an oligonucleotide is of Format S43. In some embodiments, an oligonucleotide is of Format S44.

In some embodiments, an oligonucleotide having any of the structures described and/or illustrated herein is capable of directing RNA interference. In some embodiments, an oligonucleotide having any of the structures described and/or illustrated herein is capable of directing RNase H-mediated knockdown. In some embodiments, an oligonucleotide having any of the structures described and/or illustrated herein is capable of directing RNA interference and/or RNase H-mediated knockdown. In some embodiments, an oligonucleotide comprises any structural element of any oligonucleotide described herein, or any Format described herein or illustrated in FIG. 1. In some embodiments, an oligonucleotide comprises any structural element of any oligonucleotide described herein, or any Format described herein or illustrated in FIG. 1 and is capable of directing RNA interference. In some embodiments, an oligonucleotide comprises any structural element of any oligonucleotide described herein, or any Format described herein or illustrated in FIG. 1 and is capable of directing RNase H-mediated knockdown. In some embodiments, an oligonucleotide comprises any structural element of any oligonucleotide described herein, or any Format described herein or illustrated in FIG. 1 and is capable of directing RNA interference and/or RNase H-mediated knockdown.

In some embodiments, a RNAi agent comprises any one or more of: a 5'-end structure, a 5'-end region, a seed region, a post-seed region, and a 3'-end region, and an optional additional chemical moiety. In some embodiments, a seed region is any seed region described herein or known in the art. In some embodiments, a post-seed region can be any region between a seed region and a 3'-end region described herein or known in the art. In some embodiments, a 3'-end region can be any 3'-end region described herein or known in the art. In some embodiments, any optional additional chemical moiety can be any optional additional chemical moiety described herein or known in the art. Any individual 5'-end structure, 5'-end region, seed region, post-seed region, 3'-end region, and optional additional chemical moiety described herein or known in the art can be combined, independently, with any other 5'-end structure, 5'-end region, seed region, post-seed region, 3'-end region, and optional additional chemical moiety described herein or known in the art. In some embodiments, as non-limiting examples, a region of a single-stranded RNAi agent is a 5'-end structure, a 5'-end region, a seed region, a post-seed region, a portion of a seed region, a portion of a post-seed region, or a 3'-terminal dinucleotide.

In some embodiments, the base sequence of a provided oligonucleotide consists of the base sequence of any oligonucleotide disclosed herein. In some embodiments, the base sequence of a provided oligonucleotide comprises the base sequence of any oligonucleotide disclosed herein. In some embodiments, the base sequence of a provided oligonucleotide comprises a sequence comprising the sequence of 15 contiguous bases of the base sequence of any oligonucleotide disclosed herein. In some embodiments, the base sequence of a provided oligonucleotide comprises a sequence comprising the sequence of 20 contiguous bases, with up to 5 mismatches, of the base sequence of any oligonucleotide disclosed herein.

In some embodiments, a provided oligonucleotide is capable of directing a decrease in the expression and/or level of a target gene or its gene product. In some embodiments, a provided oligonucleotide is capable of directing single-stranded RNAi interference. In some embodiments, a provided oligonucleotide is capable of directing RNase H-mediated knockdown. In some embodiments, a provided oligonucleotide is capable of directing single-stranded RNA interference and RNase H-mediated knockdown. In some embodiments, an oligonucleotide comprises a sequence which targets any transcript or gene targeted by an oligonucleotide disclosed herein.

In some embodiments, provided oligonucleotides target ACVR2B or MSTN-R. In some embodiments, provided oligonucleotides target APOB. In some embodiments, provided oligonucleotides target APOC3. In some embodiments, provided oligonucleotides target FXI (Factor XI). In some embodiments, provided oligonucleotides target KRT14. In some embodiments, provided oligonucleotides target MSTN. In some embodiments, provided oligonucleotides target PCSK9.

In some embodiments, provided oligonucleotides target PNPLA3.

In some embodiments, provided oligonucleotides can be used to decrease or inhibit the activity, level and/or expression of a gene or its gene product. In some embodiments, provided oligonucleotides can be used to decrease or inhibit the activity, level and/or expression of a gene or its gene product, wherein abnormal or excessive activity, level and/or expression of, a deleterious mutation in, or abnormal tissue or inter- or intracellular distribution of a gene or its gene product is related to, causes and/or is associated with a disorder. In some embodiments, provided oligonucleotides can be used to treat a disorder and/or to manufacture a medicament for the treatment of a disorder related to, caused and/or associated with the abnormal or excessive activity, level and/or expression or abnormal distribution of a gene or its gene product.

In some embodiments, provided oligonucleotides can be used to treat or used to manufacture a medicament for treatment of a disorder related to a specific gene or gene product. In some embodiments, the present disclosure pertains to methods of using oligonucleotides disclosed herein which are capable of targeting ACVR2B and useful for treating and/or manufacturing a treatment for a ACVR2B-related disorder. In some embodiments, the present disclosure pertains to methods of using oligonucleotides disclosed herein which are capable of targeting APOB and useful for treating and/or manufacturing a treatment for a APOB-related disorder.

In some embodiments, the present disclosure pertains to methods of using oligonucleotides disclosed herein which are capable of targeting APOC3 and useful for treating and/or manufacturing a treatment for a APOC3-related disorder.

In some embodiments, the present disclosure pertains to methods of using oligonucleotides disclosed herein which are capable of targeting FXI (Factor XI) and useful for treating and/or manufacturing a treatment for a FXI (Factor XI)-related disorder. In some embodiments, the present disclosure pertains to methods of using oligonucleotides disclosed herein which are capable of targeting KRT or KRT14 and useful for treating and/or manufacturing a treatment for a KRT or KRT14-related disorder. In some embodiments, the present disclosure pertains to methods of using oligonucleotides disclosed herein which are capable of targeting myostatin (MSTN) and useful for treating and/or manufacturing a treatment for a myostatin (MSTN)-related disorder. In some embodiments, the present disclosure pertains to methods of using oligonucleotides disclosed herein which are capable of targeting PCSK9 and useful for treating and/or manufacturing a treatment for a PCSK9-related disorder.

In some embodiments, the present disclosure pertains to methods of using oligonucleotides disclosed herein which are capable of targeting PNPLA3 and useful for treating and/or manufacturing a treatment for a PNPLA3-related disorder.

In some embodiments, an oligonucleotide capable of targeting a gene comprises a base sequence which is a portion of or complementary or substantially complementary to a portion of the base sequence of the target gene. In some embodiments, a portion is at least 15 bases long. In some embodiments, a base sequence of a single-stranded RNAi agent can comprise or consist of a base sequence which has a specified maximum number of mismatches from a specified base sequence.

In some embodiments, a mismatch is a difference between the base sequence or length when two sequences are maximally aligned and compared. As a non-limiting example, a mismatch is counted if a difference exists between the base at a particular location in one sequence and the base at the corresponding position in another sequence. Thus, a mismatch is counted, for example, if a position in one sequence has a particular base (e.g., A), and the corresponding position on the other sequence has a different base (e.g., G, C or U). A mismatch is also counted, e.g., if a position in one sequence has a base (e.g., A), and the corresponding position on the other sequence has no base (e.g., that position is an abasic nucleotide which comprises a phosphate-sugar backbone but no base) or that position is skipped. A single-stranded nick in either sequence (or in the sense or antisense strand) may not be counted as mismatch, for example, no mismatch would be counted if one sequence comprises the sequence 5'-AG-3', but the other sequence comprises the sequence 5'-AG-3' with a single-stranded nick between the A and the G. A base modification is generally not considered a mismatch, for example, if one sequence comprises a C, and the other sequence comprises a modified C (e.g., 5mC) at the same position, no mismatch may be counted. In some embodiments, for purposes of counting mismatches, substitution of a T for U or vice versa is not considered a mismatch.

In some embodiments, an oligonucleotide is complementary or totally or 100% complementary to a target sequence (e.g., a RNA, such as a mRNA), meaning that the base sequence of the oligonucleotide has no mismatches with a sequence which is fully complementary (e.g., base-pairs via Watson-Crick basepairing) to the target sequence. Without wishing to be bound by any particular theory, the disclosure notes that, for a single-stranded RNAi agent, it is not necessary for the 5'-end nucleotide moiety or the 3'-terminal dinucleotide to base-pair with the target. These may be mismatches. In addition, an antisense oligonucleotide or single-stranded RNAi agent can have a small number of internal mismatches and still direct a decrease in the expression and/or level of a target gene or its gene product and/or direct RNase H-mediated knockdown and/or RNA interference. If a first base sequence of an oligonucleotide, (e.g., antisense oligonucleotide or single-stranded RNAi agent) has a small number of mismatches from a reference base sequence which is 100% complementary to a target sequence, then the first base sequence is substantially complementary to the target sequence. In some embodiments, an oligonucleotide, (e.g., antisense oligonucleotide or single-stranded RNAi agent) can have a base sequence which is complementary or substantially complementary to a target sequence. In some embodiments, complementarity is determined based on Watson-Crick base pairs (guanine-cytosine and adenine-thymine/uracil), wherein guanine, cytosine, adenine, thymine, uracil may be optionally and independently modified but maintains their pairing hydrogen-bonding patters as unmodified. In some embodiments, a sequence complementary to another sequence comprises at least 5, 6, 7, 8, 9, 10, 11, 12, 13, 14, 15, 16, 17, 18, 19, 20 bases.

In some embodiments, an oligonucleotide, oligonucleotide composition or oligonucleotide type has a common pattern of backbone linkages. In some embodiments, a common pattern of backbone linkages comprises at least 10 modified internucleotidic linkages.

In some embodiments, a common pattern of backbone linkages comprises at least 10, 11, 12, 13, 14, 15, 16, 17, 18, 19 or 20 modified internucleotidic linkages. In some embodiments, a common pattern of backbone linkages comprises at least 15 modified internucleotidic linkages. In some embodiments, a common pattern of backbone linkages comprises at least 19 modified internucleotidic linkages. In some embodiments, a common pattern of backbone linkages comprises no more than 10, 11, 12, 13, 14, 15, 16, 17, 18, 19 or 20 modified internucleotidic linkages. In some embodiments, a common pattern of backbone linkages comprises no more than 19 modified internucleotidic linkages. In some embodiments, a common pattern of backbone linkages comprises no more than 15 modified internucleotidic linkages. In some embodiments, a common pattern of backbone linkages comprises 11 to 21 modified internucleotidic linkages. In some embodiments, a common pattern of backbone linkages comprises 0 phosphodiesters. In some embodiments, a common pattern of backbone linkages comprises 1 phosphodiester. In some embodiments, a common pattern of backbone linkages comprises 2, 3, 4, 5, 6, 7, 8, 9, 10, 11, 12, 13, 14, 15, 16, 17, 18 or 19 phosphodiesters. In some embodiments, a common pattern of backbone linkages comprises at least 2 to 19 phosphodiesters. In some embodiments, the phosphodiesters are optionally contiguous or not contiguous. In some embodiments, the modified internucleotidic linkages are optionally contiguous or not contiguous.

In some embodiments, a common pattern of backbone linkages comprises at least 10 phosphorothioate linkages. In some embodiments, a common pattern of backbone linkages comprises at least 11 phosphorothioate linkages. In some embodiments, a common pattern of backbone linkages comprises at least 12 to 19 phosphorothioate linkages. In some embodiments, a common pattern of backbone linkages comprises at least 12, 13, 14, 15, 16, 17, 18, 19 or 20 phosphorothioate linkages. In some embodiments, a common pattern of backbone linkages comprises 0 phosphodiesters. In some embodiments, a common pattern of backbone linkages comprises 1 to 6 phosphodiesters and 13 to 19 phosphorothioate linkages. In some embodiments, the phosphodiesters are optionally contiguous or not contiguous. In some embodiments, the phosphorothioate linkages are optionally contiguous or not contiguous.

In some embodiments, an oligonucleotide, oligonucleotide composition or oligonucleotide type has a common pattern of backbone chiral centers. In some embodiments, a common pattern of backbone chiral centers comprises at least 1 internucleotidic linkage in the Sp configuration. In some embodiments, a common pattern of backbone chiral centers comprises at least 1 internucleotidic linkage which is phosphorothioate in the Sp configuration.

In some embodiments, a common pattern of backbone chiral centers comprises at least 5 internucleotidic linkages in the Sp configuration. In some embodiments, a common pattern of backbone chiral centers comprises at least 6 to 19 internucleotidic linkages in the Sp configuration. In some embodiments, a common pattern of backbone chiral centers comprises at least 6, 7, 8, 9, 10, 11, 12, 13, 14, 15, 16, 17, 18, 19 or 20 internucleotidic linkages in the Sp configuration. In some embodiments, a common pattern of backbone chiral centers comprises no more than 8 internucleotidic linkages in the Rp configuration. In some embodiments, a common pattern of backbone chiral centers comprises no more than 1 to 7 internucleotidic linkages in the Rp configuration. In some embodiments, a common pattern of backbone chiral centers comprises no more than 8 internucleotidic linkages which are not chiral (as a non-limiting example, a phosphodiester). In some embodiments, a common pattern of backbone chiral centers comprises no more than 1, 2, 3, 4, 5, 6, or 7 internucleotidic linkages which are not chiral. In some embodiments, a common pattern of backbone chiral centers comprises at least 10 internucleotidic linkages in the Sp configuration, and no more than 8 internucleotidic linkages which are not chiral. In some embodiments, a common pattern of backbone chiral centers comprises at least 11 internucleotidic linkages in the Sp configuration, and no more than 7 internucleotidic linkages which are not chiral. In some embodiments, a common pattern of backbone chiral centers comprises at least 12 internucleotidic linkages in the Sp configuration, and no more than 6 internucleotidic linkages which are not chiral. In some embodiments, a common pattern of backbone chiral centers comprises at least 13 internucleotidic linkages in the Sp configuration, and no more than 6 internucleotidic linkages which are not chiral. In some embodiments, a common pattern of backbone chiral centers comprises at least 14 internucleotidic linkages in the Sp configuration, and no more than 5 internucleotidic linkages which are not chiral. In some embodiments, a common pattern of backbone chiral centers comprises at least 15 internucleotidic linkages in the Sp configuration, and no more than 4 internucleotidic linkages which are not chiral. In some embodiments, the internucleotidic linkages in the Sp configuration are optionally contiguous or not contiguous. In some embodiments, the internucleotidic linkages in the Rp configuration are optionally contiguous or not contiguous. In some embodiments, the internucleotidic linkages which are not chiral are optionally contiguous or not contiguous.

In some embodiments, oligonucleotides in provided compositions have a common pattern of backbone phosphorus modifications. In some embodiments, a provided composition is an oligonucleotide composition that is chirally controlled in that the composition contains a predetermined level of oligonucleotides of an individual oligonucleotide type, wherein an oligonucleotide type is defined by:
  1) base sequence;
  2) pattern of backbone linkages;
  3) pattern of backbone chiral centers; and
  4) pattern of backbone phosphorus modifications.

As noted above and understood in the art, in some embodiments, base sequence of an oligonucleotide may refer to the identity and/or modification status of nucleoside residues (e.g., of sugar and/or base components, relative to standard naturally occurring nucleotides such as adenine, cytosine, guanosine, thymine, and uracil) in the oligonucleotide and/or to the hybridization character (i.e., the ability to hybridize with particular complementary residues) of such residues.

In some embodiments, a particular oligonucleotide type may be defined by
  1A) base identity;
  1B) pattern of base modification;
  1C) pattern of sugar modification;
  2) pattern of backbone linkages;
  3) pattern of backbone chiral centers; and
  4) pattern of backbone phosphorus modifications.

Thus, in some embodiments, oligonucleotides of a particular type may share identical bases but differ in their pattern of base modifications and/or sugar modifications. In some embodiments, oligonucleotides of a particular type may share identical bases and pattern of base modifications (including, e.g., absence of base modification), but differ in pattern of sugar modifications.

In some embodiments, oligonucleotides of a particular type are chemically identical in that they have the same base sequence (including length), the same pattern of chemical modifications to sugar and base moieties, the same pattern of backbone linkages (e.g., pattern of natural phosphate linkages, non-negatively charged linkages, phosphorothioate linkages, phosphorothioate triester linkages, and combinations thereof), the same pattern of backbone chiral centers (e.g., pattern of stereochemistry (Rp/Sp) of chiral internucleotidic linkages), and the same pattern of backbone phosphorus modifications (e.g., pattern of modifications on the internucleotidic phosphorus atom, such as and of Formula I).

In some embodiments, the present disclosure provides chirally controlled oligonucleotide compositions of oligonucleotides comprising multiple (e.g., more than 5, 6, 7, 8, 9, or 10) internucleotidic linkages, and particularly for oligonucleotides comprising multiple (e.g., more than 5, 6, 7, 8, 9, or 10) chiral internucleotidic linkages. In some embodiments, in a stereorandom or racemic preparation of oligonucleotides, at least one chiral internucleotidic linkage is formed with less than 90:10, 95:5, 96:4, 97:3, or 98:2 diastereoselectivity. In some embodiments, for a stereoselective or chirally controlled preparation of oligonucleotides, each chiral internucleotidic linkage is formed with greater than 90:10, 95:5, 96:4, 97:3, or 98:2 diastereoselectivity. In some embodiments, for a stereoselective or chirally controlled preparation of oligonucleotides, each chiral internucleotidic linkage is formed with greater than 95:5 diastereoselectivity. In some embodiments, for a stereoselective or chirally controlled preparation of oligonucleotides, each chiral internucleotidic linkage is formed with greater than 96:4 diastereoselectivity. In some embodiments, for a stereoselective or chirally controlled preparation of oligonucleotides, each chiral internucleotidic linkage is formed with greater than 97:3 diastereoselectivity. In some embodiments, for a stereoselective or chirally controlled preparation of oligonucleotides, each chiral internucleotidic linkage is formed with greater than 98:2 diastereoselectivity. In some embodiments, for a stereoselective or chirally controlled preparation of oligonucleotides, each chiral internucleotidic linkage is formed with greater than 99:1 diastereoselectivity. In some embodiments, diastereoselectivity of a chiral internucleotidic linkage in an oligonucleotide may be measured through a model reaction, e.g. formation of a dimer under essentially the same or comparable conditions wherein the dimer has the same internucleotidic linkage as the chiral internucleotidic linkage, the 5'-nucleoside of the dimer is the same as the nucleoside to the 5'-end of the chiral internucleotidic linkage, and the 3'-nucleoside of the dimer is the same as the nucleoside to the 3'-end of the chiral internucleotidic linkage. In some embodiments, a chirally controlled internucleotidic linkage has 90%-100% (e.g., 90%, 91%, 92%, 93%, 94%, 95%, 96%, 97%, 98%, 99%, or 99.5%) diastereopurity at the linkage phosphorus. In some embodiments, a chirally controlled internucleotidic linkage has 95%-100% (e.g., 95%, 96%, 97%, 98%, 99%, or 99.5%) diastereopurity at the linkage phosphorus. In some embodiments, a chirally controlled internucleotidic linkage has 97%-100% (e.g., 97%, 98%, 99%, or 99.5%) diastereopurity at the linkage phosphorus. In some embodiments, a chirally controlled internucleotidic linkage has at least 97% diastereopurity. In some embodiments, a chirally controlled internucleotidic linkage has at least 98% diastereopurity. In some embodiments, a chirally controlled internucleotidic linkage has at least 99% diastereopurity. In some embodiments, a non-chirally controlled (racemic/stereorandom) internucleotidic linkage has less than 90% diastereopurity.

Among other things, the present disclosure provides oligonucleotide compositions and technologies for optimizing properties.

Among other things, the present disclosure provides oligonucleotide compositions and technologies for optimizing properties, e.g., improved single-stranded RNA interference, RNase H-mediated knockdown, etc. In some embodiments, the present disclosure provides methods for lowering immune response associated with administration of oligonucleotides and compositions thereof (i.e., of administering oligonucleotide compositions so that undesirable immune responses to oligonucleotides in the compositions are reduced, for example relative to those observed with a reference composition of nucleotides of comparable or identical nucleotide sequence). In some embodiments, the present disclosure provides methods for increasing binding to certain proteins by oligonucleotides and compositions thereof. In some embodiments, the present disclosure provides methods for increasing binding to certain proteins by oligonucleotides and compositions thereof. In some embodiments, the present disclosure provides methods for enhancing delivery of oligonucleotides and compositions thereof. Among other things, the present disclosure encompasses the recognition that optimal delivery of oligonucleotides to their targets, in some embodiments, involves balance of oligonucleotides binding to certain proteins so that oligonucleotides can be transported to the desired locations, and oligonucleotide release so that oligonucleotides can be properly released from certain proteins to perform their desired functions, for example, hybridization with their targets, cleavage of their targets, inhibition of translation, modulation of transcript processing, etc. As exemplified in this disclosure, the present disclosure recognizes, among other things, that improvement of oligonucleotide properties can be achieved through chemical modifications and/or stereochemistry.

In some embodiments, the present disclosure provides a method for treating or preventing a disease, comprising administering to a subject an oligonucleotide composition described herein.

In some embodiments, a disease is one in which, after administering a provided composition, knocking down a target nucleic acid via single-stranded RNA interference can repair, restore or introduce a new beneficial function.

In some embodiments, a disease is cancer.

In some embodiments, a common sequence comprises a sequence selected from Table 1A. In some embodiments, a common sequence is a sequence selected from Table 1A. In some embodiments, a pattern of backbone chiral centers is selected from those described in Table 1A.

In some embodiments, the present disclosure provides a method comprising administering a composition comprising a first plurality of oligonucleotides, which composition displays improved delivery as compared with a reference composition comprising a plurality of oligonucleotides, each of which also has the common base sequence but which differs structurally from the oligonucleotides of the first plurality in that:

individual oligonucleotides within the reference plurality differ from one another in stereochemical structure; and/or at least some oligonucleotides within the reference plurality have a structure different from a structure represented by the plurality of oligonucleotides of the composition.

In some embodiments, the present disclosure provides a method of administering an oligonucleotide composition comprising a first plurality of oligonucleotides capable of directing a decrease in the expression and/or level of a target gene or its gene product and having a common nucleotide sequence, the improvement that comprises:

administering an oligonucleotide comprising a first plurality of oligonucleotides that is characterized by improved delivery relative to a reference oligonucleotide composition of the same common nucleotide sequence.

In some embodiments, the present disclosure provides a method of administering an oligonucleotide composition comprising a first plurality of oligonucleotides capable of directing single-stranded RNA interference and having a common nucleotide sequence, the improvement that comprises:

administering an oligonucleotide comprising a first plurality of oligonucleotides that is characterized by improved delivery relative to a reference oligonucleotide composition of the same common nucleotide sequence.

In some embodiments, the present disclosure provides a single-stranded RNAi agent of an oligonucleotide selected from any of the Tables, including but not limited to Table 1A, or otherwise disclosed herein. In some embodiments, the present disclosure provides a single-stranded RNAi agent of an oligonucleotide selected from any of the Tables, including but not limited to Table 1A, or otherwise disclosed herein, wherein the oligonucleotide is conjugated to a lipid moiety.

In some embodiments, the oligonucleotide is no more than 25 bases long. In some embodiments, the oligonucleotide is no more than 30 bases long. n some embodiments, the oligonucleotide is no more than 35 bases long. In some embodiments, the oligonucleotide is no more than 40 bases long. In some embodiments, the oligonucleotide is no more than 45 bases long. In some embodiments, the oligonucleotide is no more than 50 bases long. In some embodiments, the oligonucleotide is no more than 55 bases long. In some embodiments, the oligonucleotide is no more than 60 bases long.

In some embodiments, a provided oligonucleotide comprises a lipid moiety. In some embodiments, a lipid moiety is incorporated by conjugation with a lipid. In some embodiments, a lipid moiety is a fatty acid. In some embodiments, an oligonucleotide is conjugated to a fatty acid. In some embodiments, a provided single-stranded RNAi agent further comprises a lipid. In some embodiments, a provided single-stranded RNAi agent comprises a lipid moiety conjugated at the $9^{th}$ or $11^{th}$ nucleotide (counting from the 5'-end). In some embodiments, an oligonucleotide is conjugated at the base to a fatty acid. In some embodiments, a provided single-stranded RNAi agent comprises a lipid moiety. In some embodiments, a provided single-stranded RNAi agent comprises a lipid moiety conjugated at the base at the $9^{th}$ or $11^{th}$ nucleotide (counting from the 5'-end).

In some embodiments, the present disclosure provides a compound, e.g., an oligonucleotide, having the structure of formula O-I:

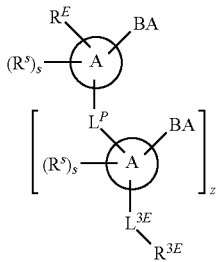

O-I or a salt thereof, wherein each variable is independently as described in the present disclosure.

In some embodiments, the present disclosure provides a compound of structure:

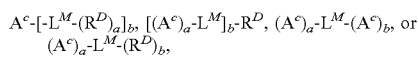

or a salt thereof, wherein each variable is independently as described in the present disclosure.

In some embodiments, each $A^c$ is independently an oligonucleotide moiety of an oligonucleotide of formula O-I or a salt thereof (e.g., $[H]_a$-$A^c$ or $[H]_b$-$A^c$ is an oligonucleotide of formula O-I or a salt thereof). In some embodiments, the present disclosure provides an oligonucleotide having the structure of $A^c$-$[-L^M$-$(R^D)_a]_b$, $[(A^c)_a$-$L^M]_b$-$R^D$, $(A^c)_a$-$L^M$-$(A^c)_b$, or $(A^c)_a$-$L^M$-$(R^D)_b$, or a salt thereof. In some embodiments, the present disclosure provides oligonucleotide compositions comprising oligonucleotides having the structure of $A^c$-$[-L^M$-$(R^D)_a]_b$, $[(A^c)_a$-$L^M]_b$-$R^D$, $(A^c)_a$-$L^M$-$(A^c)_b$, or $(A^c)_a$-$L^M$-$(R^D)_b$, or a salt thereof. In some embodiments, the present disclosure provides oligonucleotide compositions comprising predetermined levels (as described in the present disclosure) of oligonucleotides having the structure of $A^c$-$[-L^M$-$(R^D)_a]_b$, $[(A^c)_a$-$L^M]_b$-$R^D$, $(A^c)_a$-$L^M$-$(A^c)_b$, or $(A^c)_a$-$L^M$-$(R^D)_b$, or a salt thereof. In some embodiments, the present disclosure provides chirally controlled oligonucleotide compositions comprising oligonucleotides having the structure of $A^c$-$[-L^M$-$(R^D)_a]_b$, $[(A^c)_a$-$L^M]_b$-$R^D$, $(A^c)_a$-$L^M$-$(A^c)_b$, or $(A^c)_a$-$L^M$-$(R^D)_b$, or a salt thereof. In some embodiments, oligonucleotides of a plurality (e.g., a first plurality), or oligonucleotides of an oligonucleotide type, are oligonucleotides having the structure of $A^c$-$[-L^M$-$(R^D)_a]_b$, $[(A^c)_a$-$L^M]_b$-$R^D$, $(A^c)_a$-$L^M$-$(A^c)_b$, or $(A^c)_a$-$L^M$-$(R^D)_b$, or a salt thereof. In some embodiments, oligonucleotides in provided compositions, e.g., provided chirally controlled oligonucleotide compositions, have the structure of $A^c$-$[-L^M$-$(R^D)_a]_b$, $[(A^c)_a$-$L^M]_b$-$R^D$, $(A^c)_a$-$L^M$-$(A^c)_b$, or $(A^c)_a$-$L^M$-$(R^D)_b$, or a salt thereof. In some embodiments, the structure is $A^c$-$[-L^M$-$(R^D)_a]_b$ or a salt thereof. In some embodiments, the structure is $[(A^c)_a$-$L^M]_b$-$R^D$ or a salt thereof. In some embodiments, the structure is $(A^c)_a$-$L^M$-$(A^c)_b$ or a salt thereof. In some embodiments, the structure is $A^c$-$[-L^M$-$(R^D)_a]_b$ or a salt thereof.

In some embodiments, each $A^c$ is independently an oligonucleotide moiety of an oligonucleotide having the structure of 5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-(N26-PX26-N27-PX27)$_{yz}$-(CAP)$_{zz}$-3', or a salt thereof.

In some embodiments, a conjugate has the structure of $A^c$-$[-L^{LD}$-$(R^{LD})_a]_b$, wherein each variable is independently as described in the present disclosure.

In some embodiments, the present disclosure provides an oligonucleotide composition comprising a plurality of oligonucleotides having the structure of:

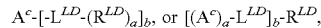

wherein:
each $A^c$ is independently an oligonucleotide moiety (e.g., $[H]_a$-$A^c$ or $[H]_b$-$A^c$ is an oligonucleotide);
a is 1-1000;
b is 1-1000;
each $L^{LD}$ is independently a linker moiety; and
each $R^{LD}$ is independently a lipid moiety or a targeting moiety.

In some embodiments, the present disclosure provides an oligonucleotide composition comprising a plurality of oligonucleotides having the structure of:

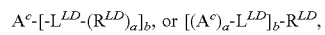

wherein:
each $A^c$ is independently an oligonucleotide moiety (e.g., $[H]_a$-$A^c$ or $[H]_b$-$A^c$ is an oligonucleotide);
a is 1-1000;
b is 1-1000;
each $L^{LD}$ is independently a covalent bond or an optionally substituted, C1-C80 saturated or partially unsaturated aliphatic group, wherein one or more methylene units are optionally and independently replaced by $T^{LD}$ or an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—;
each $R^{LD}$ is independently hydrogen, or an optionally substituted, $C_1$-$C_{80}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—;
$T^{LD}$ has the structure of Formula I':

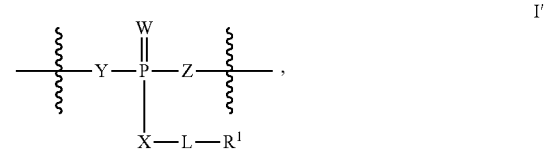

I'

W is O, S or Se;
each of X, Y and Z is independently —O—, —S—, —N(-L-$R^1$)—, or L;
L is a covalent bond or an optionally substituted, linear or branched $C_1$-$C_{10}$ aliphatic, wherein one or more methylene units of L are optionally and independently replaced by an optionally substituted group selected from $C_1$-$C_6$ aliphatic moiety, $C_1$-$C_6$ alkenylene, —C≡C—, a $C_1$-$C_6$ heteroaliphatic moiety, —C(R')$_2$—, -Cy-, —B(R')—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O—;

$R^1$ is halogen, R, or an optionally substituted $C_1$-$C_{50}$ aliphatic wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R)—, —S(O)—, —S(O)$_2$—, —S(O)$_2$N(R')—, —N(R')S(O)$_2$— —SC(O)—, —C(O)S—, —OC(O)—, and —C(O)O— each R' is independently —R, —C(O)R, —CO$_2$R, or —SO$_2$R, or:
two or more R' are taken together with their intervening atoms to form an optionally substituted $C_3$-$C_{14}$ group selected from aryl, carbocyclyl, heterocyclyl, and heteroaryl;

-Cy- is an optionally substituted bivalent ring selected from phenylene, $C_3$-$C_{14}$ carbocyclylene, $C_{10}$-$C_{14}$ arylene, $C_5$-$C_{14}$ heteroarylene, and $C_3$-$C_{14}$ heterocyclylene; and each R is independently hydrogen, or an optionally substituted group selected from $C_1$-$C_{20}$ aliphatic, $C_3$-$C_{20}$ carbocyclyl, $C_6$-$C_{20}$ aryl, $C_5$-$C_{20}$ heteroaryl, and $C_3$-$C_{20}$ heterocyclyl.

In some embodiments, $[H]_a$-$A^c$ or $[H]_b$-$A^c$ is an oligonucleotide having the structure of formula O-I, or a salt thereof. In some embodiments, $[H]_a$-$A^c$ or $[H]_b$-$A^c$ is an oligonucleotide having the structure of 5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-(N26-PX26-N27-PX27)$_{yz}$-(CAP)$_{zz}$-3', or a salt thereof.

In some embodiments, P in $T^{LD}$ is P*. In some embodiments, a conjugate has the structure of $[(A^c)_a$-$L^{LD}]_b$-$R^{LD}$. In some embodiments, a conjugate has the structure of $(A^c)_a$-$L^{LD}$-$R^{LD}$.

In some embodiments, a is 1-100. In some embodiments, a is 1-50. In some embodiments, a is 1-40. In some embodiments, a is 1-30. In some embodiments, a is 1-20. In some embodiments, a is 1-15. In some embodiments, a is 1-10. In some embodiments, a is 1-9. In some embodiments, a is 1-8. In some embodiments, a is 1-7. In some embodiments, a is 1-6. In some embodiments, a is 1-5. In some embodiments, a is 1-4. In some embodiments, a is 1-3. In some embodiments, a is 1-2. In some embodiments, a is 1. In some embodiments, a is 2. In some embodiments, a is 3. In some embodiments, a is 4. In some embodiments, a is 5. In some embodiments, a is 6. In some embodiments, a is 7. In some embodiments, a is 8. In some embodiments, a is 9. In some embodiments, a is 10. In some embodiments, a is more than 10. In some embodiments, b is 1-100. In some embodiments, b is 1-50. In some embodiments, b is 1-40. In some embodiments, b is 1-30. In some embodiments, b is 1-20. In some embodiments, b is 1-15. In some embodiments, b is 1-10. In some embodiments, b is 1-9. In some embodiments, b is 1-8. In some embodiments, b is 1-7. In some embodiments, b is 1-6. In some embodiments, b is 1-5. In some embodiments, b is 1-4. In some embodiments, b is 1-3. In some embodiments, b is 1-2. In some embodiments, b is 1. In some embodiments, b is 2. In some embodiments, b is 3. In some embodiments, b is 4. In some embodiments, b is 5. In some embodiments, b is 6. In some embodiments, b is 7. In some embodiments, b is 8. In some embodiments, b is 9. In some embodiments, b is 10. In some embodiments, b is more than 10. In some embodiments, a conjugate has the structure of $A^c$-$L^{LD}$-$R^{LD}$. In some embodiments, $A^c$ is conjugated through one or more of its sugar, base and/or internucleotidic linkage moieties. In some embodiments, $A^c$ is conjugated through its 5'-OH (5'-O—). In some embodiments, $A^c$ is conjugated through its 3'-OH (3'-O—). In some embodiments, $A^c$ is conjugated through an internucleotidic linkage. In some embodiments, $A^c$ is conjugated through a nucleobase. In some embodiments, $A^c$ is conjugated through a sugar. In some embodiments, before conjugation, $A^c$-(H)$_b$ (b is an integer of 1-1000 depending on valency of $A^c$) is an oligonucleotide as described herein, for example, one of those described in any one of the Tables. In some embodiments, $L^{LD}$ is -L-. In some embodiments, $L^{LD}$ comprises a phosphorothioate group. In some embodiments, $L^{LD}$ is —C(O)NH—(CH$_2$)$_6$—OP(=O)(S$^-$)—O—. In some embodiments, the —C(O)NH end is connected to $R^{LD}$, and the —O— end is connected to the oligonucleotide, e.g., through 5'- or 3'-end. In some embodiments, $R^{LD}$ is optionally substituted $C_{10}$, $C_{15}$, $C_{16}$, $C_{17}$, $C_{18}$, $C_{19}$, $C_{20}$, $C_{21}$, $C_{22}$, $C_{23}$, $C_{24}$, or $C_{25}$ to $C_{20}$, $C_{21}$, $C_{22}$, $C_{23}$, $C_{24}$, $C_{25}$, $C_{26}$, $C_{27}$, $C_{28}$, $C_{29}$, $C_{30}$, $C_{35}$, $C_{40}$, $C_{45}$, $C_{50}$, $C_{60}$, $C_{70}$, or $C_{80}$ aliphatic. In some embodiments, $R^{LD}$ is optionally substituted $C_{10-80}$ aliphatic. In some embodiments, $R^{LD}$ is optionally substituted $C_{20-80}$ aliphatic. In some embodiments, $R^{LD}$ is optionally substituted $C_{10-70}$ aliphatic. In some embodiments, $R^{LD}$ is optionally substituted $C_{20-70}$ aliphatic. In some embodiments, $R^{LD}$ is optionally substituted $C_{10-60}$ aliphatic. In some embodiments, $R^{LD}$ is optionally substituted $C_{20-60}$ aliphatic. In some embodiments, $R^{LD}$ is optionally substituted $C_{10-50}$ aliphatic. In some embodiments, $R^{LD}$ is optionally substituted $C_{20-50}$ aliphatic. In some embodiments, $R^{LD}$ is optionally substituted $C_{10-40}$ aliphatic. In some embodiments, $R^{LD}$ is optionally substituted $C_{20-40}$ aliphatic. In some embodiments, $R^{LD}$ is optionally substituted $C_{10-30}$ aliphatic. In some embodiments, $R^{LD}$ is optionally substituted $C_{20-30}$ aliphatic. In some embodiments, $R^{LD}$ is unsubstituted $C_{10}$, $C_{15}$, $C_{16}$, $C_{17}$, $C_{18}$, $C_{19}$, $C_{20}$, $C_{21}$, $C_{22}$, $C_{23}$, $C_{24}$, or $C_{25}$ to $C_{20}$, $C_{21}$, $C_{22}$, $C_{23}$, $C_{24}$, $C_{25}$, $C_{26}$, $C_{27}$, $C_{28}$, $C_{29}$, $C_{30}$, $C_{35}$, $C_{40}$, $C_{45}$, $C_{50}$, $C_{60}$, $C_{70}$, or $C_{80}$ aliphatic. In some embodiments, $R^{LD}$ is unsubstituted $C_{10-80}$ aliphatic. In some embodiments, $R^{LD}$ is unsubstituted $C_{20-80}$ aliphatic. In some embodiments, $R^{LD}$ is unsubstituted $C_{10-70}$ aliphatic. In some embodiments, $R^{LD}$ is unsubstituted $C_{20-70}$ aliphatic. In some embodiments, $R^{LD}$ is unsubstituted $C_{10-60}$ aliphatic. In some embodiments, $R^{LD}$ is unsubstituted $C_{20-60}$ aliphatic. In some embodiments, $R^{LD}$ is unsubstituted $C_{10-50}$ aliphatic. In some embodiments, $R^{LD}$ is unsubstituted $C_{20-50}$ aliphatic. In some embodiments, $R^{LD}$ is unsubstituted $C_{10-40}$ aliphatic. In some embodiments, $R^{LD}$ is unsubstituted $C_{20-40}$ aliphatic. In some embodiments, $R^{LD}$ is unsubstituted $C_{10-30}$ aliphatic. In some embodiments, $R^{LD}$ is unsubstituted $C_{20-30}$ aliphatic.

In some embodiments, $R^{LD}$ is not hydrogen. In some embodiments, $R^{LD}$ is a lipid moiety. In some embodiments, $R^{LD}$ is a targeting moiety. In some embodiments, $R^{LD}$ is a targeting moiety comprising a carbohydrate moiety. In some embodiments, $R^{LD}$ is a GalNAc moiety.

In some embodiments, a single-stranded RNAi agent is any one of the preceding compositions, further comprising one or more additional components.

In some embodiments, a provided oligonucleotide is capable of degrading a target transcript, e.g., RNA, through both a RNase H mechanism and a RNAi mechanism.

In some embodiments, conjugation of a lipid moiety to an oligonucleotide improves at least one property of the oligonucleotide. In some embodiments, improved properties include increased activity (e.g., increased ability to direct a decrease in the expression and/or level of a target gene or its gene product and/or direct single-stranded RNA interference and/or direct RNase H-mediated knockdown) and/or improved distribution to a tissue. In some embodiments, a tissue is muscle tissue. In some embodiments, a tissue is skeletal muscle, gastrocnemius, triceps, heart or diaphragm. In some embodiments, improved properties include reduced hTLR9 agonist activity. In some embodiments, improved properties include hTLR9 antagonist activity. In some embodiments, improved properties include increased hTLR9 antagonist activity.

In general, properties of oligonucleotide compositions as described herein can be assessed using any appropriate assay.

Those of skill in the art will be aware of and/or will readily be able to develop appropriate assays for particular oligonucleotide compositions.

Definitions

As used herein, the following definitions shall apply unless otherwise indicated. For purposes of this disclosure, the chemical elements are identified in accordance with the Periodic Table of the Elements, CAS version, Handbook of Chemistry and Physics, 75th Ed. Additionally, general principles of organic chemistry are described in "Organic Chemistry", Thomas Sorrell, University Science Books, Sausalito: 1999, and "March's Advanced Organic Chemistry", 5th Ed., Ed.: Smith, M. B. and March, J., John Wiley & Sons, New York: 2001.

Aliphatic: As used herein, "aliphatic" means a straight-chain (i.e., unbranched) or branched, substituted or unsubstituted hydrocarbon chain that is completely saturated or that contains one or more units of unsaturation, or a substituted or unsubstituted monocyclic, bicyclic, or polycyclic hydrocarbon ring that is completely saturated or that contains one or more units of unsaturation (but not aromatic), or combinations thereof. In some embodiments, aliphatic groups contain 1-50 aliphatic carbon atoms. In some embodiments, aliphatic groups contain 1-20 aliphatic carbon atoms. In other embodiments, aliphatic groups contain 1-10 aliphatic carbon atoms. In other embodiments, aliphatic groups contain 1-9 aliphatic carbon atoms. In other embodiments, aliphatic groups contain 1-8 aliphatic carbon atoms. In other embodiments, aliphatic groups contain 1-7 aliphatic carbon atoms. In other embodiments, aliphatic groups contain 1-6 aliphatic carbon atoms. In still other embodiments, aliphatic groups contain 1-5 aliphatic carbon atoms, and in yet other embodiments, aliphatic groups contain 1, 2, 3, or 4 aliphatic carbon atoms. Suitable aliphatic groups include, but are not limited to, linear or branched, substituted or unsubstituted alkyl, alkenyl, alkynyl groups and hybrids thereof such as (cycloalkyl)alkyl, (cycloalkenyl)alkyl or (cycloalkyl)alkenyl.

Alkenyl: As used herein, the term "alkenyl" refers to an alkyl group, as defined herein, having one or more double bonds.

Alkyl: As used herein, the term "alkyl" is given its ordinary meaning in the art and may include saturated aliphatic groups, including straight-chain alkyl groups, branched-chain alkyl groups, cycloalkyl (alicyclic) groups, alkyl substituted cycloalkyl groups, and cycloalkyl substituted alkyl groups. In some embodiments, an alkyl has 1-100 carbon atoms. In certain embodiments, a straight chain or branched chain alkyl has about 1-20 carbon atoms in its backbone (e.g., $C_1$-$C_{20}$ for straight chain, $C_2$-$C_{20}$ for branched chain), and alternatively, about 1-10. In some embodiments, cycloalkyl rings have from about 3-10 carbon atoms in their ring structure where such rings are monocyclic, bicyclic, or polycyclic, and alternatively about 5, 6 or 7 carbons in the ring structure. In some embodiments, an alkyl group may be a lower alkyl group, wherein a lower alkyl group comprises 1-4 carbon atoms (e.g., $C_1$-$C_4$ for straight chain lower alkyls).

Alkynyl: As used herein, the term "alkynyl" refers to an alkyl group, as defined herein, having one or more triple bonds.

Animal: As used herein, the term "animal" refers to any member of the animal kingdom. In some embodiments, "animal" refers to humans, at any stage of development. In some embodiments, "animal" refers to non-human animals, at any stage of development. In certain embodiments, the non-human animal is a mammal (e.g., a rodent, a mouse, a rat, a rabbit, a monkey, a dog, a cat, a sheep, cattle, a primate and/or a pig). In some embodiments, animals include, but are not limited to, mammals, birds, reptiles, amphibians, fish and/or worms. In some embodiments, an animal may be a transgenic animal, a genetically-engineered animal and/or a clone.

Approximately: As used herein, the terms "approximately" or "about" in reference to a number are generally taken to include numbers that fall within a range of 5%, 10%, 15%, or 20% in either direction (greater than or less than) of the number unless otherwise stated or otherwise evident from the context (except where such number would be less than 0% or exceed 100% of a possible value). In some embodiments, use of the term "about" in reference to dosages means±5 mg/kg/day.

Aryl: The term "aryl", as used herein, used alone or as part of a larger moiety as in "aralkyl," "aralkoxy," or "aryloxyalkyl," refers to monocyclic, bicyclic or polycyclic ring systems having a total of five to thirty ring members, wherein at least one ring in the system is aromatic. In some embodiments, an aryl group is a monocyclic, bicyclic or polycyclic ring system having a total of five to fourteen ring members, wherein at least one ring in the system is aromatic, and wherein each ring in the system contains 3 to 7 ring members. In some embodiments, an aryl group is a biaryl group. The term "aryl" may be used interchangeably with the term "aryl ring." In certain embodiments of the present disclosure, "aryl" refers to an aromatic ring system which includes, but not limited to, phenyl, biphenyl, naphthyl, binaphthyl, anthracyl and the like, which may bear one or more substituents. Also included within the scope of the term "aryl," as it is used herein, is a group in which an aromatic ring is fused to one or more non-aromatic rings, such as indanyl, phthalimidyl, naphthimidyl, phenanthridinyl, or tetrahydronaphthyl, and the like.

Characteristic portion: As used herein, the phrase a "characteristic portion" of a protein or polypeptide is one that contains a continuous stretch of amino acids, or a collection of continuous stretches of amino acids, that together are characteristic of a protein or polypeptide. Each such continuous stretch generally will contain at least two amino acids. Furthermore, those of ordinary skill in the art will appreciate that typically at least 5, 10, 15, 20 or more amino acids are required to be characteristic of a protein. In general, a characteristic portion is one that, in addition to the sequence identity specified above, shares at least one functional characteristic with the relevant intact protein.

Characteristic structural element: The term "characteristic structural element" or "structural element" refers to a distinctive structural element that is found in all members of a family of polypeptides, small molecules, or nucleic acids, and therefore can be used by those of ordinary skill in the art to define members of the family. In some embodiments, a structural element of a single-stranded RNAi agent includes, but is not limited to: a 5'-end structure, a 5'-end region, a 5' nucleotide moiety, a seed region, a post-seed region, a 3'-end region, a 3'-terminal dinucleotide, a 3' cap, a pattern of modifications, a pattern of stereochemistry in the backbone, additional chemical moieties, etc.

Comparable: The term "comparable" is used herein to describe two (or more) sets of conditions or circumstances that are sufficiently similar to one another to permit comparison of results obtained or phenomena observed. In some embodiments, comparable sets of conditions or circumstances are characterized by a plurality of substantially identical features and one or a small number of varied features. Those of ordinary skill in the art will appreciate that sets of conditions are comparable to one another when characterized by a sufficient number and type of substantially identical features to warrant a reasonable conclusion that differences in results obtained or phenomena observed under the different sets of conditions or circumstances are caused by or indicative of the variation in those features that are varied.

Cycloaliphatic: The term "cycloaliphatic," "carbocycle," "carbocyclyl," "carbocyclic radical," and "carbocyclic ring," are used interchangeably, and as used herein, refer to saturated or partially unsaturated, but non-aromatic, cyclic aliphatic monocyclic, bicyclic, or polycyclic ring systems, as described herein, having, unless otherwise specified, from 3 to 30 ring members. Cycloaliphatic groups include, without limitation, cyclopropyl, cyclobutyl, cyclopentyl, cyclopentenyl, cyclohexyl, cyclohexenyl, cycloheptyl, cycloheptenyl, cyclooctyl, cyclooctenyl, norbornyl, adamantyl, and cyclooctadienyl. In some embodiments, a cycloaliphatic group has 3-6 carbons. In some embodiments, a cycloaliphatic group is saturated and is cycloalkyl. The term "cycloaliphatic" may also include aliphatic rings that are fused to one or more aromatic or nonaromatic rings, such as decahydronaphthyl or tetrahydronaphthyl. In some embodiments, a cycloaliphatic group is bicyclic. In some embodiments, a cycloaliphatic group is tricyclic. In some embodiments, a cycloaliphatic group is polycyclic. In some embodiments, "cycloaliphatic" refers to $C_3$-$C_6$ monocyclic hydrocarbon, or $C_8$-$C_{10}$ bicyclic or polycyclic hydrocarbon, that is completely saturated or that contains one or more units of unsaturation, but which is not aromatic, that has a single point of attachment to the rest of the molecule, or a $C_9$-$C_{16}$ polycyclic hydrocarbon that is completely saturated or that contains one or more units of unsaturation, but which is not aromatic, that has a single point of attachment to the rest of the molecule.

Dosing regimen: As used herein, a "dosing regimen" or "therapeutic regimen" refers to a set of unit doses (typically more than one) that are administered individually to a subject, typically separated by periods of time. In some embodiments, a given therapeutic agent has a recommended dosing regimen, which may involve one or more doses. In some embodiments, a dosing regimen comprises a plurality of doses each of which are separated from one another by a time period of the same length; in some embodiments, a dosing regime comprises a plurality of doses and at least two different time periods separating individual doses. In some embodiments, all doses within a dosing regimen are of the same unit dose amount. In some embodiments, different doses within a dosing regimen are of different amounts. In some embodiments, a dosing regimen comprises a first dose in a first dose amount, followed by one or more additional doses in a second dose amount different from the first dose amount. In some embodiments, a dosing regimen comprises a first dose in a first dose amount, followed by one or more additional doses in a second dose amount same as the first dose amount.

Equivalent agents: Those of ordinary skill in the art, reading the present disclosure, will appreciate that the scope of useful agents in the context of the present disclosure is not limited to those specifically mentioned or exemplified herein. In particular, those skilled in the art will recognize that active agents typically have a structure that consists of a core and attached pendant moieties, and furthermore will appreciate that simple variations of such core and/or pendant moieties may not significantly alter activity of the agent. For example, in some embodiments, substitution of one or more pendant moieties with groups of comparable three-dimensional structure and/or chemical reactivity characteristics may generate a substituted compound or portion equivalent to a parent reference compound or portion. In some embodiments, addition or removal of one or more pendant moieties may generate a substituted compound equivalent to a parent reference compound. In some embodiments, alteration of core structure, for example by addition or removal of a small number of bonds (typically not more than 5, 4, 3, 2, or 1 bonds, and often only a single bond) may generate a substituted compound equivalent to a parent reference compound. In many embodiments, equivalent compounds may be prepared by methods illustrated in general reaction schemes as, for example, described below, or by modifications thereof, using readily available starting materials, reagents and conventional or provided synthesis procedures. In these reactions, it is also possible to make use of variants, which are in themselves known, but are not mentioned here.

Equivalent Dosage: The term "equivalent dosage" is used herein to compare dosages of different pharmaceutically active agents that effect the same biological result. Dosages of two different agents are considered to be "equivalent" to one another in accordance with the present disclosure if they achieve a comparable level or extent of the biological result. In some embodiments, equivalent dosages of different pharmaceutical agents for use in accordance with the present disclosure are determined using in vitro and/or in vivo assays as described herein. In some embodiments, one or more lysosomal activating agents for use in accordance with the present disclosure is utilized at a dose equivalent to a dose of a reference lysosomal activating agent; in some such embodiments, the reference lysosomal activating agent for such purpose is selected from the group consisting of small molecule allosteric activators (e.g., pyrazolpyrimidines), imminosugars (e.g., isofagomine), antioxidants (e.g., n-acetyl-cysteine), and regulators of cellular trafficking (e.g., Rab1a polypeptide).

Heteroaliphatic: The term "heteroaliphatic", as used herein, is given its ordinary meaning in the art and refers to aliphatic groups as described herein in which one or more carbon atoms are independently replaced with one or more heteroatoms (e.g., oxygen, nitrogen, sulfur, silicon, phosphorus, and the like). In some embodiments, one or more units selected from C, CH, $CH_2$, and $CH_3$ are independently replaced by one or more heteroatoms (including oxidized and/or substituted form thereof). In some embodiments, a heteroaliphatic group is heteroalkyl. In some embodiments, a heteroaliphatic group is heteroalkenyl.

Heteroalkyl: The term "heteroalkyl", as used herein, is given its ordinary meaning in the art and refers to alkyl groups as described herein in which one or more carbon atoms are independently replaced with one or more heteroatoms (e.g., oxygen, nitrogen, sulfur, silicon, phosphorus, and the like). Examples of heteroalkyl groups include, but are not limited to, alkoxy, poly(ethylene glycol)-, alkyl-substituted amino, tetrahydrofuranyl, piperidinyl, morpholinyl, etc.

Heteroaryl: The terms "heteroaryl" and "heteroar-", as used herein, used alone or as part of a larger moiety, e.g., "heteroaralkyl," or "heteroaralkoxy," refer to monocyclic, bicyclic or polycyclic ring systems having a total of five to thirty ring members, wherein at least one ring in the system is aromatic and at least one aromatic ring atom is a heteroatom. In some embodiments, a heteroaryl group is a group having 5 to 10 ring atoms (i.e., monocyclic, bicyclic or polycyclic), in some embodiments 5, 6, 9, or 10 ring atoms. In some embodiments, a heteroaryl group has 6, 10, or 14 π electrons shared in a cyclic array; and having, in addition to carbon atoms, from one to five heteroatoms. Heteroaryl groups include, without limitation, thienyl, furanyl, pyrrolyl, imidazolyl, pyrazolyl, triazolyl, tetrazolyl, oxazolyl, isoxazolyl, oxadiazolyl, thiazolyl, isothiazolyl, thiadiazolyl, pyridyl, pyridazinyl, pyrimidinyl, pyrazinyl, indolizinyl, purinyl, naphthyridinyl, and pteridinyl. In some embodiments, a heteroaryl is a heterobiaryl group, such as bipyridyl and the like. The terms "heteroaryl" and "heteroar-", as used herein, also include groups in which a heteroaromatic ring is fused to one or more aryl, cycloaliphatic, or heterocyclyl rings, where the radical or point of attachment is on the heteroaromatic ring. Non-limiting examples include indolyl, isoindolyl, benzothienyl, benzofuranyl, dibenzofuranyl, indazolyl, benzimidazolyl, benzthiazolyl, quinolyl, isoquinolyl, cinnolinyl, phthalazinyl, quinazolinyl, quinoxalinyl, 4H-quinolizinyl, carbazolyl, acridinyl, phenazinyl, phenothiazinyl, phenoxazinyl, tetrahydroquinolinyl, tetrahydroisoquinolinyl, and pyrido[2,3-b]-1,4-oxazin-3(4H)-one. A heteroaryl group may be monocyclic, bicyclic or polycyclic. The term "heteroaryl" may be used interchangeably with the terms "heteroaryl ring," "heteroaryl group," or "heteroaromatic," any of which terms include rings that are optionally substituted. The term "heteroaralkyl" refers to an alkyl group substituted by a heteroaryl group, wherein the alkyl and heteroaryl portions independently are optionally substituted.

Heteroatom: The term "heteroatom", as used herein, means an atom that is not carbon or hydrogen. In some embodiments, a heteroatom is oxygen, sulfur, nitrogen, phosphorus, or silicon (including any oxidized form of nitrogen, sulfur, phosphorus, or silicon; the quaternized form of any basic nitrogen or a substitutable nitrogen of a heterocyclic ring (for example, N as in 3,4-dihydro-2H-pyrrolyl), NH (as in pyrrolidinyl) or NR$^+$ (as in N-substituted pyrrolidinyl); etc.).

Heterocycle: As used herein, the terms "heterocycle," "heterocyclyl," "heterocyclic radical," and "heterocyclic ring", as used herein, are used interchangeably and refer to a monocyclic, bicyclic or polycyclic ring moiety (e.g., 3-30 membered) that is saturated or partially unsaturated and has one or more heteroatom ring atoms. In some embodiments, a heterocyclyl group is a stable 5- to 7-membered monocyclic or 7- to 10-membered bicyclic heterocyclic moiety that is either saturated or partially unsaturated, and having, in addition to carbon atoms, one or more, preferably one to four, heteroatoms, as defined above. When used in reference to a ring atom of a heterocycle, the term "nitrogen" includes substituted nitrogen. As an example, in a saturated or partially unsaturated ring having 0-3 heteroatoms selected from oxygen, sulfur and nitrogen, the nitrogen may be N (as in 3,4-dihydro-2H-pyrrolyl), NH (as in pyrrolidinyl), or $^+$NR (as in N-substituted pyrrolidinyl). A heterocyclic ring can be attached to its pendant group at any heteroatom or carbon atom that results in a stable structure and any of the ring atoms can be optionally substituted. Examples of such saturated or partially unsaturated heterocyclic radicals include, without limitation, tetrahydrofuranyl, tetrahydrothienyl, pyrrolidinyl, piperidinyl, pyrrolinyl, tetrahydroquinolinyl, tetrahydroisoquinolinyl, decahydroquinolinyl, oxazolidinyl, piperazinyl, dioxanyl, dioxolanyl, diazepinyl, oxazepinyl, thiazepinyl, morpholinyl, and quinuclidinyl. The terms "heterocycle," "heterocyclyl," "heterocyclyl ring," "heterocyclic group," "heterocyclic moiety," and "heterocyclic radical," are used interchangeably herein, and also include groups in which a heterocyclyl ring is fused to one or more aryl, heteroaryl, or cycloaliphatic rings, such as indolinyl, 3H-indolyl, chromanyl, phenanthridinyl, or tetrahydroquinolinyl. A heterocyclyl group may be monocyclic, bicyclic or polycyclic. The term "heterocyclylalkyl" refers to an alkyl group substituted by a heterocyclyl, wherein the alkyl and heterocyclyl portions independently are optionally substituted.

Intraperitoneal: The phrases "intraperitoneal administration" and "administered intraperitonealy" as used herein have their art-understood meaning referring to administration of a compound or composition into the peritoneum of a subject.

In vitro: As used herein, the term "in vitro" refers to events that occur in an artificial environment, e.g., in a test tube or reaction vessel, in cell culture, etc., rather than within an organism (e.g., animal, plant and/or microbe).

In vivo: As used herein, the term "in vivo" refers to events that occur within an organism (e.g., animal, plant and/or microbe).

Lower alkyl: The term "lower alkyl" refers to a $C_{1-4}$ straight or branched alkyl group. Example lower alkyl groups are methyl, ethyl, propyl, isopropyl, butyl, isobutyl, and tert-butyl.

Lower haloalkyl: The term "lower haloalkyl" refers to a $C_{1-4}$ straight or branched alkyl group that is substituted with one or more halogen atoms.

Optionally Substituted: As described herein, compounds, e.g., oligonucleotides, of the disclosure may contain optionally substituted and/or substituted moieties. In general, the term "substituted," whether preceded by the term "optionally" or not, means that one or more hydrogens of the designated moiety are replaced with a suitable substituent. Unless otherwise indicated, an "optionally substituted" group may have a suitable substituent at each substitutable position of the group, and when more than one position in any given structure may be substituted with more than one substituent selected from a specified group, the substituent may be either the same or different at every position. In some embodiments, an optionally substituted group is unsubstituted. Combinations of substituents envisioned by this disclosure are preferably those that result in the formation of stable or chemically feasible compounds. The term "stable," as used herein, refers to compounds that are not substantially altered when subjected to conditions to allow for their production, detection, and, in certain embodiments, their recovery, purification, and use for one or more of the purposes disclosed herein.

Suitable monovalent substituents on a substitutable atom, e.g., a suitable carbon atom, are independently halogen; —(CH$_2$)$_{0-4}$R°; —(CH$_2$)$_{0-40}$R°; —O(CH$_2$)$_{0-4}$R°, —O—(CH$_2$)$_{0-4}$C(O)OR°; —(CH$_2$)$_{0-4}$CH(OR°)$_2$; —(CH$_2$)$_{0-4}$Ph, which may be substituted with R°; —(CH$_2$)$_{0-40}$(CH$_2$)$_{0-1}$Ph which may be substituted with R°; —CH=CHPh, which may be substituted with R°; —(CH$_2$)$_{0-4}$O(CH$_2$)$_{0-1}$-pyridyl which may be substituted with R°; —NO$_2$; —CN; —N$_3$; —(CH$_2$)$_{0-4}$N(R°)$_2$; —(CH$_2$)$_{0-4}$N(R°)C(O)R°; —N(R°)C(S)R°; —(CH$_2$)$_{0-4}$N(R°)C(O)NR°$_2$; —N(R°)C(S)NR°$_2$; —(CH$_2$)$_{0-4}$N(R°)C(O)OR°; —N(R°)N(R°)C(O)R°; —N(R°)N(R°)C(O)NR°$_2$; —N(R°)N(R°)C(O)OR°; —(CH$_2$)$_{0-4}$C(O)R°; —C(S)R°; —(CH$_2$)$_{0-4}$C(O)OR°; —(CH$_2$)$_{0-4}$C(O)SR°; —(CH$_2$)$_{0-4}$C(O)OSiR°$_3$; —(CH$_2$)$_{0-4}$OC(O)R°; —OC(O)(CH$_2$)$_{0-4}$SR, —SC(S)SR°; —(CH$_2$)$_{0-4}$SC(O)R°; —(CH$_2$)$_{0-4}$C(O)NR°$_2$; —C(S)NR°$_2$; —C(S)SR°; —SC(S)SR°, —(CH$_2$)$_{0-4}$OC(O)NR°$_2$; —C(O)N(OR°)R°; —C(O)C(O)R°; —C(O)CH$_2$C(O)R°; —C(NOR°)R°; —(CH$_2$)$_{0-4}$SSR°; —(CH$_2$)$_{0-4}$S(O)$_2$R°; —(CH$_2$)$_{0-4}$S(O)$_2$OR°; —(CH$_2$)$_{0-40}$S(O)$_2$R°; —S(O)$_2$NR°$_2$; —(CH$_2$)$_{0-4}$S(O)R°; —N(R°)S(O)$_2$NR°$_2$; —N(R°)S(O)$_2$R°; —N(OR°)R°; —C(NH)NR°$_2$; —Si(R°)$_3$; —OSi(R°)$_3$; —B(R°)$_2$; —OB(R°)$_2$; —OB(OR°)$_2$; —P(R°)$_2$; —P(OR°)$_2$; —OP(R°)$_2$; —OP(OR°)$_2$; —P(O)(R°)$_2$; —P(O)(OR°)$_2$; —OP(O)(R°)$_2$; —OP(O)(OR°)$_2$; —OP(O)(OR°)(SR°); —SP(O)(R°)$_2$; —SP(O)(OR°)$_2$; —N(R°)P(O)(R°)$_2$; —N(R°)P(O)(OR°)$_2$; —P(R°)$_2$[B(R°)$_3$]; —P(OR°)$_2$[B(R°)$_3$]; —OP(R°)$_2$[B(R°)$_3$]; —OP(OR°)$_2$[B(R°)$_3$]; —(C$_{1-4}$ straight or branched alkylene)O—N(R°)$_2$; or —(C$_{1-4}$ straight or branched alkylene)C(O)O—N(R°)$_2$, wherein each R° may be substituted as defined below and is independently hydrogen, C$_{1-20}$ aliphatic, C$_{1-20}$ heteroaliphatic having 1-5 heteroatoms independently selected from nitrogen, oxygen, sulfur, silicon and phosphorus, —CH$_2$—(C$_{6-14}$ aryl), —O(CH$_2$)$_{0-1}$(C$_{6-14}$ aryl), —CH$_2$-(5-14 membered heteroaryl ring), a 5-20 membered, monocyclic, bicyclic, or polycyclic, saturated, partially unsaturated or aryl ring having 0-5 heteroatoms independently selected from nitrogen, oxygen, sulfur, silicon and phosphorus, or, notwithstanding the definition above, two independent occurrences of R°, taken together with their intervening atom(s), form a 5-20 membered, monocyclic, bicyclic, or polycyclic, saturated, partially unsaturated or aryl ring having 0-5 heteroatoms independently selected from nitrogen, oxygen, sulfur, silicon and phosphorus, which may be substituted as defined below.

Suitable monovalent substituents on R° (or the ring formed by taking two independent occurrences of R° together with their intervening atoms), are independently halogen, —(CH$_2$)$_{0-2}$R$^\bullet$, -(haloR$^\bullet$), —(CH$_2$)$_{0-2}$OH, —(CH$_2$)$_{0-2}$OR$^\bullet$, —(CH$_2$)$_{0-2}$CH(OR$^\bullet$)$_2$; —O(haloR$^\bullet$), —CN, —N$_3$, —(CH$_2$)$_{0-2}$C(O)R$^\bullet$, —(CH$_2$)$_{0-2}$C(O)OH, —(CH$_2$)$_{0-2}$C(O)OR$^\bullet$, —(CH$_2$)$_{0-2}$SR$^\bullet$, —(CH$_2$)$_{0-2}$SH, —(CH$_2$)$_{0-2}$NH$_2$, —(CH$_2$)$_{0-2}$NHR$^\bullet$, —(CH$_2$)$_{0-2}$NR$^\bullet_2$, —NO$_2$, —SiR$^\bullet_3$, —OSiR$^\bullet_3$, —C(O)SR$^\bullet$, —(C$_{1-4}$ straight or branched alkylene)C(O)OR$^\bullet$, or —SSR$^\bullet$ wherein each R$^\bullet$ is unsubstituted or where preceded by "halo" is substituted only with one or more halogens, and is independently selected from C$_{1-4}$ aliphatic, —CH$_2$Ph, —O(CH$_2$)$_{0-1}$Ph, and a 5-6-membered saturated, partially unsaturated, or aryl ring having 0-4 heteroatoms independently selected from nitrogen, oxygen, and sulfur. Suitable divalent substituents on a saturated carbon atom of R° include =O and =S.

Suitable divalent substituents, e.g., on a suitable carbon atom, are independently the following: =O, =S, =NNR*$_2$, =NNHC(O)R*, =NNHC(O)OR*, =NNHS(O)$_2$R*, =NR*, =NOR*, —O(C(R*$_2$))$_{2-3}$O—, or —S(C(R*$_2$))$_{2-3}$S—, wherein each independent occurrence of R* is selected from hydrogen, C$_{1-6}$ aliphatic which may be substituted as defined below, and an unsubstituted 5-6-membered saturated, partially unsaturated, or aryl ring having 0-4 heteroatoms independently selected from nitrogen, oxygen, and sulfur. Suitable divalent substituents that are bound to vicinal substitutable carbons of an "optionally substituted" group include: —O(CR*$_2$)$_{2-3}$O—, wherein each independent occurrence of R* is selected from hydrogen, C$_{1-6}$ aliphatic which may be substituted as defined below, and an unsubstituted 5-6-membered saturated, partially unsaturated, or aryl ring having 0-4 heteroatoms independently selected from nitrogen, oxygen, and sulfur.

Suitable substituents on the aliphatic group of R* are independently halogen, —R$^\bullet$, -(haloR$^\bullet$), —OH, —OR$^\bullet$, —O(haloR$^\bullet$), —CN, —C(O)OH, —C(O)OR$^\bullet$, —NH$_2$, —NHR$^\bullet$, —NR$^\bullet_2$, or —NO$_2$, wherein each R$^\bullet$ is unsubstituted or where preceded by "halo" is substituted only with one or more halogens, and is independently C$_{1-4}$ aliphatic, —CH$_2$Ph, —O(CH$_2$)$_{0-1}$Ph, or a 5-6-membered saturated, partially unsaturated, or aryl ring having 0-4 heteroatoms independently selected from nitrogen, oxygen, and sulfur.

Oral: The phrases "oral administration" and "administered orally" as used herein have their art-understood meaning referring to administration by mouth of a compound or composition.

Parenteral: The phrases "parenteral administration" and "administered parenterally" as used herein have their art-understood meaning referring to modes of administration other than enteral and topical administration, usually by injection, and include, without limitation, intravenous, intramuscular, intraarterial, intrathecal, intracapsular, intraorbital, intracardiac, intradermal, intraperitoneal, transtracheal, subcutaneous, subcuticular, intraarticulare, subcapsular, subarachnoid, intraspinal, and intrasternal injection and infusion.

Partially unsaturated. As used herein, the term "partially unsaturated" refers to a ring moiety that includes at least one double or triple bond. The term "partially unsaturated" is intended to encompass rings having multiple sites of unsaturation, but is not intended to include aryl or heteroaryl moieties, as herein defined.

Pharmaceutical composition: As used herein, the term "pharmaceutical composition" refers to an active agent, formulated together with one or more pharmaceutically acceptable carriers. In some embodiments, an active agent is present in unit dose amount appropriate for administration in a therapeutic regimen that shows a statistically significant probability of achieving a predetermined therapeutic effect when administered to a relevant population. In some embodiments, pharmaceutical compositions may be specially formulated for administration in solid or liquid form, including those adapted for the following: oral administration, for example, drenches (aqueous or non-aqueous solutions or suspensions), tablets, e.g., those targeted for buccal, sublingual, and systemic absorption, boluses, powders, granules, pastes for application to the tongue; parenteral administration, for example, by subcutaneous, intramuscular, intravenous or epidural injection as, for example, a sterile solution or suspension, or sustained-release formulation; topical application, for example, as a cream, ointment, or a controlled-release patch or spray applied to the skin, lungs, or oral cavity; intravaginally or intrarectally, for example, as a pessary, cream, or foam; sublingually; ocularly; transdermally; or nasally, pulmonary, and to other mucosal surfaces.

Pharmaceutically acceptable: As used herein, the phrase "pharmaceutically acceptable" refers to those compounds, materials, compositions and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable carrier: As used herein, the term "pharmaceutically acceptable carrier" means a pharmaceutically-acceptable material, composition or vehicle, such as a liquid or solid filler, diluent, excipient, or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the patient. Some examples of materials which can serve as pharmaceutically-acceptable carriers include: sugars, such as lactose, glucose and sucrose; starches, such as corn starch and potato starch; cellulose, and its derivatives, such as sodium carboxymethyl cellulose, ethyl cellulose and cellulose acetate; powdered tragacanth; malt; gelatin; talc; excipients, such as cocoa butter and suppository waxes; oils, such as peanut oil, cottonseed oil, safflower oil, sesame oil, olive oil, corn oil and soybean oil; glycols, such as propylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; pH buffered solutions; polyesters, polycarbonates and/or polyanhydrides; and other non-toxic compatible substances employed in pharmaceutical formulations.

Pharmaceutically acceptable salt: The term "pharmaceutically acceptable salt", as used herein, refers to salts of such compounds that are appropriate for use in pharmaceutical contexts, i.e., salts which are, within the scope of sound medical judgment, suitable for use in contact with the tissues of humans and lower animals without undue toxicity, irritation, allergic response and the like, and are commensurate with a reasonable benefit/risk ratio. Pharmaceutically acceptable salts are well known in the art. For example, S. M. Berge, et al. describes pharmaceutically acceptable salts in detail in J. Pharmaceutical Sciences, 66: 1-19 (1977). In some embodiments, pharmaceutically acceptable salt include, but are not limited to, nontoxic acid addition salts, which are salts of an amino group formed with inorganic acids such as hydrochloric acid, hydrobromic acid, phosphoric acid, sulfuric acid and perchloric acid or with organic acids such as acetic acid, maleic acid, tartaric acid, citric acid, succinic acid or malonic acid or by using other methods used in the art such as ion exchange. In some embodiments, pharmaceutically acceptable salts include, but are not limited to, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemi sulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. In some embodiments, a provided compound comprises one or more acidic groups, e.g., an oligonucleotide, and a pharmaceutically acceptable salt is an alkali, alkaline earth metal, or ammonium (e.g., an ammonium salt of N(R)3, wherein each R is independently defined and described in the present disclosure) salt. Representative alkali or alkaline earth metal salts include sodium, lithium, potassium, calcium, magnesium, and the like. In some embodiments, a pharmaceutically acceptable salt is a sodium salt. In some embodiments, a pharmaceutically acceptable salt is a potassium salt. In some embodiments, a pharmaceutically acceptable salt is a calcium salt. In some embodiments, pharmaceutically acceptable salts include, when appropriate, nontoxic ammonium, quaternary ammonium, and amine cations formed using counterions such as halide, hydroxide, carboxylate, sulfate, phosphate, nitrate, alkyl having from 1 to 6 carbon atoms, sulfonate and aryl sulfonate. In some embodiments, a provided compound comprises more than one acid groups, for example, a provided oligonucleotide may comprise two or more acidic groups (e.g., in natural phosphate linkages and/or modified internucleotidic linkages). In some embodiments, a pharmaceutically acceptable salt, or generally a salt, of such a compound comprises two or more cations, which can be the same or different. In some embodiments, in a pharmaceutically acceptable salt (or generally, a salt), all ionizable hydrogen in the acidic groups are replaced with cations. In some embodiments, a pharmaceutically acceptable salt is a sodium salt of a provided oligonucleotide. In some embodiments, a pharmaceutically acceptable salt is a sodium salt of a provided oligonucleotide, wherein each acidic phosphate group exists as a salt form (all sodium salt); for example, a sodium salt of WV-2555 containing 19 $Na^+$, or a sodium salt of WV-2555 containing 23 $Na^+$.

Prodrug: A general, a "prodrug," as that term is used herein and as is understood in the art, is an entity that, when administered to an organism, is metabolized in the body to deliver an active (e.g., therapeutic or diagnostic) agent of interest. Typically, such metabolism involves removal of at least one "prodrug moiety" so that the active agent is formed. Various forms of "prodrugs" are known in the art. For examples of such prodrug moieties, see:
  a) *Design of Prodrugs*, edited by H. Bundgaard, (Elsevier, 1985) and *Methods in Enzymology*, 42:309-396, edited by K. Widder, et al. (Academic Press, 1985);
  b) *Prodrugs and Targeted Delivery*, edited by by J. Rautio (Wiley, 2011);
  c) A Textbook of Drug Design and Development, edited by Krogsgaard-Larsen;
  d) Bundgaard, Chapter 5 "Design and Application of Prodrugs", by H. Bundgaard, p. 113-191 (1991);
  e) Bundgaard, *Advanced Drug Delivery Reviews*, 8:1-38 (1992);
  f) Bundgaard, et al., *Journal of Pharmaceutical Sciences*, 77:285 (1988); and
  g) Kakey a, et al., *Chem. Pharm. Bull.*, 32:692 (1984).

As with other compounds described herein, prodrugs may be provided in any of a variety of forms, e.g., crystal forms, salt forms etc. In some embodiments, prodrugs are provided as pharmaceutically acceptable salts thereof.

Protecting group: The term "protecting group," as used herein, is well known in the art and includes those described in detail in *Protecting Groups in Organic Synthesis*, T. W. Greene and P. G. M. Wuts, $3^{rd}$ edition, John Wiley & Sons, 1999, the entirety of which is incorporated herein by reference. Also included are those protecting groups specially adapted for nucleoside and nucleotide chemistry described in *Current Protocols in Nucleic Acid Chemistry*, edited by Serge L. Beaucage et al. June 2012, the entirety of Chapter 2 is incorporated herein by reference. Suitable amino-protecting groups include methyl carbamate, ethyl carbamate, 9-fluorenylmethyl carbamate (Fmoc), 9-(2-sulfo)fluorenylmethyl carbamate, 9-(2,7-dibromo)fluoroenylmethyl carbamate, 2,7-di-t-butyl-[9-(10,10-dioxo-10,10,10,10-tetrahydrothioxanthyl)]methyl carbamate (DBD-Tmoc), 4-methoxyphenacyl carbamate (Phenoc), 2,2,2-trichloroethyl carbamate (Troc), 2-trimethylsilylethyl carbamate (Teoc), 2-phenylethyl carbamate (hZ), 1-(1-adamantyl)-1-methylethyl carbamate (Adpoc), 1,1-dimethyl-2-haloethyl carbamate, 1,1-dimethyl-2,2-dibromoethyl carbamate (DB-t-BOC), 1,1-dimethyl-2,2,2-trichloroethyl carbamate (TCBOC), 1-methyl-1-(4-biphenylyl)ethyl carbamate (Bpoc), 1-(3,5-di-t-butylphenyl)-1-methylethyl carbamate (t-Bumeoc), 2-(2'- and 4'-pyridyl)ethyl carbamate (Pyoc), 2-(N,N-dicyclohexylcarboxamido)ethyl carbamate, t-butyl carbamate (BOC), 1-adamantyl carbamate (Adoc), vinyl carbamate (Voc), allyl carbamate (Alloc), 1-isopropylallyl carbamate (Ipaoc), cinnamyl carbamate (Coc), 4-nitrocinnamyl carbamate (Noc), 8-quinolyl carbamate, N-hydroxypiperidinyl carbamate, alkyldithio carbamate, benzyl carbamate (Cbz), p-methoxybenzyl carbamate (Moz), p-nitobenzyl carbamate, p-bromobenzyl carbamate, p-chlorobenzyl carbamate, 2,4-dichlorobenzyl carbamate, 4-methylsulfinylbenzyl carbamate (Msz), 9-anthrylmethyl carbamate, diphenylmethyl carbamate, 2-methylthioethyl carbamate, 2-methylsulfonylethyl carbamate, 2-(p-toluenesulfonyl)ethyl carbamate, [2-(1,3-dithianyl)]methyl carbamate (Dmoc), 4-methylthiophenyl carbamate (Mtpc), 2,4-dimethylthiophenyl carbamate (Bmpc), 2-phosphonioethyl carbamate (Peoc), 2-triphenylphosphonioisopropyl carbamate (Ppoc), 1,1-dimethyl-2-cyanoethyl carbamate, m-chloro-p-acyloxybenzyl carbamate, p-(dihydroxyboryl)benzyl carbamate, 5-benzisoxazolylmethyl carbamate, 2-(trifluoromethyl)-6-chromonylmethyl carbamate (Tcroc), m-nitrophenyl carbamate, 3,5-dimethoxybenzyl carbamate, o-nitrobenzyl carbamate, 3,4-dimethoxy-6-nitrobenzyl carbamate, phenyl(o-nitrophenyl)methyl carbamate, phenothiazinyl-(10)-carbonyl derivative, N'-p-toluenesulfonylaminocarbonyl derivative, N'-phenylaminothiocarbonyl derivative, t-amyl carbamate, S-benzyl thiocarbamate, p-cyanobenzyl carbamate, cyclobutyl carbamate, cyclohexyl carbamate, cyclopentyl carbamate, cyclopropylmethyl carbamate, p-decyloxybenzyl carbamate, 2,2-dimethoxycarbonylvinyl carbamate, o-(N,N-dimethylcarboxamido)benzyl carbamate, 1,1-dimethyl-3-(N,N-dimethylcarboxamido) propyl carbamate, 1,1-dimethylpropynyl carbamate, di(2-pyridyl)methyl carbamate, 2-furanylmethyl carbamate, 2-iodoethyl carbamate, isobornyl carbamate, isobutyl carbamate, isonicotinyl carbamate, p-(p'-methoxyphenylazo)benzyl carbamate, 1-methylcyclobutyl carbamate, 1-methylcyclohexyl carbamate, 1-methyl-1-cyclopropylmethyl carbamate, 1-methyl-1-(3,5-dimethoxyphenyl)ethyl carbamate, 1-methyl-1-(p-phenylazophenyl)ethyl carbamate, 1-methyl-1-phenylethyl carbamate, 1-methyl-1-(4-pyridyl) ethyl carbamate, phenyl carbamate, p-(phenylazo)benzyl carbamate, 2,4,6-tri-t-butylphenyl carbamate, 4-(trimethylammonium)benzyl carbamate, 2,4,6-trimethylbenzyl carbamate, formamide, acetamide, chloroacetamide, trichloroacetamide, trifluoroacetamide, phenylacetamide, 3-phenylpropanamide, picolinamide, 3-pyridylcarboxamide, N-benzoylphenylalanyl derivative, benzamide, p-phenylbenzamide, o-nitrophenylacetamide, o-nitrophenoxyacetamide, acetoacetamide, (N'-dithiobenzyloxycarbonylamino) acetamide, 3-(p-hydroxyphenyl)propanamide, 3-(o-nitrophenyl)propanamide, 2-methyl-2-(o-nitrophenoxy) propanamide, 2-methyl-2-(o-phenylazophenoxy) propanamide, 4-chlorobutanamide, 3-methyl-3-nitrobutanamide, o-nitrocinnamide, N-acetylmethionine derivative, o-nitrobenzamide, o-(benzoyloxymethyl)benzamide, 4,5-diphenyl-3-oxazolin-2-one, N-phthalimide, N-dithiasuccinimide (Dts), N-2,3-diphenylmaleimide, N-2,5-dimethylpyrrole, N-1,1,4,4-tetramethyldisilylazacyclopentane adduct (STABASE), 5-substituted 1,3-dimethyl-1,3,5-triazacyclohexan-2-one, 5-substituted 1,3-dibenzyl-1,3,5-triazacyclohexan-2-one, 1-substituted 3,5-dinitro-4-pyridone, N-methylamine, N-allylamine, N-[2-(trimethylsilyl)ethoxy]methylamine (SEM), N-3-acetoxypropylamine, N-(1-isopropyl-4-nitro-2-oxo-3-pyroolin-3-yl)amine, quaternary ammonium salts, N-benzylamine, N-di(4-methoxyphenyl)methylamine, N-5-dibenzosuberylamine, N-triphenylmethylamine (Tr), N-[(4-methoxyphenyl)diphenylmethyl]amine (MMTr), N-9-phenylfluorenylamine (PhF), N-2,7-dichloro-9-fluorenylmethyleneamine, N-ferrocenylmethylamino (Fcm), N-2-picolylamino N'-oxide, N-1,1-dimethylthiomethyleneamine, N-benzylideneamine, Np-methoxybenzylideneamine, N-diphenylmethyleneamine, N-[(2-pyridyl)mesityl]methyleneamine, N—(N',N'-dimethylaminomethylene)amine, N,N'-isopropylidenediamine, N-p-nitrobenzylideneamine, N-salicylideneamine, N-5-chlorosalicylideneamine, N-(5-chloro-2-hydroxyphenyl) phenylmethyleneamine, N-cyclohexylideneamine, N-(5,5-dimethyl-3-oxo-1-cyclohexenyl)amine, N-borane derivative, N-diphenylborinic acid derivative, N-[phenyl (pentacarbonylchromium- or tungsten)carbonyl]amine, N-copper chelate, N-zinc chelate, N-nitroamine, N-nitrosoamine, amine N-oxide, diphenylphosphinamide (Dpp), dimethylthiophosphinamide (Mpt), diphenylthiophosphinamide (Ppt), dialkyl phosphoramidates, dibenzyl phosphoramidate, diphenyl phosphoramidate, benzenesulfenamide, o-nitrobenzenesulfenamide (Nps), 2,4-dinitrobenzenesulfenamide, pentachlorobenzenesulfenamide, 2-nitro-4-methoxybenzenesulfenamide, triphenylmethylsulfenamide, 3-nitropyridinesulfenamide (Npys), p-toluenesulfonamide (Ts), benzenesulfonamide, 2,3,6,-trimethyl-4-methoxybenzenesulfonamide (Mtr), 2,4,6-trimethoxybenzenesulfonamide (Mtb), 2,6-dimethyl-4-methoxybenzenesulfonamide (Pme), 2,3,5,6-tetramethyl-4-methoxybenzenesulfonamide (Mte), 4-methoxybenzenesulfonamide (Mbs), 2,4,6-trimethylbenzenesulfonamide (Mts), 2,6-dimethoxy-4-methylbenzenesulfonamide (iMds), 2,2,5,7,8-pentamethylchroman-6-sulfonamide (Pme), methanesulfonamide (Ms), β-trimethylsilylethanesulfonamide (SES), 9-anthracenesulfonamide, 4-(4',8'-dimethoxynaphthylmethyl)benzenesulfonamide (DNMBS), benzylsulfonamide, trifluoromethylsulfonamide, and phenacylsulfonamide.

Suitably protected carboxylic acids further include, but are not limited to, silyl-, alkyl-, alkenyl-, aryl-, and arylalkyl-protected carboxylic acids. Examples of suitable silyl groups include trimethylsilyl, triethylsilyl, t-butyldimethylsilyl, t-butyldiphenylsilyl, triisopropylsilyl, and the like. Examples of suitable alkyl groups include methyl, benzyl, p-methoxybenzyl, 3,4-dimethoxybenzyl, trityl, t-butyl, tetrahydropyran-2-yl. Examples of suitable alkenyl groups include allyl. Examples of suitable aryl groups include optionally substituted phenyl, biphenyl, or naphthyl. Examples of suitable arylalkyl groups include optionally substituted benzyl (e.g., p-methoxybenzyl (MPM), 3,4-dimethoxybenzyl, O-nitrobenzyl, p-nitrobenzyl, p-halobenzyl, 2,6-dichlorobenzyl, p-cyanobenzyl), and 2- and 4-picolyl.

Suitable hydroxyl protecting groups include methyl, methoxylmethyl (MOM), methylthiomethyl (MTM), t-butylthiomethyl, (phenyldimethylsilyl)methoxymethyl (SMOM), benzyloxymethyl (BOM), p-methoxybenzyloxymethyl (PMBM), (4-methoxyphenoxy)methyl (p-AOM), guaiacolmethyl (GUM), t-butoxymethyl, 4-pentenyloxymethyl (POM), siloxymethyl, 2-methoxyethoxymethyl (MEM), 2,2,2-trichloroethoxymethyl, bis(2-chloroethoxy)methyl, 2-(trimethylsilyl)ethoxymethyl (SEMOR), tetrahydropyranyl (THP), 3-bromotetrahydropyranyl, tetrahydrothiopyranyl, 1-methoxycyclohexyl, 4-methoxytetrahydropyranyl (MTHP), 4-methoxytetrahydrothiopyranyl, 4-methoxytetrahydrothiopyranyl S,S-dioxide, 1-[(2-chloro-4-methyl)phenyl]-4-methoxypiperidin-4-yl (CTMP), 1,4-dioxan-2-yl, tetrahydrofuranyl, tetrahydrothiofuranyl, 2,3,3a,4,5,6,7,7a-octahydro-7,8,8-trimethyl-4,7-methanobenzofuran-2-yl, 1-ethoxyethyl, 1-(2-chloroethoxy)ethyl, 1-methyl-1-methoxyethyl, 1-methyl-1-benzyloxyethyl, 1-methyl-1-benzyloxy-2-fluoroethyl, 2,2,2-trichloroethyl, 2-trimethylsilylethyl, 2-(phenylselenyl)ethyl, t-butyl, allyl, p-chlorophenyl, p-methoxyphenyl, 2,4-dinitrophenyl, benzyl, p-methoxybenzyl, 3,4-dimethoxybenzyl, o-nitrobenzyl, p-nitrobenzyl, p-halobenzyl, 2,6-dichlorobenzyl, p-cyanobenzyl, p-phenylbenzyl, 2-picolyl, 4-picolyl, 3-methyl-2-picolyl N-oxido, diphenylmethyl, p,p'-dinitrobenzhydryl, 5-dibenzosuberyl, triphenylmethyl, α-naphthyldiphenylmethyl, p-methoxyphenyldiphenylmethyl, di(p-methoxyphenyl)phenylmethyl, tri(p-methoxyphenyl)methyl, 4-(4'-bromophenacyloxyphenyl)diphenylmethyl, 4,4',4''-tris(4,5-dichlorophthalimidophenyl)methyl, 4,4',4''-tris(levulinoyloxyphenyl)methyl, 4,4',4''-tris(benzoyloxyphenyl)methyl, 3-(imidazol-1-yl)bis(4',4''-dimethoxyphenyl)methyl, 1,1-bis(4-methoxyphenyl)-1'-pyrenylmethyl, 9-anthryl, 9-(9-phenyl)xanthenyl, 9-(9-phenyl-10-oxo)anthryl, 1,3-benzodithiolan-2-yl, benzisothiazolyl S,S-dioxido, trimethylsilyl (TMS), triethylsilyl (TES), triisopropylsilyl (TIPS), dimethylisopropylsilyl (IPDMS), diethylisopropylsilyl (DEIPS), dimethylthexylsilyl, t-butyldimethylsilyl (TBDMS), t-butyldiphenylsilyl (TBDPS), tribenzylsilyl, tri-p-xylylsilyl, triphenylsilyl, diphenylmethylsilyl (DPMS), t-butylmethoxyphenylsilyl (TBMPS), formate, benzoylformate, acetate, chloroacetate, dichloroacetate, trichloroacetate, trifluoroacetate, methoxyacetate, triphenylmethoxyacetate, phenoxyacetate, p-chlorophenoxyacetate, 3-phenylpropionate, 4-oxopentanoate (levulinate), 4,4-(ethylenedithio)pentanoate (levulinoyldithioacetal), pivaloate, adamantoate, crotonate, 4-methoxycrotonate, benzoate, p-phenylbenzoate, 2,4,6-trimethylbenzoate (mesitoate), alkyl methyl carbonate, 9-fluorenylmethyl carbonate (Fmoc), alkyl ethyl carbonate, alkyl 2,2,2-trichloroethyl carbonate (Troc), 2-(trimethylsilyl)ethyl carbonate (TMSEC), 2-(phenylsulfonyl) ethyl carbonate (Psec), 2-(triphenylphosphonio) ethyl carbonate (Peoc), alkyl isobutyl carbonate, alkyl vinyl carbonate alkyl allyl carbonate, alkyl p-nitrophenyl carbonate, alkyl benzyl carbonate, alkyl p-methoxybenzyl carbonate, alkyl 3,4-dimethoxybenzyl carbonate, alkyl o-nitrobenzyl carbonate, alkyl p-nitrobenzyl carbonate, alkyl S-benzyl thiocarbonate, 4-ethoxy-1-napththyl carbonate, methyl dithiocarbonate, 2-iodobenzoate, 4-azidobutyrate, 4-nitro-4-methylpentanoate, o-(dibromomethyl)benzoate, 2-formylbenzenesulfonate, 2-(methylthiomethoxy)ethyl, 4-(methylthiomethoxy)butyrate, 2-(methylthiomethoxymethyl)benzoate, 2,6-dichloro-4-methylphenoxyacetate, 2,6-dichloro-4-(1,1,3,3-tetramethylbutyl)phenoxyacetate, 2,4-bis(1,1-dimethylpropyl)phenoxyacetate, chlorodiphenylacetate, isobutyrate, monosuccinoate, (E)-2-methyl-2-butenoate, o-(methoxycarbonyl)benzoate, α-naphthoate, nitrate, alkyl N,N,N',N'-tetramethylphosphorodiamidate, alkyl N-phenylcarbamate, borate, dimethylphosphinothioyl, alkyl 2,4-dinitrophenylsulfenate, sulfate, methanesulfonate (mesylate), benzylsulfonate, and tosylate (Ts). For protecting 1,2- or 1,3-diols, the protecting groups include methylene acetal, ethylidene acetal, 1-t-butylethylidene ketal, 1-phenylethylidene ketal, (4-methoxyphenyl)ethylidene acetal, 2,2,2-trichloroethylidene acetal, acetonide, cyclopentylidene ketal, cyclohexylidene ketal, cycloheptylidene ketal, benzylidene acetal, p-methoxybenzylidene acetal, 2,4-dimethoxybenzylidene ketal, 3,4-dimethoxybenzylidene acetal, 2-nitrobenzylidene acetal, methoxymethylene acetal, ethoxymethylene acetal, dimethoxymethylene ortho ester, 1-methoxyethylidene ortho ester, 1-ethoxyethylidine ortho ester, 1,2-dimethoxyethylidene ortho ester, α-methoxybenzylidene ortho ester, 1-(N,N-dimethylamino)ethylidene derivative, α-(N,N'-dimethylamino)benzylidene derivative, 2-oxacyclopentylidene ortho ester, di-t-butylsilylene group (DTBS), 1,3-(1,1,3,3-tetraisopropyldisiloxanylidene) derivative (TIPDS), tetra-t-butoxydisiloxane-1,3-diylidene derivative (TBDS), cyclic carbonates, cyclic boronates, ethyl boronate, and phenyl boronate.

In some embodiments, a hydroxyl protecting group is acetyl, t-butyl, tbutoxymethyl, methoxymethyl, tetrahydropyranyl, 1-ethoxyethyl, 1-(2-chloroethoxy)ethyl, 2-trimethylsilylethyl, p-chlorophenyl, 2,4-dinitrophenyl, benzyl, benzoyl, p-phenylbenzoyl, 2,6-dichlorobenzyl, diphenylmethyl, p-nitrobenzyl, triphenylmethyl (trityl), 4,4'-dimethoxytrityl, trimethylsilyl, triethylsilyl, t-butyldimethylsilyl, t-butyldiphenylsilyl, triphenylsilyl, triisopropylsilyl, benzoylformate, chloroacetyl, trichloroacetyl, trifluoroacetyl, pivaloyl, 9-fluorenylmethyl carbonate, mesylate, tosylate, triflate, trityl, monomethoxytrityl (MMTr), 4,4'-dimethoxytrityl, (DMTr) and 4,4',4''-trimethoxytrityl (TMTr), 2-cyanoethyl (CE or Cne), 2-(trimethylsilyl)ethyl (TSE), 2-(2-nitrophenyl)ethyl, 2-(4-cyanophenyl)ethyl 2-(4-nitrophenyl)ethyl (NPE), 2-(4-nitrophenylsulfonyl)ethyl, 3,5-dichlorophenyl, 2,4-dimethylphenyl, 2-nitrophenyl, 4-nitrophenyl, 2,4,6-trimethylphenyl, 2-(2-nitrophenyl)ethyl, butylthiocarbonyl, 4,4',4''-tris(benzoyloxy)trityl, diphenylcarbamoyl, levulinyl, 2-(dibromomethyl)benzoyl (Dbmb), 2-(isopropylthiomethoxymethyl)benzoyl (Ptmt), 9-phenylxanthen-9-yl (pixyl) or 9-(p-methoxyphenyl)xanthine-9-yl (MOX). In some embodiments, each of the hydroxyl protecting groups is, independently selected from acetyl, benzyl, t-butyldimethylsilyl, t-butyldiphenylsilyl and 4,4'-dimethoxytrityl. In some embodiments, the hydroxyl protecting group is selected from the group consisting of trityl, monomethoxytrityl and 4,4'-dimethoxytrityl group.

In some embodiments, a phosphorous linkage protecting group is a group attached to the phosphorous linkage (e.g., an internucleotidic linkage) throughout oligonucleotide synthesis. In some embodiments, a protecting group is attached to a sulfur atom of an phosphorothioate group. In some embodiments, a protecting group is attached to an oxygen atom of an internucleotide phosphorothioate linkage. In some embodiments, a protecting group is attached to an oxygen atom of the internucleotide phosphate linkage. In some embodiments a protecting group is 2-cyanoethyl (CE or Cne), 2-trimethylsilylethyl, 2-nitroethyl, 2-sulfonylethyl, methyl, benzyl, o-nitrobenzyl, 2-(p-nitrophenyl)ethyl (NPE or Npe), 2-phenylethyl, 3-(N-tert-butylcarboxamido)-1-propyl, 4-oxopentyl, 4-methylthio-1-butyl, 2-cyano-1,1-dimethyl ethyl, 4-N-methylaminobutyl, 3-(2-pyridyl)-1-propyl, 2-[N-methyl-N-(2-pyridyl)]aminoethyl, 2-(N-formyl,N-methyl)aminoethyl, or 4-[N-methyl-N-(2,2,2-trifluoroacetyl)amino]butyl.

Protein: As used herein, the term "protein" refers to a polypeptide (i.e., a string of at least two amino acids linked to one another by peptide bonds). In some embodiments, proteins include only naturally-occurring amino acids. In some embodiments, proteins include one or more non-naturally-occurring amino acids (e.g., moieties that form one or more peptide bonds with adjacent amino acids). In some embodiments, one or more residues in a protein chain contain a non-amino-acid moiety (e.g., a glycan, etc). In some embodiments, a protein includes more than one polypeptide chain, for example linked by one or more disulfide bonds or associated by other means. In some embodiments, proteins contain L-amino acids, D-amino acids, or both; in some embodiments, proteins contain one or more amino acid modifications or analogs known in the art. Useful modifications include, e.g., terminal acetylation, amidation, methylation, etc. The term "peptide" is generally used to refer to a polypeptide having a length of less than about 100 amino acids, less than about 50 amino acids, less than 20 amino acids, or less than 10 amino acids. In some embodiments, proteins are antibodies, antibody fragments, biologically active portions thereof and/or characteristic portions thereof.

RNA interference: As used herein, the terms "RNA interference" or "RNAi" refer to a post-transcriptional, targeted gene-silencing process involving the RISC (RNA-induced silencing complex). A process of RNAi reportedly naturally occurs when ribonuclease III (Dicer) cleaves a longer dsRNA into shorter fragments called siRNAs. A naturally-produced siRNA (small interfering RNA) is typically about 21 to 23 nucleotides long with an about 19 basepair duplex and two single-stranded overhangs and is typically RNA. These RNA segments then reportedly direct the degradation of the target nucleic acid, such as a mRNA or pre-mRNA. Dicer has reportedly also been implicated in the excision of 21- and 22-nucleotide small temporal RNAs (stRNAs) from precursor RNA of conserved structure that are implicated in translational control. Hutvagner et al. 2001, Science, 293, 834. Those skilled in the art are aware that RNAi can be mediated by a single-stranded or a double-stranded oligonucleotide that includes a sequence complementary or substantially complementary to a target sequence (e.g., in a target mRNA). Thus, in some embodiments of the present disclosure, a single-stranded oligonucleotide as described herein may act as an RNAi agent; in some embodiments, a double-stranded oligonucleotide as described herein may act as an RNAi agent. In some embodiments, an RNAi response involves an endonuclease complex, commonly referred to as an RNA-induced silencing complex (RISC), which directs cleavage of single-stranded mRNA complementary to the antisense strand of the siRNA. In some embodiments, RISC directs cleavage of target RNA complementary to provided oligonucleotides which can function as single-stranded RNAi agent. In some embodiments, cleavage of a target RNA takes place in the middle of the region complementary to the antisense strand of a siRNA duplex or single-stranded RNAi agent. In some embodiments, RNA interference is directed by a single-stranded oligonucleotide which acts as a single-stranded RNAi agent that can direct RNA interference in a mechanism involving the RISC pathway.

RNAi agent: As used herein, the term "RNAi agent," "iRNA agent", and the like, refer to an oligonucleotide that, when administered to a system in which a target gene product (e.g., a transcript, such as a pre-mRNA or a mRNA, of a target gene) is being or has been expressed, reduces level and/or activity (e.g., translation) of that target gene product. In some embodiments, an RNAi agent may be or comprise a single-stranded oligonucleotide or a double-stranded oligonucleotide. In some embodiments, an RNAi agent may have a structure recognized in the art as a siRNA (short inhibitory RNA), shRNA (short or small hairpin RNA), dsRNA (double-stranded RNA), microRNA, etc. In some embodiments, an RNAi agent may specifically bind to a RNA target (e.g., a transcript of a target gene). In some embodiments, upon binding to its target, and RNAi agent is loaded to the RISC (RNA-induced silencing complex). In some embodiments, an RNAi agent directs degradation of, and/or inhibits translation of, its target, in some embodiments via a mechanism involving the RISC (RNA-induced silencing complex) pathway. In some embodiments, an RNAi agent is an oligonucleotide that activates the RISC complex/pathway. In some embodiments, an RNAi agent comprises an antisense strand sequence. In some embodiments, an RNAi agent includes only one oligonucleotide strand (e.g., is a single-stranded oligonucleotide). In some embodiments, a single-stranded RNAi agent oligonucleotide can be or comprise a sense or antisense strand sequence, as described by Sioud 2005 J. Mol. Biol. 348: 1079-1090. In some embodiments, a RNAi agent is a compound capable of directing RNA interference. In some embodiments, a RNAi agent may have a structure or format as is found in "canonical" siRNA structure). In some embodiments, an RNAi agent may have a structure that differs from a "canonical" siRNA structure. To give but a few examples, in some embodiments, an RNAi agent can be longer or shorter than the canonical, can be blunt-ended, and/or can comprise one or more modifications, mismatches, gaps and/or nucleotide replacements. In some embodiments, an RNAi agent contains a 3'-end cap as described in the present disclosure. Without wishing to be bound by any particular theory, Applicant proposes that, in some embodiments, a 3'-end cap can allow both of two functions: (1) allowing RNA interference; and (2) increasing duration of activity and/or biological half-life, which may be accomplished, for example, by increased binding to the PAZ domain of Dicer and/or one or more Ago proteins and/or reducing or preventing degradation of the RNAi agent (e.g., by nucleases such as those in the serum or intestinal fluid). In some embodiments, a RNAi agent of the present disclosure targets (e.g., binds to, anneals to, etc.) a target mRNA. In some embodiments, exposure of a RNAi agent to its target results in a decrease of activity, level and/or expression, e.g., a "knock-down" or "knock-out" of the target. Particularly, in some embodiments, in the case of a disease, disorder and/or condition characterized by over-expression and/or hyper-activity of a target gene, administration of a RNAi agent to a cell, tissue, or subject knocks down the target gene enough to restore a normal level of activity, or to reduce activity to a level that can alleviate, ameliorate, relieve, inhibit, prevent, delay onset of, reduce severity of, and/or reduce incidence of one or more symptoms or features of a disease, disorder, and/or condition of the disease, disorder, and/or condition. In some embodiments, a RNAi agent is double-stranded comprising an antisense strand which is a single-stranded RNAi agent as described herein, which, in combination with a sense strand, can direct RNA interference.

Sample: A "sample" as used herein is a specific organism or material obtained therefrom. In some embodiments, a sample is a biological sample obtained or derived from a source of interest, as described herein. In some embodiments, a source of interest comprises an organism, such as an animal or human. In some embodiments, a biological sample comprises biological tissue or fluid. In some embodiments, a biological sample is or comprises bone marrow; blood; blood cells; ascites; tissue or fine needle biopsy samples; cell-containing body fluids; free floating nucleic acids; sputum; saliva; urine; cerebrospinal fluid, peritoneal fluid; pleural fluid; feces; lymph; gynecological fluids; skin swabs; vaginal swabs; oral swabs; nasal swabs; washings or lavages such as a ductal lavages or broncheoalveolar lavages; aspirates; scrapings; bone marrow specimens; tissue biopsy specimens; surgical specimens; feces, other body fluids, secretions and/or excretions; and/or cells therefrom, etc. In some embodiments, a biological sample is or comprises cells obtained from an individual. In some embodiments, a sample is a "primary sample" obtained directly from a source of interest by any appropriate means. For example, in some embodiments, a primary biological sample is obtained by methods selected from the group consisting of biopsy (e.g., fine needle aspiration or tissue biopsy), surgery, collection of body fluid (e.g., blood, lymph, feces etc.), etc. In some embodiments, as will be clear from context, the term "sample" refers to a preparation that is obtained by processing (e.g., by removing one or more components of and/or by adding one or more agents to) a primary sample. For example, filtering using a semi-permeable membrane. Such a "processed sample" may comprise, for example nucleic acids or proteins extracted from a sample or obtained by subjecting a primary sample to techniques such as amplification or reverse transcription of mRNA, isolation and/or purification of certain components, etc. In some embodiments, a sample is an organism. In some embodiments, a sample is a plant. In some embodiments, a sample is an animal. In some embodiments, a sample is a human. In some embodiments, a sample is an organism other than a human.

Single-stranded RNA interference: As used herein, the phrases "single-stranded RNAi" or "single-stranded RNA interference" or the like refer to a process or method of gene silencing directed at least in part by administration of a single-stranded RNAi agent to a system (e.g., cells, tissues, organs, subjects, etc.) where RNAi is to be directed by the agent, and which requires the RISC pathway. The terms may be utilized herein in certain instances to distinguish from "double-stranded RNAi" or "double-stranded RNA interference", in which a double-stranded RNAi agent is administered to a system, and may be further processed, for example so that one of its two strands is loaded to RISC to, e.g., suppress translation, cleave target RNA, etc.

Single-stranded RNAi agent: As used herein, the phrase "single-stranded RNAi agent" refers to a single-stranded oligonucleotide that can direct single-stranded RNA interference (RNAi or iRNA) or gene silencing via the RISC pathway. A single-stranded RNAi agent can comprise a polymer of one or more single-stranded nucleotides.

Subject: As used herein, the term "subject" or "test subject" refers to any organism to which a provided compound or composition is administered in accordance with the present disclosure e.g., for experimental, diagnostic, prophylactic and/or therapeutic purposes. Typical subjects include animals (e.g., mammals such as mice, rats, rabbits, non-human primates, and humans; insects; worms; etc.) and plants. In some embodiments, a subject may be suffering from and/or susceptible to a disease, disorder and/or condition.

Substantially: As used herein, the term "substantially" refers to the qualitative condition of exhibiting total or near-total extent or degree of a characteristic or property of interest. A base sequence which is substantially complementary to a second sequence is not identical to the second sequence, but is mostly or nearly identical to the second sequence. In addition, one of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and/or chemical phenomena.

Suffering from: An individual who is "suffering from" a disease, disorder and/or condition has been diagnosed with and/or displays one or more symptoms of a disease, disorder and/or condition.

Susceptible to: An individual who is "susceptible to" a disease, disorder and/or condition is one who has a higher risk of developing the disease, disorder and/or condition than does a member of the general public. In some embodiments, an individual who is susceptible to a disease, disorder and/or condition may not have been diagnosed with the disease, disorder and/or condition. In some embodiments, an individual who is susceptible to a disease, disorder and/or condition may exhibit symptoms of the disease, disorder and/or condition. In some embodiments, an individual who is susceptible to a disease, disorder and/or condition may not exhibit symptoms of the disease, disorder and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Systemic: The phrases "systemic administration," "administered systemically," "peripheral administration," and "administered peripherally" as used herein have their art-understood meaning referring to administration of a compound or composition such that it enters the recipient's system.

Tautomeric forms: The phrase "tautomeric forms," as used herein, is used to describe different isomeric forms of organic compounds that are capable of facile interconversion. Tautomers may be characterized by the formal migration of a hydrogen atom or proton, accompanied by a switch of a single bond and adjacent double bond. In some embodiments, tautomers may result from prototropic tautomerism (i.e., the relocation of a proton). In some embodiments, tautomers may result from valence tautomerism (i.e., the rapid reorganization of bonding electrons). All such tautomeric forms are intended to be included within the scope of the present disclosure. In some embodiments, tautomeric forms of a compound exist in mobile equilibrium with each other, so that attempts to prepare the separate substances results in the formation of a mixture. In some embodiments, tautomeric forms of a compound are separable and isolatable compounds. In some embodiments of the disclosure, chemical compositions may be provided that are or include pure preparations of a single tautomeric form of a compound. In some embodiments of the disclosure, chemical compositions may be provided as mixtures of two or more tautomeric forms of a compound. In certain embodiments, such mixtures contain equal amounts of different tautomeric forms; in certain embodiments, such mixtures contain different amounts of at least two different tautomeric forms of a compound. In some embodiments of the disclosure, chemical compositions may contain all tautomeric forms of a compound. In some embodiments of the disclosure, chemical compositions may contain less than all tautomeric forms of a compound. In some embodiments of the disclosure, chemical compositions may contain one or more tautomeric forms of a compound in amounts that vary over time as a result of interconversion. In some embodiments of the disclosure, the tautomerism is keto-enol tautomerism. One of skill in the chemical arts would recognize that a keto-enol tautomer can be "trapped" (i.e., chemically modified such that it remains in the "enol" form) using any suitable reagent known in the chemical arts in to provide an enol derivative that may subsequently be isolated using one or more suitable techniques known in the art. Unless otherwise indicated, the present disclosure encompasses all tautomeric forms of relevant compounds, whether in pure form or in admixture with one another.

Therapeutic agent: As used herein, the phrase "therapeutic agent" refers to any agent that, when administered to a subject, has a therapeutic effect and/or elicits a desired biological and/or pharmacological effect. In some embodiments, a therapeutic agent is any substance that can be used to alleviate, ameliorate, relieve, inhibit, prevent, delay onset of, reduce severity of, and/or reduce incidence of one or more symptoms or features of a disease, disorder, and/or condition.

Therapeutically effective amount: As used herein, the term "therapeutically effective amount" means an amount of a substance (e.g., a therapeutic agent, composition, and/or formulation) that elicits a desired biological response when administered as part of a therapeutic regimen. In some embodiments, a therapeutically effective amount of a substance is an amount that is sufficient, when administered to a subject suffering from or susceptible to a disease, disorder, and/or condition, to treat, diagnose, prevent, and/or delay the onset of the disease, disorder, and/or condition. As will be appreciated by those of ordinary skill in this art, the effective amount of a substance may vary depending on such factors as the desired biological endpoint, the substance to be delivered, the target cell or tissue, etc. For example, the effective amount of compound in a formulation to treat a disease, disorder, and/or condition is the amount that alleviates, ameliorates, relieves, inhibits, prevents, delays onset of, reduces severity of and/or reduces incidence of one or more symptoms or features of the disease, disorder, and/or condition. In some embodiments, a therapeutically effective amount is administered in a single dose; in some embodiments, multiple unit doses are required to deliver a therapeutically effective amount.

Treat: As used herein, the term "treat," "treatment," or "treating" refers to any method used to partially or completely alleviate, ameliorate, relieve, inhibit, prevent, delay onset of, reduce severity of, and/or reduce incidence of one or more symptoms or features of a disease, disorder, and/or condition. Treatment may be administered to a subject who does not exhibit signs of a disease, disorder, and/or condition. In some embodiments, treatment may be administered to a subject who exhibits only early signs of the disease, disorder, and/or condition, for example for the purpose of decreasing the risk of developing pathology associated with the disease, disorder, and/or condition.

Unsaturated: The term "unsaturated," as used herein, means that a moiety has one or more units of unsaturation.

Unit dose: The expression "unit dose" as used herein refers to an amount administered as a single dose and/or in a physically discrete unit of a pharmaceutical composition. In many embodiments, a unit dose contains a predetermined quantity of an active agent. In some embodiments, a unit dose contains an entire single dose of the agent. In some embodiments, more than one unit dose is administered to achieve a total single dose. In some embodiments, administration of multiple unit doses is required, or expected to be required, in order to achieve an intended effect. A unit dose may be, for example, a volume of liquid (e.g., an acceptable carrier) containing a predetermined quantity of one or more therapeutic agents, a predetermined amount of one or more therapeutic agents in solid form, a sustained release formulation or drug delivery device containing a predetermined amount of one or more therapeutic agents, etc. It will be appreciated that a unit dose may be present in a formulation that includes any of a variety of components in addition to the therapeutic agent(s). For example, acceptable carriers (e.g., pharmaceutically acceptable carriers), diluents, stabilizers, buffers, preservatives, etc., may be included as described infra. It will be appreciated by those skilled in the art, in many embodiments, a total appropriate daily dosage of a particular therapeutic agent may comprise a portion, or a plurality, of unit doses, and may be decided, for example, by the attending physician within the scope of sound medical judgment. In some embodiments, the specific effective dose level for any particular subject or organism may depend upon a variety of factors including the disorder being treated and the severity of the disorder; activity of specific active compound employed; specific composition employed; age, body weight, general health, sex and diet of the subject; time of administration, and rate of excretion of the specific active compound employed; duration of the treatment; drugs and/or additional therapies used in combination or coincidental with specific compound(s) employed, and like factors well known in the medical arts.

Wild-type: As used herein, the term "wild-type" has its art-understood meaning that refers to an entity having a structure and/or activity as found in nature in a "normal" (as contrasted with mutant, diseased, altered, etc) state or context. Those of ordinary skill in the art will appreciate that wild type genes and polypeptides often exist in multiple different forms (e.g., alleles).

Nucleic acid: The term "nucleic acid", as used herein, includes any nucleotides and polymers thereof. The term "polynucleotide", as used herein, refers to a polymeric form of nucleotides of any length, either ribonucleotides (RNA) or deoxyribonucleotides (DNA). These terms refer to the primary structure of the molecules and, thus, include double- and single-stranded DNA, and double- and single-stranded RNA. These terms include, as equivalents, analogs of either RNA or DNA made from modified nucleotides and/or modified polynucleotides, such as, though not limited to, methylated, protected and/or capped nucleotides or polynucleotides. The terms encompass poly- or oligo-ribonucleotides (RNA) and poly- or oligo-deoxyribonucleotides (DNA); RNA or DNA derived from N-glycosides or C-glycosides of nucleobases and/or modified nucleobases; nucleic acids derived from sugars and/or modified sugars; and nucleic acids derived from phosphate bridges and/or modified internucleotide linkages. The term encompasses nucleic acids containing any combinations of nucleobases, modified nucleobases, sugars, modified sugars, phosphate bridges or modified internucleotidic linkages. Examples include, and are not limited to, nucleic acids containing ribose moieties, nucleic acids containing deoxy-ribose moieties, nucleic acids containing both ribose and deoxyribose moieties, nucleic acids containing ribose and modified ribose moieties. Unless otherwise specified, the prefix poly- refers to a nucleic acid containing 2 to about 10,000 nucleotide monomer units and wherein the prefix oligo- refers to a nucleic acid containing 2 to about 200 nucleotide monomer units.

Nucleotide: The term "nucleotide" as used herein refers to a monomeric unit of a polynucleotide that consists of a heterocyclic base, a sugar, and one or more internucleotidic linkages. The naturally occurring bases (guanine, (G), adenine, (A), cytosine, (C), thymine, (T), and uracil (U)) are derivatives of purine or pyrimidine, though it should be understood that naturally and non-naturally occurring base analogs are also included. The naturally occurring sugar is the pentose (five-carbon sugar) deoxyribose (which forms DNA) or ribose (which forms RNA), though it should be understood that naturally and non-naturally occurring sugar analogs are also included. Nucleotides are linked via internucleotidic linkages to form nucleic acids, or polynucleotides. Many internucleotidic linkages are known in the art (such as, though not limited to, phosphate, phosphorothioates, boranophosphates and the like). Artificial nucleic acids include PNAs (peptide nucleic acids), phosphotriesters, phosphorothionates, H-phosphonates, phosphoramidates, boranophosphates, methylphosphonates, phosphonoacetates, thiophosphonoacetates and other variants of the phosphate backbone of native nucleic acids, such as those described herein. In some embodiments, a natural nucleotide comprises a naturally occurring base, sugar and internucleotidic linkage. As used herein, the term "nucleotide" also encompasses structural analogs used in lieu of natural or naturally-occurring nucleotides, such as modified nucleotides and nucleotide analogs.

Modified nucleotide: The term "modified nucleotide" includes any chemical moiety which differs structurally from a natural nucleotide but is capable of performing at least one function of a natural nucleotide. In some embodiments, a modified nucleotide comprises a modification at a sugar, base and/or internucleotidic linkage. In some embodiments, a modified nucleotide comprises a modified sugar, modified nucleobase and/or modified internucleotidic linkage. In some embodiments, a modified nucleotide is capable of at least one function of a nucleotide, e.g., forming a subunit in a polymer capable of base-pairing to a nucleic acid comprising an at least complementary sequence of bases.

Analog: The term "analog" includes any chemical moiety which differs structurally from a reference chemical moiety or class of moieties, but which is capable of performing at least one function of such a reference chemical moiety or class of moieties. As non-limiting examples, a nucleotide analog differs structurally from a nucleotide but performs at least one function of a nucleotide; a nucleobase analog differs structurally from a nucleobase but performs at least one function of a nucleobase; etc.

Nucleoside: The term "nucleoside" refers to a moiety wherein a nucleobase or a modified nucleobase is covalently bound to a sugar or modified sugar.

Modified nucleoside: The term "modified nucleoside" refers to a moiety derived from or chemically similar to a natural nucleoside, but which comprises a chemical modification which differentiates it from a natural nucleoside. Non-limiting examples of modified nucleosides include those which comprise a modification at the base and/or the sugar. Non-limiting examples of modified nucleosides include those with a 2' modification at a sugar. Non-limiting examples of modified nucleosides also include abasic nucleosides (which lack a nucleobase). In some embodiments, a modified nucleoside is capable of at least one function of a nucleoside, e.g., forming a moiety in a polymer capable of base-pairing to a nucleic acid comprising an at least complementary sequence of bases.

Nucleoside analog: The term "nucleoside analog" refers to a chemical moiety which is chemically distinct from a natural nucleoside, but which is capable of performing at least one function of a nucleoside. In some embodiments, a nucleoside analog comprises an analog of a sugar and/or an analog of a nucleobase. In some embodiments, a modified nucleoside is capable of at least one function of a nucleoside, e.g., forming a moiety in a polymer capable of base-pairing to a nucleic acid comprising a complementary sequence of bases.

Sugar: The term "sugar" refers to a monosaccharide or polysaccharide in closed and/or open form. In some embodiments, sugars are monosaccharides. In some embodiments, sugars are polysaccharides. Sugars include, but are not limited to, ribose, deoxyribose, pentofuranose, pentopyranose, and hexopyranose moieties. As used herein, the term "sugar" also encompasses structural analogs used in lieu of conventional sugar molecules, such as glycol, polymer of which forms the backbone of the nucleic acid analog, glycol nucleic acid ("GNA"), etc. As used herein, the term "sugar" also encompasses structural analogs used in lieu of natural or naturally-occurring nucleotides, such as modified sugars and nucleotide sugars.

Modified sugar: The term "modified sugar" refers to a moiety that can replace a sugar. A modified sugar mimics the spatial arrangement, electronic properties, or some other physicochemical property of a sugar.

Nucleobase: The term "nucleobase" refers to the parts of nucleic acids that are involved in the hydrogen-bonding that binds one nucleic acid strand to another complementary strand in a sequence specific manner. The most common naturally-occurring nucleobases are adenine (A), guanine (G), uracil (U), cytosine (C), and thymine (T). In some embodiments, the naturally-occurring nucleobases are modified adenine, guanine, uracil, cytosine, or thymine. In some embodiments, the naturally-occurring nucleobases are methylated adenine, guanine, uracil, cytosine, or thymine. In some embodiments, a nucleobase is a "modified nucleobase," e.g., a nucleobase other than adenine (A), guanine (G), uracil (U), cytosine (C), and thymine (T). In some embodiments, the modified nucleobases are methylated adenine, guanine, uracil, cytosine, or thymine. In some embodiments, the modified nucleobase mimics the spatial arrangement, electronic properties, or some other physicochemical property of the nucleobase and retains the property of hydrogen-bonding that binds one nucleic acid strand to another in a sequence specific manner. In some embodiments, a modified nucleobase can pair with all of the five naturally occurring bases (uracil, thymine, adenine, cytosine, or guanine) without substantially affecting the melting behavior, recognition by intracellular enzymes or activity of the oligonucleotide duplex. As used herein, the term "nucleobase" also encompasses structural analogs used in lieu of natural or naturally-occurring nucleotides, such as modified nucleobases and nucleobase analogs.

Modified nucleobase: The terms "modified nucleobase", "modified base" and the like refer to a chemical moiety which is chemically distinct from a nucleobase, but which is capable of performing at least one function of a nucleobase. In some embodiments, a modified nucleobase is a nucleobase which comprises a modification. In some embodiments, a modified nucleobase is capable of at least one function of a nucleobase, e.g., forming a moiety in a polymer capable of base-pairing to a nucleic acid comprising an at least complementary sequence of bases.

3'-end cap: The term "3'-end cap" refers to a non-nucleotidic chemical moiety bound to the 3'-end of an oligonucleotide, e.g., a RNAi agent. In some embodiments, a 3'-end cap replaces a 3'-terminal dinucleotide. In some embodiments, a 3'-end cap of an oligonucleotide performs at least one of the following functions: allowing RNA interference directed by the oligonucleotide, protecting the oligonucleotide from degradation or reducing the amount or rate of degradation of the oligonucleotide (e.g., by nucleases), reducing the off-target effects of a sense strand, or increasing the activity, duration or efficacy of RNA interference directed by the oligonucleotide. By describing a 3'-end cap as "non-nucleotidic", it is meant that a 3'-end cap is not a nucleotidic moiety, or oligonucleotide moiety, connected to a sugar moiety of the rest of an oligonucleotide as it would do if it is part of an oligonucleotide chain. Certain example 3'-end caps are described herein. A person having ordinary skill understands that others 3'-end caps known in the art can be utilized in accordance in the present disclosure.

Blocking group: The term "blocking group" refers to a group that masks the reactivity of a functional group. The functional group can be subsequently unmasked by removal of the blocking group. In some embodiments, a blocking group is a protecting group.

Moiety: The term "moiety" refers to a specific segment or functional group of a molecule. Chemical moieties are often recognized chemical entities embedded in or appended to a molecule.

Solid support: The term "solid support" refers to any support which enables synthesis of nucleic acids. In some embodiments, the term refers to a glass or a polymer, that is insoluble in the media employed in the reaction steps performed to synthesize nucleic acids, and is derivatized to comprise reactive groups. In some embodiments, the solid support is Highly Cross-linked Polystyrene (HCP) or Controlled Pore Glass (CPG). In some embodiments, the solid support is Controlled Pore Glass (CPG). In some embodiments, the solid support is hybrid support of Controlled Pore Glass (CPG) and Highly Cross-linked Polystyrene (HCP).

Linker or Linking moiety: The terms "linker", "linking moiety" and the like refer to any chemical moiety which connects one chemical moiety to another. In some embodiments, a linker is a moiety which connects one oligonucleotide to another oligonucleotide in a multimer. In some embodiments, a linker is a moiety optionally positioned between the terminal nucleoside and the solid support or between the terminal nucleoside and another nucleoside, nucleotide, or nucleic acid.

Gene: The terms "gene," "recombinant gene" and "gene construct" as used herein, refer to a DNA molecule, or portion of a DNA molecule, that encodes a protein or a portion thereof. The DNA molecule can contain an open reading frame encoding the protein (as exon sequences) and can further include intron sequences. The term "intron" as used herein, refers to a DNA sequence present in a given gene which is not translated into protein and is found in some, but not all cases, between exons. It can be desirable for the gene to be operably linked to, (or it can comprise), one or more promoters, enhancers, repressors and/or other regulatory sequences to modulate the activity or expression of the gene, as is well known in the art.

Complementary DNA: As used herein, a "complementary DNA" or "cDNA" includes recombinant polynucleotides synthesized by reverse transcription of mRNA and from which intervening sequences (introns) have been removed.

Homology: "Homology" or "identity" or "similarity" refers to sequence similarity between two nucleic acid molecules. Homology and identity can each be determined by comparing a position in each sequence which can be aligned for purposes of comparison. When an equivalent position in the compared sequences is occupied by the same base, then the molecules are identical at that position; when the equivalent site occupied by the same or a similar nucleic acid residue (e.g., similar in steric and/or electronic nature), then the molecules can be referred to as homologous (similar) at that position. Expression as a percentage of homology/similarity or identity refers to a function of the number of identical or similar nucleic acids at positions shared by the compared sequences. A sequence which is "unrelated" or "non-homologous" shares less than 40% identity, less than 35% identity, less than 30% identity, or less than 25% identity with a sequence described herein. In comparing two sequences, the absence of residues (amino acids or nucleic acids) or presence of extra residues also decreases the identity and homology/similarity.

In some embodiments, the term "homology" describes a mathematically based comparison of sequence similarities which is used to identify genes with similar functions or motifs. The nucleic acid sequences described herein can be used as a "query sequence" to perform a search against public databases, for example, to identify other family members, related sequences or homologs. In some embodiments, such searches can be performed using the NBLAST and)(BLAST programs (version 2.0) of Altschul, et al. (1990) J. Mol. Biol. 215:403-10. In some embodiments, BLAST nucleotide searches can be performed with the NBLAST program, score=100, wordlength=12 to obtain nucleotide sequences homologous to nucleic acid molecules of the disclosure. In some embodiments, to obtain gapped alignments for comparison purposes, Gapped BLAST can be utilized as described in Altschul et al., (1997) Nucleic Acids Res. 25(17):3389-3402. When utilizing BLAST and Gapped BLAST programs, the default parameters of the respective programs (e.g.,)(BLAST and BLAST) can be used (See www.ncbi.nlm.nih.gov).

Identity: As used herein, "identity" means the percentage of identical nucleotide residues at corresponding positions in two or more sequences when the sequences are aligned to maximize sequence matching, i.e., taking into account gaps and insertions. Identity can be readily calculated by known methods, including but not limited to those described in (Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991; and Carillo, H., and Lipman, D., SIAM J. Applied Math., 48: 1073 (1988). Methods to determine identity are designed to give the largest match between the sequences tested. Moreover, methods to determine identity are codified in publicly available computer programs. Computer program methods to determine identity between two sequences include, but are not limited to, the GCG program package (Devereux, J., et al., Nucleic Acids Research 12(1): 387 (1984)), BLASTP, BLASTN, and FASTA (Altschul, S. F. et al., J. Molec. Biol. 215: 403-410 (1990) and Altschul et al. Nuc. Acids Res. 25: 3389-3402 (1997)). The BLAST X program is publicly available from NCBI and other sources (BLAST Manual, Altschul, S., et al., NCBI NLM NIH Bethesda, Md. 20894; Altschul, S., et al., J. Mol. Biol. 215: 403-410 (1990). The well-known Smith Waterman algorithm can also be used to determine identity.

Oligonucleotide: The term "oligonucleotide" refers to a polymer or oligomer of nucleotides, and may contain any combination of natural and non-natural nucleobases, sugars, and internucleotidic linkages.

Oligonucleotides can be single-stranded or double-stranded. As used herein, the term "oligonucleotide strand" encompasses a single-stranded oligonucleotide. A single-stranded oligonucleotide can have double-stranded regions (formed by two portions of the single-stranded oligonucleotide) and a double-stranded oligonucleotide, which comprises two oligonucleotide chains, can have single-stranded regions for example, at regions where the two oligonucleotide chains are not complementary to each other. In some embodiments, oligonucleotides are capable of directing a decrease in the expression and/or level of a target gene or its gene product. In some embodiments, oligonucleotides are capable of directing a decrease in the expression and/or level of a target gene or its gene product via RNA interference. In some embodiments, oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, oligonucleotides are capable of directing a decrease in the expression and/or level of a target gene or its gene product via RNA interference and/or RNase H-mediated knockdown. Example oligonucleotides include, but are not limited to structural genes, genes including control and termination regions, self-replicating systems such as viral or plasmid DNA, single-stranded and double-stranded RNAi agents and other RNA interference reagents (RNAi agents or iRNA agents), shRNA, antisense oligonucleotides, ribozymes, microRNAs, microRNA mimics, supermirs, aptamers, antimirs, antagomirs, U1 adaptors, triplex-forming oligonucleotides, G-quadruplex oligonucleotides, RNA activators, immuno-stimulatory oligonucleotides, and decoy oligonucleotides.

Double-stranded and single-stranded oligonucleotides that are effective in inducing RNA interference are also referred to as a RNAi agent or iRNA agent, herein. In some embodiments, these RNA interference inducing oligonucleotides associate with a cytoplasmic multi-protein complex known as RNAi-induced silencing complex (RISC). In many embodiments, double-stranded RNAi agents are sufficiently long that they can be cleaved by an endogenous molecule, e.g., by Dicer, to produce smaller oligonucleotides that can enter the RISC machinery and participate in RISC mediated cleavage and/or translation suppression of a target sequence, e.g. a target mRNA sequence.

Oligonucleotides of the present disclosure can be of various lengths. In particular embodiments, oligonucleotides can range from about 2 to about 200 nucleotides in length. In various related embodiments, oligonucleotides, single-stranded, double-stranded, and triple-stranded, can range in length from about 4 to about 10 nucleotides, from about 10 to about 50 nucleotides, from about 20 to about 50 nucleotides, from about 15 to about 30 nucleotides, or from about 20 to about 30 nucleotides in length. In some embodiments, an oligonucleotide is from about 10 to about 40 nucleotides in length. In some embodiments, an oligonucleotide is from about 9 to about 39 nucleotides in length. In some embodiments, the oligonucleotide is at least 4 nucleotides in length. In some embodiments, the oligonucleotide is at least 5 nucleotides in length. In some embodiments, the oligonucleotide is at least 6 nucleotides in length. In some embodiments, the oligonucleotide is at least 7 nucleotides in length. In some embodiments, the oligonucleotide is at least 8 nucleotides in length. In some embodiments, the oligonucleotide is at least 9 nucleotides in length. In some embodiments, the oligonucleotide is at least 10 nucleotides in length. In some embodiments, the oligonucleotide is at least 11 nucleotides in length. In some embodiments, the oligonucleotide is at least 12 nucleotides in length. In some embodiments, the oligonucleotide is at least 15 nucleotides in length. In some embodiments, the oligonucleotide is at least 20 nucleotides in length. In some embodiments, the oligonucleotide is at least 25 nucleotides in length. In some embodiments, the oligonucleotide is at least 30 nucleotides in length. In some embodiments, the oligonucleotide is a duplex of complementary strands of at least 18 nucleotides in length. In some embodiments, the oligonucleotide is a duplex of complementary strands of at least 21 nucleotides in length. In some embodiments, each nucleotide counted in a length independently comprises an optionally substituted nucleobase selected from adenine, cytosine, guanosine, thymine, and uracil.

Internucleotidic linkage: As used herein, the phrase "internucleotidic linkage" refers generally to a linkage linking nucleoside units of an oligonucleotide or a nucleic acid. In some embodiments, an internucleotidic linkage is a phosphodiester linkage, as found in naturally occurring DNA and RNA molecules (natural phosphate linkage). In some embodiments, the term "internucleotidic linkage" includes a modified internucleotidic linkage. In some embodiments, an internucleotidic linkage is a "modified internucleotidic linkage" wherein each oxygen atom of the phosphodiester linkage is optionally and independently replaced by an organic or inorganic moiety. In some embodiments, such an organic or inorganic moiety is selected from but not limited to =S, =Se, =NR', —SR', —SeR', —N(R')$_2$, B(R')$_3$, —S—, —Se—, and —N(R')—, wherein each R' is independently as defined and described in the present disclosure. In some embodiments, an internucleotidic linkage is a phosphotriester linkage, phosphorothioate diester linkage

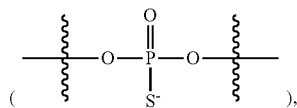

or modified phosphorothioate triester linkage.

In some embodiments, an internucleotidic linkage is one of, e.g., PNA (peptide nucleic acid) or PMO (phosphorodiamidate Morpholino oligomer) linkage.

It is understood by a person of ordinary skill in the art that an internucleotidic linkage may exist as an anion or cation at a given pH due to the existence of acid or base moieties in the linkage.

Unless otherwise specified, when used with an oligonucleotide sequence, each of s, s1, s2, s3, s4, s5, s6 and s7 independently represents the following modified internucleotidic linkage as illustrated below:

| Symbol | Modified Internucleotidic Linkage |
|---|---|
| s | ![phosphorothioate structure] | phosphorothioate

-continued
| Symbol | Modified Internucleotidic Linkage |
|---|---|
| s1 | 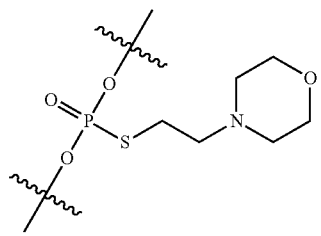 |
| s2 | 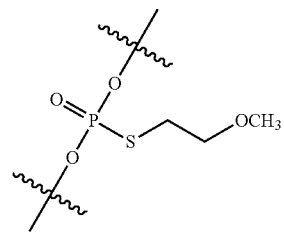 |
| s3 |  |
| s4 | 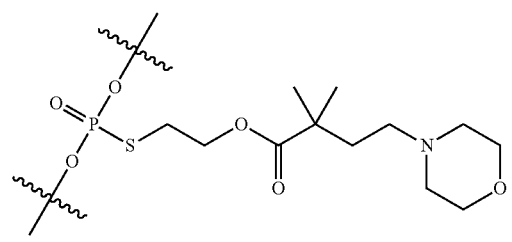 |
| s5 | 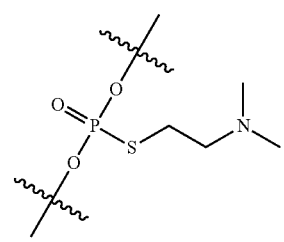 |
| s6 | 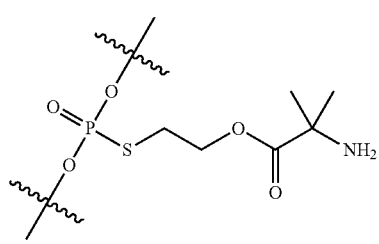 |
-continued
| Symbol | Modified Internucleotidic Linkage |
|---|---|
| s7 | 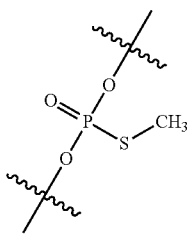 |
| s8 | 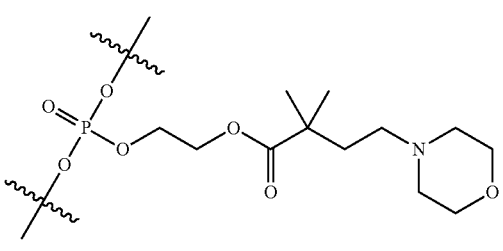 |
| s9 | 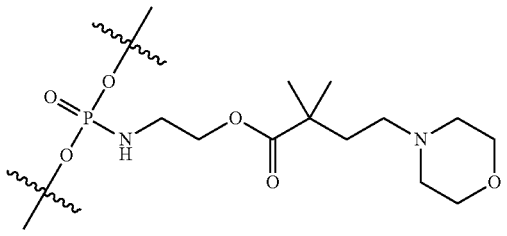 |
| s10 |  |
| s11 | 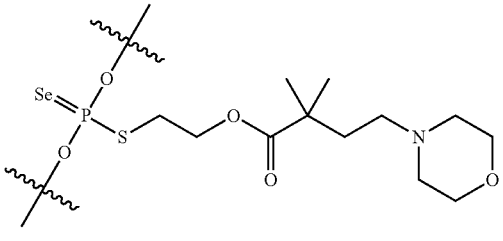 [SMILES: *OP(=O)(O*)OCCOC(=O)C(C)(C)CCN1CCOCC1] |
| s12 | 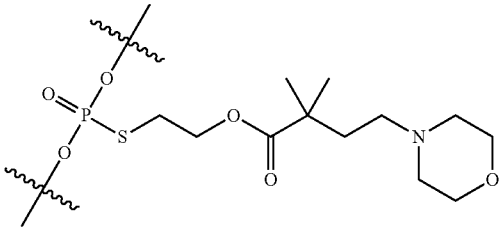 |

-continued

| Symbol | Modified Internucleotidic Linkage |
|---|---|
| s13 | 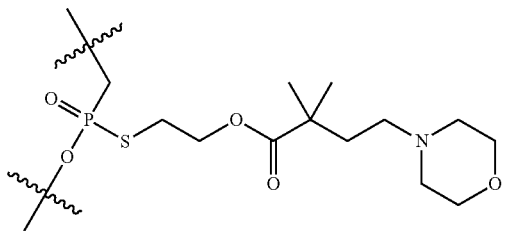 |
| s14 |  |
| s15 | 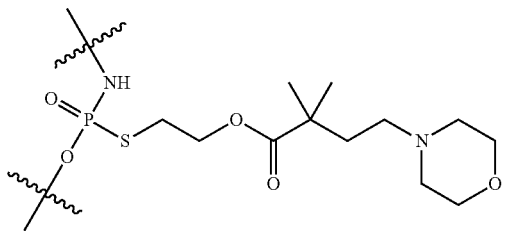 |
| s16 | 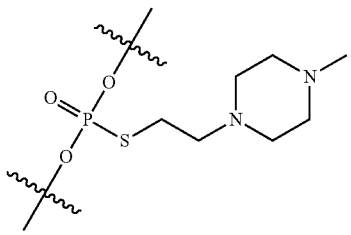 |
| s17 | 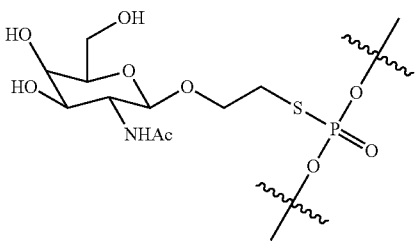 |
| s18 | 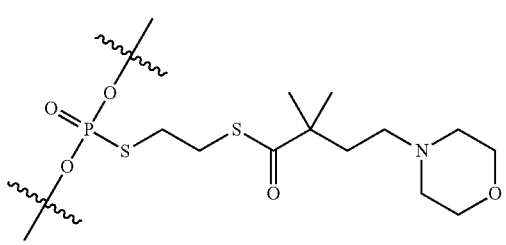 |

For instance, (Rp, Sp)-ATsCs1GA has 1) a phosphorothioate internucleotidic linkage

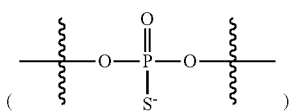

between T and C; and 2) a phosphorothioate triester internucleotidic linkage having the structure of

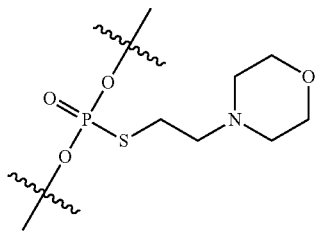

between C and G. Unless otherwise specified, the Rp/Sp designations preceding an oligonucleotide sequence describe the configurations of chiral linkage phosphorus atoms in the internucleotidic linkages sequentially from 5' to 3' of the oligonucleotide sequence. For instance, in (Rp, Sp)-ATsCs1GA, the phosphorus in the "s" linkage between T and C has Rp configuration and the phosphorus in "s1" linkage between C and G has Sp configuration.

In some embodiments, "All-(Rp)" or "All-(Sp)" is used to indicate that all chiral linkage phosphorus atoms in oligonucleotide have the same Rp or Sp configuration, respectively.

Oligonucleotide type: As used herein, the phrase "oligonucleotide type" is used to define an oligonucleotide that has a particular base sequence, pattern of backbone linkages (i.e., pattern of internucleotidic linkage types, for example, phosphate, phosphorothioate, etc.), pattern of backbone chiral centers (i.e. pattern of linkage phosphorus stereochemistry (Rp/Sp)), and pattern of backbone phosphorus modifications (e.g., pattern of "-XLR¹" groups in formula I). In some embodiments, oligonucleotides of a common designated "type" are structurally identical to one another.

One of skill in the art will appreciate that synthetic methods of the present disclosure provide for a degree of control during the synthesis of an oligonucleotide strand such that each nucleotide unit of the oligonucleotide strand can be designed and/or selected in advance to have a particular stereochemistry at the linkage phosphorus and/or a particular modification at the linkage phosphorus, and/or a particular base, and/or a particular sugar. In some embodiments, an oligonucleotide strand is designed and/or selected in advance to have a particular combination of stereocenters at the linkage phosphorus. In some embodiments, an oligonucleotide strand is designed and/or determined to have a particular combination of modifications at the linkage phosphorus. In some embodiments, an oligonucleotide strand is designed and/or selected to have a particular combination of bases. In some embodiments, an oligonucleotide strand is designed and/or selected to have a particular combination of one or more of the above structural characteristics. In some embodiments, the present disclosure provides compositions comprising or consisting of a plurality of oligonucleotide molecules (e.g., chirally controlled oligonucleotide compositions). In some embodiments, all such molecules are of the same type (i.e., are structurally identical to one another). In many embodiments, however, provided compositions comprise a plurality of oligonucleotides of different types, typically in pre-determined relative amounts.

Chiral control: As used herein, "chiral control" refers to control of the stereochemical designation of a chiral linkage phosphorus in a chiral internucleotidic linkage within an oligonucleotide. In some embodiments, a control is achieved through a chiral element that is absent from the sugar and base moieties of an oligonucleotide, for example, in some embodiments, a control is achieved through use of one or more chiral auxiliaries during oligonucleotide preparation as exemplified in the present disclosure, which chiral auxiliaries often are part of chiral phosphoramidites used during oligonucleotide preparation. In contrast to chiral control, a person having ordinary skill in the art appreciates that conventional oligonucleotide synthesis which does not use chiral auxiliaries cannot control stereochemistry at a chiral internucleotidic linkage if such conventional oligonucleotide synthesis is used to form the chiral internucleotidic linkage. In some embodiments, the stereochemical designation of each chiral linkage phosphorus in a chiral internucleotidic linkage within an oligonucleotide is controlled.

Chirally controlled oligonucleotide composition: The terms "chirally controlled oligonucleotide composition", "chirally controlled nucleic acid composition", and the like, as used herein, refers to a composition that comprises a plurality of oligonucleotides (or nucleic acids) which share 1) a common base sequence, 2) a common pattern of backbone linkages, and 3) a common pattern of backbone phosphorus modifications, wherein the plurality of oligonucleotides (or nucleic acids) share the same stereochemistry at one or more chiral internucleotidic linkages (chirally controlled internucleotidic linkages), and the level of the plurality of oligonucleotides (or nucleic acids) in the composition is pre-determined (e.g., through chirally controlled oligonucleotide preparation to form one or more chiral internucleotidic linkages). In some embodiments, about 1%-100%, (e.g., about 5%-100%, 10%-100%, 20%-100%, 30%-100%, 40%-100%, 50%-100%, 60%-100%, 70%-100%, 80%-100%, 90%-100%, 95%-100%, 50%-90%, or about 5%, 10%, 20%, 30%, 40%, 50%, 60%, 70%, 80%, 85%, 90%, 91%, 92%, 93%, 94%, 95%, 96%, 97%, 98%, or 99%, or at least 5%, 10%, 20%, 30%, 40%, 50%, 60%, 70%, 80%, 85%, 90%, 91%, 92%, 93%, 94%, 95%, 96%, 97%, 98%, or 99%) of all oligonucleotides in a chirally controlled oligonucleotide composition are oligonucleotides of the plurality. In some embodiments, about 1%-100%, (e.g., about 5%-100%, 10%-100%, 20%-100%, 30%-100%, 40%-100%, 50%-100%, 60%-100%, 70%-100%, 80%-100%, 90%-100%, 95%-100%, 50%-90%, or about 5%, 10%, 20%, 30%, 40%, 50%, 60%, 70%, 80%, 85%, 90%, 91%, 92%, 93%, 94%, 95%, 96%, 97%, 98%, or 99%, or at least 5%, 10%, 20%, 30%, 40%, 50%, 60%, 70%, 80%, 85%, 90%, 91%, 92%, 93%, 94%, 95%, 96%, 97%, 98%, or 99%) of all oligonucleotides in a chirally controlled oligonucleotide composition that share the common base sequence are oligonucleotides of the plurality. In some embodiments, about 1%-100%, (e.g., about 5%-100%, 10%-100%, 20%-100%, 30%-100%, 40%-100%, 50%-100%, 60%-100%, 70%-100%, 80%-100%, 90%-100%, 95%-100%, 50%-90%, or about 5%, 10%, 20%, 30%, 40%, 50%, 60%, 70%, 80%, 85%, 90%, 91%, 92%, 93%, 94%, 95%, 96%, 97%, 98%, or 99%, or at least 5%, 10%, 20%, 30%, 40%, 50%, 60%, 70%, 80%, 85%, 90%, 91%, 92%, 93%, 94%, 95%, 96%, 97%, 98%, or 99%) of all oligonucleotides in a chirally controlled oligonucleotide composition that share the common base sequence, the common pattern of backbone linkages, and the common pattern of backbone phosphorus modifications are oligonucleotides of the plurality. In some embodiments, a predetermined level is be about 1%-100%, (e.g., about 5%-100%, 10%-100%, 20%-100%, 30%-100%, 40%-100%, 50%-100%, 60%-100%, 70%-100%, 80%-100%, 90%-100%, 95%-100%, 50%-90%, or about 5%, 10%, 20%, 30%, 40%, 50%, 60%, 70%, 80%, 85%, 90%, 91%, 92%, 93%, 94%, 95%, 96%, 97%, 98%, or 99%, or at least 5%, 10%, 20%, 30%, 40%, 50%, 60%, 70%, 80%, 85%, 90%, 91%, 92%, 93%, 94%, 95%, 96%, 97%, 98%, or 99%) of all oligonucleotides in a composition, or of all oligonucleotides in a composition that share a common base sequence (e.g., of a plurality of oligonucleotide or an oligonucleotide type), or of all oligonucleotides in a composition that share a common base sequence, a common pattern of backbone linkages, and a common pattern of backbone phosphorus modifications are oligonucleotides of the plurality, or of all oligonucleotides in a composition that share a common base sequence, a common patter of base modifications, a common pattern of sugar modifications, a common pattern of internucleotidic linkage types, and/or a common pattern of internucleotidic linkage modifications. In some embodiments, the plurality of oligonucleotides share the same stereochemistry at about 1-50 (e.g., about 1-10, 1-20, 5-10, 5-20, 10-15, 10-20, 10-25, 10-30, or about 1, 2, 3, 4, 5, 6, 7, 8, 9, 10, 11, 12, 13, 14, 15, 16, 17, 18, 19, or 20, or at least 1, 2, 3, 4, 5, 6, 7, 8, 9, 10, 11, 12, 13, 14, 15, 16, 17, 18, 19, or 20) chiral internucleotidic linkages. In some embodiments, the plurality of oligonucleotides share the same stereochemistry at about 1%-100% (e.g., about 5%-100%, 10%-100%, 20%-100%, 30%-100%, 40%-100%, 50%-100%, 60%-100%, 70%-100%, 80%-100%, 90%-100%, 95%-100%, 50%-90%, about 5%, 10%, 15%, 20%, 25%, 30%, 35%, 40%, 45%, 50%, 55%, 60%, 65%, 70%, 75%, 80%, 85%, 90%, 95%, or 100%, or at least 5%, 10%, 15%, 20%, 25%, 30%, 35%, 40%, 45%, 50%, 55%, 60%, 65%, 70%, 75%, 80%, 85%, 90%, 95%, or 99%) of chiral internucleotidic linkages. In some embodiments, each chiral internucleotidic linkage is a chiral controlled internucleotidic linkage, and the composition is a completely chirally controlled oligonucleotide composition. In some embodiments, not all chiral internucleotidic linkages are chiral controlled internucleotidic linkages, and the composition is a partially chirally controlled oligonucleotide composition. In some embodiments, a chirally controlled oligonucleotide composition comprises predetermined levels of individual oligonucleotide or nucleic acids types. For instance, in some embodiments a chirally controlled oligonucleotide composition comprises one oligonucleotide type. In some embodiments, a chirally controlled oligonucleotide composition comprises more than one oligonucleotide type.

In some embodiments, a chirally controlled oligonucleotide composition comprises multiple oligonucleotide types. In some embodiments, a chirally controlled oligonucleotide composition is a composition of oligonucleotides of an oligonucleotide type, which composition comprises a pre-determined level of a plurality of oligonucleotides of the oligonucleotide type.

Chirally uniform: as used herein, the phrase "chirally uniform" is used to describe an oligonucleotide molecule or type in which all nucleotide units have the same stereochemistry at the linkage phosphorus. For instance, an oligonucleotide whose nucleotide units all have Rp stereochemistry at the linkage phosphorus is chirally uniform. Likewise, an oligonucleotide whose nucleotide units all have Sp stereochemistry at the linkage phosphorus is chirally uniform.

Predetermined: By predetermined (or pre-determined) is meant deliberately selected, for example as opposed to randomly occurring or achieved without control. Those of ordinary skill in the art, reading the present specification, will appreciate that the present disclosure provides technologies that permit selection of particular chemistry and/or stereochemistry features to be incorporated into oligonucleotide compositions, and further permits controlled preparation of oligonucleotide compositions having such chemistry and/or stereochemistry features. Such provided compositions are "predetermined" as described herein. Compositions that may contain certain oligonucleotides because they happen to have been generated through a process that are not controlled to intentionally generate the particular chemistry and/or stereochemistry features is not a "predetermined" composition. In some embodiments, a predetermined composition is one that can be intentionally reproduced (e.g., through repetition of a controlled process). In some embodiments, a predetermined level of a plurality of oligonucleotides in a composition means that the absolute amount, and/or the relative amount (ratio, percentage, etc.) of the plurality of oligonucleotides in the composition is controlled. In some embodiments, a predetermined level of a plurality of oligonucleotides in a composition is achieved through chirally controlled oligonucleotide preparation.

Linkage phosphorus: as defined herein, the phrase "linkage phosphorus" is used to indicate that the particular phosphorus atom being referred to is the phosphorus atom present in the internucleotidic linkage, which phosphorus atom corresponds to the phosphorus atom of a phosphodiester of an internucleotidic linkage as occurs in naturally occurring DNA and RNA. In some embodiments, a linkage phosphorus atom is in a modified internucleotidic linkage, wherein each oxygen atom of a phosphodiester linkage is optionally and independently replaced by an organic or inorganic moiety. In some embodiments, a linkage phosphorus atom is $P^L$ of Formula I. In some embodiments, a linkage phosphorus atom is chiral.

P-modification: as used herein, the term "P-modification" refers to any modification at the linkage phosphorus other than a stereochemical modification. In some embodiments, a P-modification comprises addition, substitution, or removal of a pendant moiety covalently attached to a linkage phosphorus. In some embodiments, the "P-modification" is —X-L-$R^1$ wherein each of X, L and $R^1$ is independently as defined and described in the present disclosure.

Blockmer: the term "blockmer," as used herein, refers to an oligonucleotide strand whose pattern of structural features characterizing each individual nucleotide unit is characterized by the presence of at least two consecutive nucleotide units sharing a common structural feature at the internucleotidic phosphorus linkage. By common structural feature is meant common stereochemistry at the linkage phosphorus or a common modification at the linkage phosphorus. In some embodiments, the at least two consecutive nucleotide units sharing a common structure feature at the internucleotidic phosphorus linkage are referred to as a "block". In some embodiments, a provided oligonucleotide is a blockmer.

In some embodiments, a blockmer is a "stereoblockmer," e.g., at least two consecutive nucleotide units have the same stereochemistry at the linkage phosphorus. Such at least two consecutive nucleotide units form a "stereoblock."

In some embodiments, a blockmer is a "P-modification blockmer," e.g., at least two consecutive nucleotide units have the same modification at the linkage phosphorus. Such at least two consecutive nucleotide units form a "P-modification block". For instance, (Rp, Sp)-ATsCsGA is a P-modification blockmer because at least two consecutive nucleotide units, the Ts and the Cs, have the same P-modification (i.e., both are a phosphorothioate diester). In the same oligonucleotide of (Rp, Sp)-ATsCsGA, TsCs forms a block, and it is a P-modification block.

In some embodiments, a blockmer is a "linkage blockmer," e.g., at least two consecutive nucleotide units have identical stereochemistry and identical modifications at the linkage phosphorus. At least two consecutive nucleotide units form a "linkage block". For instance, (Rp, Rp)-ATsCsGA is a linkage blockmer because at least two consecutive nucleotide units, the Ts and the Cs, have the same stereochemistry (both Rp) and P-modification (both phosphorothioate). In the same oligonucleotide of (Rp, Rp)-ATsCsGA, TsCs forms a block, and it is a linkage block.

In some embodiments, a blockmer comprises one or more blocks independently selected from a stereoblock, a P-modification block and a linkage block. In some embodiments, a blockmer is a stereoblockmer with respect to one block, and/or a P-modification blockmer with respect to another block, and/or a linkage blockmer with respect to yet another block.

Altmer: the term "altmer," as used herein, refers to an oligonucleotide strand whose pattern of structural features characterizing each individual nucleotide unit is characterized in that no two consecutive nucleotide units of the oligonucleotide strand share a particular structural feature at the internucleotidic phosphorus linkage. In some embodiments, an altmer is designed such that it comprises a repeating pattern. In some embodiments, an altmer is designed such that it does not comprise a repeating pattern. In some embodiments, a provided oligonucleotide is a altmer.

In some embodiments, an altmer is a "stereoaltmer," e.g., no two consecutive nucleotide units have the same stereochemistry at the linkage phosphorus.

In some embodiments, an altmer is a "P-modification altmer" e.g., no two consecutive nucleotide units have the same modification at the linkage phosphorus. For instance, All-(Sp)-CAs1GsT, in which each linkage phosphorus has a different P-modification than the others.

In some embodiments, an altmer is a "linkage altmer," e.g., no two consecutive nucleotide units have identical stereochemistry or identical modifications at the linkage phosphorus.

Unimer: the term "unimer," as used herein, refers to an oligonucleotide strand whose pattern of structural features characterizing each individual nucleotide unit is such that all nucleotide units within the strand share at least one common structural feature at the internucleotidic phosphorus linkage. By common structural feature is meant common stereochemistry at the linkage phosphorus or a common modification at the linkage phosphorus. In some embodiments, a provided oligonucleotide is a unimer.

In some embodiments, a unimer is a "stereounimer," e.g., all nucleotide units have the same stereochemistry at the linkage phosphorus.

In some embodiments, a unimer is a "P-modification unimer", e.g., all nucleotide units have the same modification at the linkage phosphorus.

In some embodiments, a unimer is a "linkage unimer," e.g., all nucleotide units have the same stereochemistry and the same modifications at the linkage phosphorus.

Gapmer: as used herein, the term "gapmer" refers to an oligonucleotide strand characterized in that at least one internucleotidic phosphorus linkage of the oligonucleotide strand is a phosphate diester linkage, for example such as those found in naturally occurring DNA or RNA. In some embodiments, more than one internucleotidic phosphorus linkage of the oligonucleotide strand is a phosphate diester linkage such as those found in naturally occurring DNA or RNA. In some embodiments, a provided oligonucleotide is a gapmer.

Skipmer: as used herein, the term "skipmer" refers to a type of gapmer in which every other internucleotidic phosphorus linkage of the oligonucleotide strand is a phosphate diester linkage, for example such as those found in naturally occurring DNA or RNA, and every other internucleotidic phosphorus linkage of the oligonucleotide strand is a modified internucleotidic linkage. In some embodiments, a provided oligonucleotide is a skipmer.

For purposes of this disclosure, the chemical elements are identified in accordance with the Periodic Table of the Elements, CAS version, Handbook of Chemistry and Physics, 67th Ed., 1986-87, inside cover.

The methods and structures described herein relating to compounds and compositions of the disclosure also apply to the pharmaceutically acceptable acid or base addition salts and all stereoisomeric forms of these compounds and compositions.

BRIEF DESCRIPTION OF THE DRAWINGS

FIG. 1, including FIG. 1A to 1L, presents cartoons of various ssRNAi formats and hybrid formats.

FIG. 2 presents cartoons of various antisense oligonucleotide formats.

FIG. 3A shows example multimer formats. Oligonucleotides can be joined directly and/or through linkers. As illustrated, a multimer can comprise oligonucleotide monomers of the same or different structures/types. In some embodiments, a monomer of a multimer is an ssRNAi agent. In some embodiments, a monomer of a multimer is a RNase H-dependent antisense oligonucleotide (ASO). Monomers can be joined through various positions, for example, the 5'-end, the 3'-end, or positions in between.

DETAILED DESCRIPTION OF CERTAIN EMBODIMENTS

Figure 1C:
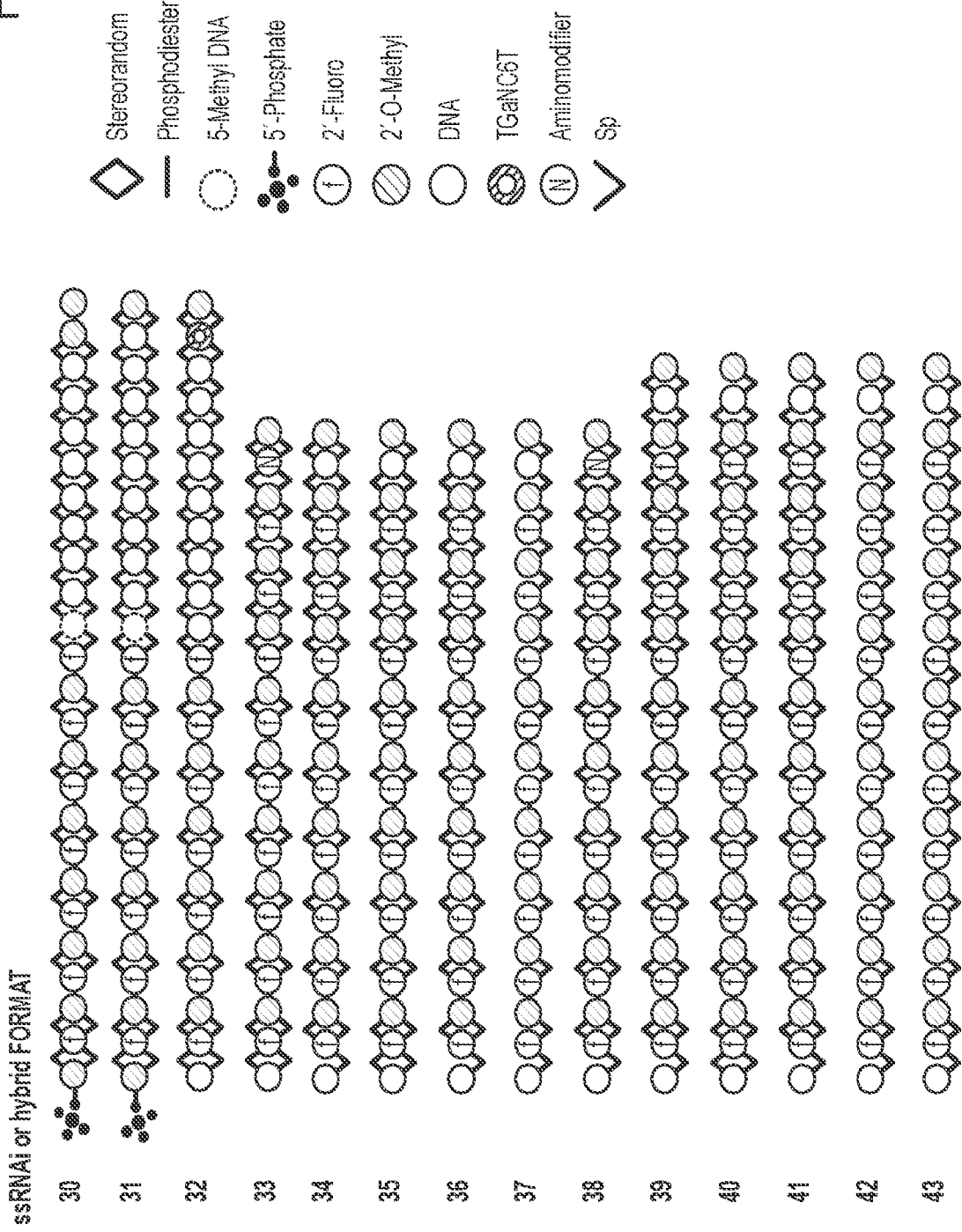

Synthetic oligonucleotides provide useful molecular tools in a wide variety of applications. For example, oligonucleotides are useful in therapeutic, diagnostic, research, and new nanomaterials applications. The use of naturally occurring nucleic acids (e.g., unmodified DNA or RNA) is limited, for example, by their susceptibility to endo- and exo-nucleases. As such, various synthetic counterparts have been developed to circumvent these shortcomings. These include synthetic oligonucleotides that contain chemical modifications, e.g., base modifications, sugar modifications, backbone modifications, etc., which, among other things, render these molecules less susceptible to degradation and improve other properties of oligonucleotides. From a structural point of view, modifications to internucleotide phosphate linkages can introduce chirality, and certain properties of oligonucleotides may be affected by configurations of phosphorus atoms that form the backbone of oligonucleotides. For example, in vitro studies have shown that properties of antisense oligonucleotides, such as binding affinity, sequence specific binding to complementary RNA, stability to nucleases, are affected by, inter alia, chirality of backbone phosphorus atoms.

Among other things, the present disclosure encompasses the recognition that structural elements of oligonucleotides, such as chemical modifications (e.g., modifications of sugar, base, and/or internucleotidic linkages) or patterns thereof, conjugation to lipids or other moieties, and/or stereochemistry [e.g., stereochemistry of backbone chiral centers (chiral internucleotidic linkages), and/or patterns thereof], can have significant impact on properties and activities (e.g., stability, specificity, selectivity, activities to reduce levels of products (transcripts and/or protein) of target genes, etc.). In some embodiments, oligonucleotide properties can be adjusted by optimizing chemical modifications (modifications of base, sugar, and/or internucleotidic linkage moieties), patterns of chemical modifications, stereochemistry and/or patterns of stereochemistry.

In some embodiments, the present disclosure demonstrates that oligonucleotide compositions comprising oligonucleotides with controlled structural elements, e.g., controlled chemical modifications and/or controlled backbone stereochemistry patterns, provide unexpected properties and activities, including but not limited to those described herein. In some embodiments, provided compositions comprising oligonucleotides having chemical modifications (e.g., base modifications, sugar modification, internucleotidic linkage modifications, etc.) or patterns thereof have improved properties and activities. Non-limiting examples of such improved properties include: directing a decrease in the expression and/or level of a target gene or its gene product; and/or directing RNA interference; and/or directing RNase H-mediated knockdown. In some embodiments, the present disclosure provides technologies (e.g., oligonucleotides, compositions, methods, etc.) for single-stranded RNAi. In some embodiments, a provided oligonucleotide is a ssRNAi agent.

In some embodiments, RNA interference is reportedly a post-transcriptional, targeted gene-silencing technique that uses an RNAi agent to target a RNA, e.g., a gene transcript such as a messenger RNA (mRNA), comprising a sequence complementary to the RNAi agent, for cleavage mediated by the RISC (RNA-induced silencing complex) pathway. In nature, a type of RNAi reportedly occurs when ribonuclease III (Dicer) cleaves a long dsRNA (double-stranded RNA) (e.g., a foreign dsRNA introduced into a mammalian cell) into shorter fragments called siRNAs. siRNAs (small interfering RNAs or short inhibitory RNAs) are typically about 21 to 23 nucleotides long and comprise about 19 base pair duplexes. The smaller RNA segments then reportedly mediate the degradation of the target mRNA. The RNAi response also reportedly features an endonuclease complex, commonly referred to as an RNA-induced silencing complex (RISC), which directs cleavage of single-stranded mRNA complementary to the antisense strand of the siRNA. Cleavage of the target RNA reportedly takes place in the middle of the region complementary to the antisense strand of the siRNA duplex. The use of the RNAi agent to a target transcript reportedly results in a decrease of gene activity, level and/or expression, e.g., a "knock-down" or "knock-out" of the target gene or target sequence. Artificial siRNAs are useful both as therapeutics and for experimental use.

In one aspect, an RNA interference agent includes a single stranded RNA that interacts with a target RNA sequence to direct the cleavage of the target RNA. Without wishing to be bound by theory, long double stranded RNA introduced into plants and invertebrate cells is reportedly broken down into siRNA by a Type III endonuclease known as Dicer (Sharp et al., Genes Dev. 2001, 15:485). Dicer, a ribonuclease-III-like enzyme, reportedly processes the dsRNA into 19-23 base pair short interfering RNAs with characteristic two base 3' overhangs (Bernstein, et al., (2001) Nature 409:363). The siRNAs are reportedly then incorporated into an RNA-induced silencing complex (RISC) where one or more helicases unwind the siRNA duplex, enabling the complementary antisense strand to guide target recognition (Nykanen, et al., (2001) Cell 107:309). Upon binding to the appropriate target mRNA, one or more endonucleases within the RISC cleaves the target to induce silencing (Elbashir, et al., (2001) Genes Dev. 15: 188). Thus, in one aspect the disclosure relates to a single stranded RNA that promotes the formation of a RISC complex to effect silencing of a target gene.

In some embodiments, a suitable RNAi agent can be selected by any processes known in the art or conceivable by one of ordinary skill in the art in accordance with the present disclosure. For example, the selection criteria can include one or more of the following steps: initial analysis of the target gene sequence and design of RNAi agents; this design can take into consideration sequence similarity across species (human, cynomolgus, mouse, etc.) and dissimilarity to other (non-target) genes; screening of RNAi agents in vitro (e.g., at 10 nM in cells expressing the target transcript); determination of EC50 or IC50 in cells; determination of viability of cells treated with RNAi agents, wherein it is desired, in some embodiments, that the RNAi agent to the target not inhibit the viability of these cells; testing with human PBMC (peripheral blood mononuclear cells), e.g., to test levels of TNF-alpha to estimate immunogenicity, wherein immunostimulatory sequences are usually less desired; testing in human whole blood assay, wherein fresh human blood is treated with an RNAi agent and cytokine/chemokine levels are determined [e.g., TNF-alpha (tumor necrosis factor-alpha) and/or MCP1 (monocyte chemotactic protein 1)], wherein immunostimulatory sequences are usually less desired; determination of gene knockdown in vivo using cells or tumors in test animals; and optimization of specific modifications of the RNAi agents.

The so-called canonical siRNA structure is reportedly a double-stranded RNA molecule, wherein each strand is about 21 nucleotides long. The two strands are reportedly an antisense (or "guide") strand, which recognizes and binds to a complementary sequence in the target transcript, and a sense (or "passenger") strand, which is complementary to the antisense strand. The sense and antisense strands are reportedly largely complementary, typically forming two 3' overhangs of 2 nucleotides on both ends.

While a canonical siRNA structure is reportedly double-stranded, RNAi agent can also be single-stranded. In some embodiments, a single-stranded RNAi agent corresponds to an antisense strand of a double-stranded siRNA, and the single-stranded RNAi agent lacks a corresponding passenger strand.

However, it has been reported that not all tested structural elements for single-stranded RNAi agents are effective; introduction of some structural elements into an oligonucleotide can reportedly interference with single-stranded RNA interference activity.

In some embodiments, the present disclosure provides oligonucleotides and compositions useful as RNAi agent. In some embodiments, the present disclosure provides oligonucleotides and compositions useful as single-stranded RNAi agent. The present disclosure, among other things, provides novel structures of single-stranded oligonucleotides capable of directing RNA interference. Without wishing to be bound by any particular theory, this disclosure notes that single-stranded RNAi agents have advantages over double-stranded RNAi agents. For example, single-stranded RNAi agents have a lower cost of goods, as the construction of only one strand is required. Additionally or alternatively, only one strand (the antisense strand) is administered to target a target transcript. A source of off-target effects directed by dsRNA is loading of the sense strand into RISC and binding to and knockdown of undesired targets (Jackson et al. 2003 Nat. Biotech. 21: 635-637), a single-stranded RNAi agent can elicit fewer off-target effects than a corresponding double-stranded RNAi agent. In addition, some single-stranded RNAi agents, including some disclosed herein, can target particular sequences which have not previously been successfully targeted with double-stranded RNAi agents (for example, they can reduce levels of the sequences, and/or products (transcripts and/or proteins) of the sequences, significantly more than double-stranded RNAi agents). The present disclosure, among other things, provides novel formats (modifications, stereochemistry, combinations thereof, etc.) for oligonucleotides which can direct single-stranded RNA interference.

Oligonucleotides

In some embodiments, provided oligonucleotides can direct a decrease in the expression and/or level of a target gene or its gene product. In some embodiments, provided oligonucleotides can direct a decrease in levels of target products. In some embodiments, provided oligonucleotide can reduce levels of transcripts of target genes. In some embodiments, provided oligonucleotide can reduce levels of mRNA of target genes. In some embodiments, provided oligonucleotide can reduce levels of proteins encoded by target genes. In some embodiments, provided oligonucleotides can direct a decrease in the expression and/or level of a target gene or its gene product via RNA interference. In some embodiments, provided oligonucleotides can direct a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides can direct a decrease in the expression and/or level of a target gene or its gene product via RNA interference and/or RNase H-mediated knockdown. In some embodiments, provided oligonucleotides can direct a decrease in the expression and/or level of a target gene or its gene product by sterically blocking translation after binding to a target gene mRNA, and/or by altering or interfering with mRNA splicing and/or exon inclusion or exclusion. In some embodiments, provided oligonucleotides comprise one or more structural elements described herein or known in the art in accordance with the present disclosure, e.g., base sequences; modifications; stereochemistry; patterns of internucleotidic linkages; GC contents; long GC stretches; patterns of backbone linkages; patterns of backbone chiral centers; patterns of backbone phosphorus modifications; additional chemical moieties, including but not limited to, one or more targeting moieties, lipid moieties, and/or carbohydrate moieties, etc.; seed regions; post-seed regions; 5'-end structures; 5'-end regions; 5' nucleotide moieties; 3'-end regions; 3'-terminal dinucleotides; 3'-end caps; etc. In some embodiments, a seed region of an oligonucleotide is or comprises the second to eighth, second to seventh, second to sixth, third to eighth, third to seventh, third to seven, or fourth to eighth or fourth to seventh nucleotides, counting from the 5' end; and the post-seed region of the oligonucleotide is the region immediately 3' to the seed region, and interposed between the seed region and the 3' end region.

In some embodiments, a provided composition comprises an oligonucleotide. In some embodiments, a provided composition comprises one or more lipid moieties, one or more carbohydrate moieties (unless otherwise specified, other than sugar moieties of nucleoside units that form oligonucleotide chain with internucleotidic linkages), and/or one or more targeting components.

In some embodiments, the present disclosure provides a provided compound, e.g., an oligonucleotide of a provided composition, having the structure of formula O-I:

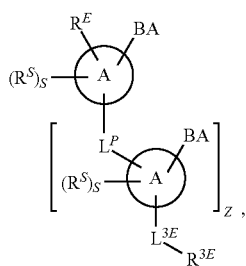

O-I or a salt thereof, wherein:
$R^E$ is a 5'-end group;
each BA is independently an optionally substituted group selected from $C_{1-30}$ cycloaliphatic, $C_{6-30}$ aryl, $C_{5-30}$ heteroaryl having 1-10 heteroatoms independently selected from oxygen, nitrogen, sulfur, phosphorus and silicon, $C_{3-30}$ heterocyclyl having 1-10 heteroatoms independently selected from oxygen, nitrogen, sulfur, phosphorus, boron and silicon, a natural nucleobase moiety, and a modified nucleobase moiety;
each $R^s$ is independently —F, —Cl, —Br, —I, —CN, —N$_3$, —NO, —NO$_2$, -L-R', -L-OR', -L-SR', -L-N(R')$_2$, —O-L-OR', —O-L-SR', or —O-L-N(R')$_2$;
s is 0-20;
each L is independently a covalent bond, or a bivalent, optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with $Cy^L$;
each $Cy^L$ is independently an optionally substituted tetravalent group selected from a $C_{3-20}$ cycloaliphatic ring, a $C_{6-20}$ aryl ring, a 5-20 membered heteroaryl ring having 1-10 heteroatoms independently selected from oxygen, nitrogen, sulfur, phosphorus and silicon, and a 3-20 membered heterocyclyl ring having 1-10 heteroatoms independently selected from oxygen, nitrogen, sulfur, phosphorus, boron and silicon;

each Ring A is independently an optionally substituted 3-20 membered monocyclic, bicyclic or polycyclic ring having 0-10 heteroatoms independently selected from oxygen, nitrogen, sulfur, phosphorus and silicon;
each $L^P$ is independently an internucleotidic linkage;
z is 1-1000;
$L^{3E}$ is L or -L-L-;
$R^{3E}$ is —R', -L-R', —OR', or a solid support;
each R' is independently —R, —C(O)R, —C(O)OR, or —S(O)$_2$R;
each R is independently —H, or an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon, or
two R groups are optionally and independently taken together to form a covalent bond, or:
two or more R groups on the same atom are optionally and independently taken together with the atom to form an optionally substituted, 3-30 membered monocyclic, bicyclic or polycyclic ring having, in addition to the atom, 0-10 heteroatoms independently selected from oxygen, nitrogen, sulfur, phosphorus and silicon; or
two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms independently selected from oxygen, nitrogen, sulfur, phosphorus and silicon.

In some embodiments, each $L^P$ independently has the structure of formula I:

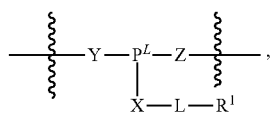

I or a salt form thereof, wherein:
$P^L$ is P(=W), P, or P→B(R')$_3$;
W is O, S or Se;
$R^1$ is -L-R, halogen, —CN, —NO$_2$, —Si(R)$_3$, —OR, —SR, or —N(R)$_2$;
each of X, Y and Z is independently —O—, —S—, —N(-L-R$^1$)—, or L;
wherein each variable is independently as described in the present disclosure.

In some embodiments, each $L^P$ independently has the structure of formula I, and $R^E$ is —C(R$^{5S}$)$_3$, -L-P$^{DB}$, —C(R$^{5s}$)$_2$OH, -L-R$^{5s}$, or -L-P$^{5s}$-L-R$^{5s}$, or a salt form thereof, wherein each variable is independently as described in the present disclosure.

In some embodiments, $R^E$ is —C(R$^{5s}$)$_3$, -L-P$^{DB}$, —C(R$^{5s}$)$_2$OH, -L-R$^{5s}$, or -L-P$^{5s}$-L-R$^{5s}$, or a salt form thereof;
each BA is independently an optionally substituted group selected from $C_{5-30}$ heteroaryl having 1-10 heteroatoms independently selected from oxygen, nitrogen, sulfur, phosphorus and silicon, and $C_{3-30}$ heterocyclyl having 1-10 heteroatoms independently selected from oxygen, nitrogen, sulfur, phosphorus, boron and silicon;

each Ring A is independently an optionally substituted 3-20 membered monocyclic, bicyclic or polycyclic ring having 0-10 heteroatoms independently selected from oxygen, nitrogen, sulfur, phosphorus and silicon; and each $L^P$ independently has the structure of formula I, wherein each variable is independently as described in the present disclosure.

In some embodiments, $R^E$ is $-C(R^{5s})_3$, $-L-P^{DB}$, $-C(R^{5s})_2OH$, $-L-R^{5s}$, or $-L-P^{5s}-L-R^{5s}$, or a salt form thereof;

each BA is independently an optionally substituted $C_{5-30}$ heteroaryl having 1-10 heteroatoms independently selected from oxygen, nitrogen, sulfur, phosphorus and silicon, wherein the heteroaryl comprises one or more heteroatoms selected from oxygen and nitrogen;

each Ring A is independently an optionally substituted 5-10 membered monocyclic or bicyclic saturated ring having 0-5 heteroatoms independently selected from oxygen, nitrogen, sulfur, phosphorus and silicon, wherein the ring comprises at least one oxygen atom; and each $L^P$ independently has the structure of formula I, wherein each variable is independently as described in the present disclosure.

In some embodiments, $R^E$ is $-C(R^{5s})_3$, $-L-P^{DB}$, $-C(R^{5s})_2OH$, $-L-R^{5s}$, or $-L-P^{5s}-L-R^{5s}$, or a salt form thereof;

each BA is independently an optionally substituted or protected nucleobase selected from adenine, cytosine, guanosine, thymine, and uracil;

each Ring A is independently an optionally substituted 5-7 membered monocyclic or bicyclic saturated ring having one or more oxygen atoms; and each $L^P$ independently has the structure of formula I, wherein each variable is independently as described in the present disclosure.

In some embodiments, $R^E$ is a 5'-end group as described herein. In some embodiments, $R^E$ is $-C(R^{5s})_3$, $-L-P^{DB}$, $C(R^{5s})_2OH$, $-L-R^{5s}$, or $-L-P^{5s}-L-R^{5s}$, or a salt form thereof, wherein each variable is independently as described in the present disclosure. In some embodiments, $R^E$ is $-CH_2OH$. In some embodiments, $R^E$ is $-CH_2OP(O)(OR)_2$ or a salt form thereof, wherein each R is independently as described in the present disclosure. In some embodiments, $R^E$ is $-CH_2OP(O)(OH)_2$ or a salt form thereof. In some embodiments, $R^E$ is $-CH_2OP(O)(OR)(SR)$ or a salt form thereof, wherein each R is independently as described in the present disclosure. In some embodiments, $R^E$ is $-CH_2OP(O)(SH)(OH)$ or a salt form thereof. In some embodiments, $R^E$ is (E)-CH=CHP(O)(OR)$_2$ or a salt form thereof, wherein each R is independently as described in the present disclosure. In some embodiments, $R^E$ is (E)-CH=CHP(O)(OH)$_2$.

In some embodiments, the present disclosure provides multimers of oligonucleotides. In some embodiments, a multimer is a multimer of the same oligonucleotides. In some embodiments, a multimer is a multimer of structurally different oligonucleotides. In some embodiments, each oligonucleotide of a multimer performs its functions independently through its own pathways, e.g., RNAi, RNase-H dependent, etc. In some embodiments, provided oligonucleotides exist in an oligomeric or polymeric form, in which one or more oligonucleotide moieties are linked together by linkers, e.g., L, $L^M$, etc., through nucleobases, sugars, and/or internucleotidic linkages of the oligonucleotide moieties. For example, in some embodiments, a provided multimer compound has the structure of $(A^c)_a-L^M-(A^c)_b$, wherein each variable is independently as described in the present disclosure. Example multimer technologies include those illustrated in FIG. 89, wherein each oligonucleotide can independently function through different pathways, e.g., RNAi, and/or RNase-H dependent.

In some embodiments, a provided compound, e.g., an oligonucleotide of a provided composition, has the structure of:

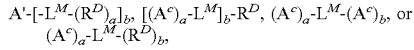

or a salt thereof, wherein:
each $A^c$ is independently an oligonucleotide moiety (e.g., $[H]_a-A^c$ or $[1-1]_b-A'$ is an oligonucleotide);
a is 1-1000;
b is 1-1000;
$L^M$ is a multivalent linker; and
each $R^D$ is independently a lipid moiety, a carbohydrate moiety, or a targeting moiety.

In some embodiments, a provided compound, e.g., an oligonucleotide of a provided composition, have the structure of:

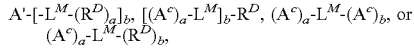

or a salt thereof, wherein:
each $A^c$ is independently an oligonucleotide moiety (e.g., $[H]_a-A^c$ or $[1-1]_b-A'$ is an oligonucleotide);
a is 1-1000;
b is 1-1000;
each $R^D$ is independently $R^{LD}$, $R^{CD}$ or $R^{TD}$;
$R^{CD}$ is an optionally substituted, linear or branched group selected from a $C_{1-100}$ aliphatic group and a $C_{1-100}$ heteroaliphatic group having 1-30 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, $-C\equiv C-$, $-C(R')_2-$, $-O-$, $-S-$, $-S-S-$, $-N(R')-$, $-C(O)-$, $-C(S)-$, $-C(NR')-$, $-C(O)N(R')-$, $-N(R')C(O)N(R')-$, $-N(R')C(O)O-$, $-S(O)-$, $-S(O)_2-$, $-S(O)_2N(R')-$, $-C(O)S-$, $-C(O)O-$, $-P(O)(OR')-$, $-P(O)(SR')-$, $-P(O)(R')-$, $-P(O)(NR')-$, $-P(S)(OR')-$, $-P(S)(SR')-$, $-P(S)(R')-$, $-P(S)(NR')-$, $-P(R')-$, $-P(OR')-$, $-P(SR')-$, $-P(NR')-$, $-P(OR')[B(R')_3]-$, $-OP(O)(OR')O-$, $-OP(O)(SR')O-$, $-OP(O)(R')O-$, $-OP(O)(NR')O-$, $-OP(OR')O-$, $-OP(SR')O-$, $-OP(NR')O-$, $-OP(R')O-$, or $-OP(OR')[B(R')_3]O-$; and one or more carbon atoms are optionally and independently replaced with $Cy^L$;

$R^{LD}$ is an optionally substituted, linear or branched group selected from a $C_{1-100}$ aliphatic group wherein one or more methylene units are optionally and independently replaced with $C_{1-6}$ alkylene, $C_{1-6}$ alkenylene, $-C\equiv C-$, $-C(R')_2-$, $-O-$, $-S-$, $-S-S-$, $-N(R')-$, $-C(O)-$, $-C(S)-$, $-C(NR')-$, $-C(O)N(R')-$, $-N(R')C(O)N(R')-$, $-N(R')C(O)O-$, $-S(O)-$, $-S(O)_2-$, $-S(O)_2N(R')-$, $-C(O)S-$, $-C(O)O-$, $-P(O)(OR')-$, $-P(O)(SR')-$, $-P(O)(R')-$, $-P(O)(NR')-$, $-P(S)(OR')-$, $-P(S)(SR')-$, $-P(S)(R')-$, $-P(S)(NR')-$, $-P(R')-$, $-P(OR')-$, $-P(SR')-$, $-P(NR')-$, $-P(OR')[B(R')_3]-$, $-OP(O)(OR')O-$, $-OP(O)(SR')O-$, $-OP(O)(R')O-$, $-OP(O)(NR')O-$, $-OP(OR')O-$, $-OP(SR')O-$, $-OP(NR')O-$, $-OP(R')O-$, or $-OP(OR')[B(R')_3]O-$; and one or more carbon atoms are optionally and independently replaced with $Cy^L$;

$R^{TD}$ is a targeting moiety;
each $L^M$ is independently a covalent bond, or a bivalent or multivalent, optionally substituted, linear or branched group selected from a $C_{1-100}$ aliphatic group and a $C_{1-100}$ heteroaliphatic group having 1-30 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with $Cy^L$;

each $Cy^L$ is independently an optionally substituted tetravalent group selected from a $C_3$-20 cycloaliphatic ring, a $C_{6-20}$ aryl ring, a 5-20 membered heteroaryl ring having 1-10 heteroatoms independently selected from oxygen, nitrogen, sulfur, phosphorus and silicon, and a 3-20 membered heterocyclyl ring having 1-10 heteroatoms independently selected from oxygen, nitrogen, sulfur, phosphorus, boron and silicon;

each R' is independently —R, —C(O)R, —C(O)OR, or —S(O)$_2$R; and each R is independently —H, or an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon, or two R groups are optionally and independently taken together to form a covalent bond, or:

two or more R groups on the same atom are optionally and independently taken together with the atom to form an optionally substituted, 3-30 membered monocyclic, bicyclic or polycyclic ring having, in addition to the atom, 0-10 heteroatoms independently selected from oxygen, nitrogen, sulfur, phosphorus and silicon; or two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms independently selected from oxygen, nitrogen, sulfur, phosphorus and silicon.

In some embodiments, $R^E$ is —CH$_2$OH. In some embodiments, $R^E$ is —CH$_2$OP(O)(R)$_2$ or a salt form thereof, wherein each R is independently as described in the present disclosure. In some embodiments, $R^E$ is —CH$_2$OP(O)(OR)$_2$ or a salt form thereof, wherein each R is independently as described in the present disclosure. In some embodiments, $R^E$ is —CH$_2$OP(O)(OH)$_2$ or a salt form thereof. In some embodiments, $R^E$ is —CH$_2$OP(O)(OR)(SR) or a salt form thereof, wherein each R is independently as described in the present disclosure. In some embodiments, $R^E$ is —CH$_2$OP(O)(SH)(OH) or a salt form thereof. In some embodiments, $R^E$ is (E)-CH=CHP(O)(OR)$_2$ or a salt form thereof, wherein each R is independently as described in the present disclosure. In some embodiments, $R^E$ is (E)-CH=CHP(O)(OH)$_2$.

In some embodiments, $R^E$ is —CH(R$^{5s}$)—OH, wherein R$^{5s}$ is as described in the present disclosure. In some embodiments, $R^E$ is —CH(R$^{5s}$)—OP(O)(R)$_2$ or a salt form thereof, wherein each R$^{5s}$ and R is independently as described in the present disclosure. In some embodiments, $R^E$ is —CH(R$^{5s}$)—OP(O)(OR)$_2$ or a salt form thereof, wherein each R$^{5s}$ and R is independently as described in the present disclosure. In some embodiments, $R^E$ is —CH(R$^{5s}$)—OP(O)(OH)$_2$ or a salt form thereof. In some embodiments, $R^E$ is —CH(R$^{5s}$)—OP(O)(OR)(SR) or a salt form thereof. In some embodiments, $R^E$ is —CH(R$^{5s}$)—OP(O)(OH)(SH) or a salt form thereof. In some embodiments, $R^E$ is —(R)—CH(R$^{5s}$)—OH, wherein R$^{5s}$ is as described in the present disclosure. In some embodiments, $R^E$ is —(R)—CH(R$^{5s}$)—OP(O)(R)$_2$ or a salt form thereof, wherein each R$^{5s}$ and R is independently as described in the present disclosure. In some embodiments, $R^E$ is —(R)—CH(R$^{5s}$)—OP(O)(OR)$_2$ or a salt form thereof, wherein each R$^{5s}$ and R is independently as described in the present disclosure. In some embodiments, $R^E$ is —(R)—CH(R$^{5s}$)—OP(O)(OH)$_2$ or a salt form thereof. In some embodiments, $R^E$ is —(R)—CH(R$^{5s}$)—OP(O)(OR)(SR) or a salt form thereof. In some embodiments, $R^E$ is —(R)—CH(R$^{5s}$)—OP(O)(OH)(SH) or a salt form thereof. In some embodiments, $R^E$ is —(S)—CH(R$^{5s}$)—OH, wherein R$^{5s}$ is as described in the present disclosure. In some embodiments, $R^E$ is —(S)—CH(R$^{5s}$)—OP(O)(R)$_2$ or a salt form thereof, wherein each R$^{5s}$ and R is independently as described in the present disclosure. In some embodiments, $R^E$ is —(S)—CH(R$^{5s}$)—OP(O)(OR)$_2$ or a salt form thereof, wherein each R$^{5s}$ and R is independently as described in the present disclosure. In some embodiments, $R^E$ is —(S)—CH(R$^{5s}$)—OP(O)(OH)$_2$ or a salt form thereof. In some embodiments, $R^E$ is —(S)—CH(R$^{5s}$)—OP(O)(OR)(SR) or a salt form thereof. In some embodiments, $R^E$ is —(S)—CH(R$^{5s}$)—OP(O)(OH)(SH) or a salt form thereof. In some embodiments, R$^{5s}$ is optionally substituted $C_1$, $C_2$, $C_3$, or $C_4$ aliphatic. In some embodiments, R$^{5s}$ is $C_1$, $C_2$, $C_3$, or $C_4$ aliphatic or haloaliphatic. In some embodiments, R$^{5s}$ is optionally substituted —CH$_3$. In some embodiments, R$^{5s}$ is —CH$_3$.

In some embodiments, a provided oligonucleotide, for example, a provided oligonucleotide having the structure of 5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-(N26-PX26-N27-PX27)$_{yz}$-(CAP)$_{zz}$-3', has the structure of formula O-I. In some embodiments, a compound of formula O-I is an oligonucleotide having the structure of 5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-(N26-PX26-N27-PX27)$_{yz}$-(CAP)$_{zz}$-3 In some embodiments, a provided oligonucleotide, for example, a provided oligonucleotide having the structure of 5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-(N26-PX26-N27-PX27)$_{yz}$-(CAP)$_{zz}$-3', has the structure of $A^c$-[-$L^M$-($R^D$)$_a$]$_b$, [($A^c$)$_a$-$L^M$]$_b$-$R^D$, $(A^c)_a\text{-}L^M\text{-}(A^c)_b$, or $(A^c)_a\text{-}L^M\text{-}(R^D)_b$. In some embodiments, a compound of $A^c\text{-}[\text{-}L^M\text{-}(R^D)_a]_b$, $[(A^c)_a\text{-}L^M]_b\text{-}R^D$, $(A^c)_a\text{-}L^M\text{-}(A^c)_b$, or $(A^c)_a\text{-}L^M\text{-}(R^D)_b$ is an oligonucleotide having the structure of 5'-PX0-N1-PX1-N2-PX2-N3-PX3-N4-PX4-NS-PX5-N6-PX6-N7-PX7-N8-PX8-N9-PX9-N10-PX10-N11-PX11-N12-PX12-N13-PX13-N14-PX14-N1S-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{rz}$-(N24-PX24)$_{vz}$-(N25-PX25)$_{wz}$-(N26-PX26-N27-PX27)$_{yz}$-(CAP)$_{zz}$-3'. In some embodiments, a provided oligonucleotide, for example, a provided oligonucleotide having the structure of 5'-PX0-N1-PX1-N2-PX2-N3-PX3-N4-PX4-NS-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{rz}$-(N24-PX24)$_{vz}$-(N2S-PX25)$_{wz}$-(N26-PX26-N27-PX27)$_3$,-(CAP)$_{zz}$-3', has the structure of $A^c\text{-}[\text{-}L^M\text{-}(R^D)_a]_b$. In some embodiments, a provided oligonucleotide, for example, a provided oligonucleotide having the structure of S'-PX0-N1-PX1-N2-PX2-N3-PX3-N4-PX4-NS-PX5-N6-PX6-N7-PX7-N8-PX8-N9-PX9-N10-PX10-N11-PX11-N12-PX12-N13-PX13-N14-PX14-N1S-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{rz}$-(N24-PX24)$_{vz}$-(N25-PX25)$_{wz}$-(N26-PX26-N27-PX27)$_3$,-(CAP)$_{zz}$-3', has the structure of $[(A^c)_a\text{-}L^M]_b\text{-}R^D$. In some embodiments, a provided oligonucleotide, for example, a provided oligonucleotide having the structure of 5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{rz}$-(N24-PX24)$_{vz}$-(N25-PX25)$_{wz}$-(N26-PX26-N27-PX27)$_{yz}$-(CAP)$_{zz}$-3', has the structure of $(A^c)_a\text{-}L^M\text{-}(A^c)_b$. In some embodiments, a provided oligonucleotide, for example, a provided oligonucleotide having the structure of 5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{rz}$-(N24-PX24)$_{vz}$-(N25-PX25)$_{wz}$-(N26-PX26-N27-PX27)$_{yz}$-(CAP)$_{zz}$-3', has the structure of $(A^c)_a\text{-}L^M\text{-}(R^D)_b$. In some embodiments, such a provided oligonucleotide, or a provided composition comprising such an oligonucleotide, functions in a system (e.g., a biochemical assay, a cell, a tissue, an organ, an organism, a subject, etc.) through a RNase H pathway to, for example, reduce levels of a nucleic acid or a product encoded thereof. In some embodiments, such a provided oligonucleotide, or a provided composition comprising such an oligonucleotide, functions in a system through a RNAi pathway to, for example, reduce levels of a nucleic acid or a product encoded thereof. In some embodiments, a provided oligonucleotide is single-stranded. In some embodiments, a provided oligonucleotide is administered to a system single-stranded.

In some embodiments, a provided compound, e.g., oligonucleotide of formula O-I, $A^c\text{-}[\text{-}L^M\text{-}(R^D)_a]_b$, $[(A^c)_a\text{-}L^M]_b\text{-}R^D$, $(A^c)_a\text{-}L^M\text{-}(A^c)_b$, or $(A^c)_a\text{-}L^M\text{-}(R^D)_b$, or 5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)m-(N20-PX20)$_{pz}$-(N21-PX21)$_{rz}$-(N22-PX22)$_{sz}$-(N23-PX23)$_{tz}$-(N24-PX24)$_{vz}$-(N25-PX25), (N26-PX26-N27-PX27)$_{yz}$-(CAP)$_{zz}$-3', may exist as a salt. In some embodiments, the present disclosure provides salts of oligonucleotides, and pharmaceutical compositions thereof.

In some embodiments, a salt is a pharmaceutically acceptable salt. In some embodiments, each hydrogen ion that may be donated to a base (e.g., under conditions of an aqueous solution, a pharmaceutical composition, etc.) is replaced by a non-H$^+$ cation. For example, in some embodiments, a pharmaceutically acceptable salt of an oligonucleotide is an all-metal ion salt, wherein each hydrogen ion (for example, of —OH, —SH, etc.) of each internucleotidic linkage (e.g., a natural phosphate linkage, a phosphorothioate diester linkage, etc.) is replaced by a metal ion. In some embodiments, a provided salt is an all-sodium salt. In some embodiments, a provided pharmaceutically acceptable salt is an all-sodium salt. In some embodiments, a provided salt is an all-sodium salt, wherein each internucleotidic linkage which is a natural phosphate linkage (acid form —O—P(O)(OH)—O—), if any, exists as its sodium salt form (—O—P(O)(ONa)—O—), and each internucleotidic linkage which is a phosphorothioate diester linkage (acid form —O—P(O)(SH)—O—), if any, exists as its sodium salt form (—O—P(O)(SNa)—O—).

In some embodiments, where presence and/or activity of a particular allele (and/or its one or more products (e.g., RNA and/or protein products)) (a disease-associated allele) is associated (e.g., correlated) with presence, incidence and/or severity of one or more diseases and/or conditions, a different allele of the same sequence (e.g. gene) exists and is not so associated, or is associated to a lesser extent (e.g., shows less significant, or statistically insignificant correlation). In some such embodiments, oligonucleotides and methods thereof as described herein may preferentially or specifically target the associated allele relative to the one or more less-associated/unassociated allele(s).

In some embodiments, a target sequence is a sequence to which an oligonucleotide as described herein binds. In many embodiments, a target sequence is identical to, or is an exact complement of, a sequence of a provided oligonucleotide, or of consecutive residues therein (e.g., a provided oligonucleotide includes a target-binding sequence that is identical to, or an exact complement of, a target sequence). In some embodiments, a small number of differences/mismatches is tolerated between (a relevant portion of) an oligonucleotide and its target sequence. In many embodiments, a target sequence is present within a target gene. In many embodiments, a target sequence is present within a transcript (e.g., an mRNA and/or a pre-mRNA) produced from a target gene.

In some embodiments, a target sequence includes one or more allelic sites (i.e., positions within a target gene at which allelic variation occurs). In some such embodiments, a provided oligonucleotide binds to one allele preferentially or specifically relative to one or more other alleles. In some embodiments, a target-binding sequence is identical to, or is an exact complement of, a target sequence of one allele. In some embodiments, a target-binding sequence is identical to a target sequence of one allele. In some embodiments, a target-binding sequence is an exact complement of a target sequence of one allele. In some embodiments, a provided oligonucleotide binds preferentially to a disease-associated allele. In some embodiments, a provided oligonucleotide binds preferentially to a disease-associated allele, and comprises a target-binding sequence which is identical to, or is an exact complement of, a target sequence of a disease-associated allele but not other allele(s). For example, in some embodiments, an oligonucleotide (or a target-binding sequence portion thereof) provided herein has a sequence that is identical to, or an exact complement of a particular allelic version of a target sequence. In some embodiments, a target sequence is a sequence of a particular allele. In some embodiments, an oligonucleotide (or a target-binding sequence portion thereof) provided herein has a sequence that is identical to, or an exact complement of an allelic site of a disease-associated allele.

A target-binding sequence, and/or a target sequence that it is identical to, or an exact complement of, can be of various lengths. In some embodiments, a length is 2-30 bases or longer. In some embodiments, a length is 5-20 bases. In some embodiments, a length is 10-20 bases. In some embodiments, a length is 2 bases. In some embodiments, a length is 3 bases. In some embodiments, a length is 4 bases. In some embodiments, a length is 5 bases. In some embodiments, a length is 6 bases. In some embodiments, a length is 7 bases. In some embodiments, a length is 8 bases. In some embodiments, a length is 9 bases. In some embodiments, a length is 10 bases. In some embodiments, a length is 11 bases. In some embodiments, a length is 12 bases. In some embodiments, a length is 13 bases. In some embodiments, a length is 14 bases. In some embodiments, a length is 15 bases. In some embodiments, a length is 16 bases. In some embodiments, a length is 17 bases. In some embodiments, a length is 18 bases. In some embodiments, a length is 19 bases. In some embodiments, a length is 20 bases. In some embodiments, a base is optionally substituted adenine, cytosine, guanosine, thymine, or uracil. In some embodiments, complementarity is determined based on A=T/U and G≡C.

As appreciated by those skilled in the art, various allelic sites can be included in a target sequence in accordance with the present disclosure. In some embodiments, a target sequence comprises a SNP. In some embodiments, a target sequence comprises a mutation. In some embodiments, a SNP is a SNP in PNPLA3.

Various linker, lipid moieties, carbohydrate moieties and targeting moieties, including many known in the art, can be utilized in accordance with the present disclosure. In some embodiments, a lipid moiety is a targeting moiety. In some embodiments, a carbohydrate moiety is a targeting moiety. In some embodiments, a targeting moiety is a lipid moiety. In some embodiments, a targeting moiety is a carbohydrate moiety. As readily appreciated by those skilled in the art, various linkers, including those described in the present disclosure, can be utilized in accordance with the present disclosure to link two moieties, for example, a lipid/carbohydrate/targeting component with an oligonucleotide moiety. As readily appreciated by those skilled in the art, linkers described for linking two moieties can also be used to link other moieties, for example, linkers for linking a lipid and an oligonucleotide moiety can also be used to link a carbohydrate or target moiety with an oligonucleotide moiety and vice versa.

In some embodiments, $A^c$ is of such an structure that its corresponding oligonucleotide (e.g., $[1\text{-}1]_a\text{-}A^c$ or $[H]_b\text{-}A^c$) is an oligonucleotide described in the present disclosure, optionally comprising a lipid moiety, a carbohydrate moiety, and/or a targeting moiety. In some embodiments, $A^c$ contains no lipid moieties, no carbohydrate moieties, and no targeting moieties. In some embodiments, $A^c$ contains no lipid moieties and no carbohydrate moieties. In some embodiments, $A^c$ contains no lipid moieties. In some embodiments, $A^c$ contains no carbohydrate moieties. In some embodiments, $A^c$ contains no targeting moieties. In some embodiments, $A^c$ is a monovalent, bivalent, or multivalent oligonucleotide moiety of an oligonucleotide having the structure of formula O-I.

In some embodiments, the present disclosure provides oligonucleotides and oligonucleotide compositions that are chirally controlled. For instance, in some embodiments, a provided composition contains predetermined levels of one or more individual oligonucleotide types, wherein an oligonucleotide type is defined by: 1) base sequence; 2) pattern of backbone linkages; 3) pattern of backbone chiral centers; and 4) pattern of backbone P-modifications. In some embodiments, a particular oligonucleotide type may be defined by 1A) base identity; 1B) pattern of base modification; 1C) pattern of sugar modification; 2) pattern of backbone linkages; 3) pattern of backbone chiral centers; and 4) pattern of backbone P-modifications. In some embodiments, oligonucleotides of the same oligonucleotide type are identical. In some embodiments, the present disclosure provides chirally controlled oligonucleotide compositions of oligonucleotides, wherein the composition comprises a predetermined level of a plurality of oligonucleotides, wherein oligonucleotides of the plurality share a common base sequence, and comprise the same configuration of linkage phosphorus at at least 1, 2, 3, 4, 5, 6, 7, 8, 9, 10, 11, 12, 13, 14, 15, 16, 17, 18, 19, 20, 21, 22, 23, 24, or 25 chiral internucleotidic linkages (chirally controlled internucleotidic linkages).

In some embodiments, oligonucleotides of a predetermined level and/or a provided plurality, e.g., those of formula O-I, $A^c\text{-}[\text{-}L^M\text{-}(R^D)_a]_b$, $[(A^c)_a\text{-}L^M]_b\text{-}R^D$, $(A^c)_a\text{-}L^M\text{-}(A^c)_b$, or $(A')_a\text{-}L^M\text{-}(R^D)_b$, or 5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)m-(N20-PX20)$_{pz}$-(N21-PX21), 7-(N22-PX22)$_{sz}$-(N23-PX23)$_{tz}$-(N24-PX24)$_{vz}$-(N25-PX25)$_{wz}$-(N26-PX26-N27-PX27)$_{yz}$-(CAP)$_{zz}$-3', comprise 1-30 chirally controlled internucleotidic linkages.

In some embodiments, provided oligonucleotides comprise 2-30 chirally controlled internucleotidic linkages. In some embodiments, provided oligonucleotides comprise 5-30 chirally controlled internucleotidic linkages. In some embodiments, provided oligonucleotides comprise 10-30 chirally controlled internucleotidic linkages. In some embodiments, provided oligonucleotides comprise 1 chirally controlled internucleotidic linkage. In some embodiments, provided oligonucleotides comprise 2 chirally controlled internucleotidic linkages. In some embodiments, provided oligonucleotides comprise 3 chirally controlled internucleotidic linkages. In some embodiments, provided oligonucleotides comprise 4 chirally controlled internucleotidic linkages. In some embodiments, provided oligonucleotides comprise 5 chirally controlled internucleotidic linkages. In some embodiments, provided oligonucleotides comprise 6 chirally controlled internucleotidic linkages. In some embodiments, provided oligonucleotides comprise 7 chirally controlled internucleotidic linkages. In some embodiments, provided oligonucleotides comprise 8 chirally controlled internucleotidic linkages. In some embodiments, provided oligonucleotides comprise 9 chirally controlled internucleotidic linkages. In some embodiments, provided oligonucleotides comprise 10 chirally controlled internucleotidic linkages. In some embodiments, provided oligonucleotides comprise 11 chirally controlled internucleotidic linkages. In some embodiments, provided oligonucleotides comprise 12 chirally controlled internucleotidic linkages. In some embodiments, provided oligonucleotides comprise 13 chirally controlled internucleotidic linkages. In some embodiments, provided oligonucleotides comprise chirally controlled internucleotidic linkages. In some embodiments, provided oligonucleotides have 15 chirally controlled internucleotidic linkages. In some embodiments, provided oligonucleotides have 16 chirally controlled internucleotidic linkages. In some embodiments, provided oligonucleotides have 17 chirally controlled internucleotidic linkages. In some embodiments, provided oligonucleotides have 18 chirally controlled internucleotidic linkages. In some embodiments, provided oligonucleotides have 19 chirally controlled internucleotidic linkages. In some embodiments, provided oligonucleotides have 20 chirally controlled internucleotidic linkages.

In some embodiments, about 1-100% of all internucleotidic linkages are chirally controlled internucleotidic linkages. In some embodiments, a percentage is about 5%-100%. In some embodiments, a percentage is at least 5%, 10%, 15%, 20%, 25%, 30%, 35%, 40%, 45%, 50%, 55%, 60%, 65%, 70%, 75%, 80%, 85%, 90%, 95%, 965, 96%, 98%, or 99%. In some embodiments, a percentage is about 5%, 10%, 15%, 20%, 25%, 30%, 35%, 40%, 45%, 50%, 55%, 60%, 65%, 70%, 75%, 80%, 85%, 90%, 95%, 965, 96%, 98%, or 99%.

In some embodiments, a provided oligonucleotide is a unimer. In some embodiments, a provided oligonucleotide is a P-modification unimer. In some embodiments, a provided oligonucleotide is a stereounimer. In some embodiments, a provided oligonucleotide is a stereounimer of configuration Rp. In some embodiments, a provided oligonucleotide is a stereounimer of configuration Sp.

In some embodiments, a provided oligonucleotide is an altmer. In some embodiments, a provided oligonucleotide is a P-modification altmer. In some embodiments, a provided oligonucleotide is a stereoaltmer.

In some embodiments, a provided oligonucleotide is a blockmer. In some embodiments, a provided oligonucleotide is a P-modification blockmer. In some embodiments, a provided oligonucleotide is a stereoblockmer.

In some embodiments, a provided oligonucleotide is a gapmer.

In some embodiments, a provided oligonucleotide is a skipmer.

In some embodiments, a provided oligonucleotide is a hemimer. In some embodiments, a hemimer is an oligonucleotide wherein the 5'-end or the 3'-end region has a sequence that possesses a structure feature that the rest of the oligonucleotide does not have. In some embodiments, the 5'-end or the 3'-end region has or comprises 2 to 20 nucleotides. In some embodiments, a structural feature is a base modification. In some embodiments, a structural feature is a sugar modification. In some embodiments, a structural feature is a P-modification. In some embodiments, a structural feature is stereochemistry of the chiral internucleotidic linkage. In some embodiments, a structural feature is or comprises a base modification, a sugar modification, a P-modification, or stereochemistry of the chiral internucleotidic linkage, or combinations thereof. In some embodiments, a hemimer is an oligonucleotide in which each sugar moiety of the 5'-end region shares a common modification. In some embodiments, a hemimer is an oligonucleotide in which each sugar moiety of the 3'-end region shares a common modification. In some embodiments, a common sugar modification of the 5' or 3'-end region is not shared by any other sugar moieties in the oligonucleotide. In some embodiments, an example hemimer is an oligonucleotide comprising a sequence of substituted or unsubstituted 2'-O-alkyl sugar modified nucleosides, bicyclic sugar modified nucleosides, β-D-ribonucleosides or β-D-deoxyribonucleosides (for example 2'-MOE modified nucleosides, and LNA™ or ENA™ bicyclic sugar modified nucleosides) at one terminus region and a sequence of nucleosides with a different sugar moiety (such as a substituted or unsubstituted 2'-O-alkyl sugar modified nucleosides, bicyclic sugar modified nucleosides or natural ones) at the other terminus region. In some embodiments, a provided oligonucleotide is a combination of one or more of unimer, altmer, blockmer, gapmer, hemimer and skipmer. In some embodiments, a provided oligonucleotide is a combination of one or more of unimer, altmer, blockmer, gapmer, and skipmer. For instance, in some embodiments, a provided oligonucleotide is both an altmer and a gapmer. In some embodiments, a provided nucleotide is both a gapmer and a skipmer. One of skill in the chemical and synthetic arts will recognize that numerous other combinations of patterns are available and are limited only by the commercial availability and/or synthetic accessibility of constituent parts required to synthesize a provided oligonucleotide in accordance with methods of the present disclosure. In some embodiments, a hemimer structure provides advantageous benefits. In some embodiments, provided oligonucleotides are 5'-hemimers that comprises modified sugar moieties in a 5'-end sequence. In some embodiments, provided oligonucleotides are 5'-hemimers that comprises modified 2'-sugar moieties in a 5'-end sequence.

In some embodiments, a provided oligonucleotide comprises one or more optionally substituted nucleotides. In some embodiments, a provided oligonucleotide comprises one or more modified nucleotides. In some embodiments, a provided oligonucleotide comprises one or more optionally substituted nucleosides. In some embodiments, a provided oligonucleotide comprises one or more modified nucleosides. In some embodiments, a provided oligonucleotide comprises one or more optionally substituted LNAs.

In some embodiments, a provided oligonucleotide comprises one or more optionally substituted nucleobases. In some embodiments, a provided oligonucleotide comprises one or more optionally substituted natural nucleobases. In some embodiments, a provided oligonucleotide comprises one or more optionally substituted modified nucleobases. In some embodiments, a provided oligonucleotide comprises one or more 5-methylcytidine; 5-hydroxymethylcytidine, 5-formylcytosine, or 5-carboxylcytosine. In some embodiments, a provided oligonucleotide comprises one or more 5-methylcytidine.

In some embodiments, each nucleobase of a provided oligonucleotide, e.g., one of formula 04, $A^c$-[-$L^M$-($R^D$)$_a$]$_b$, [($A^c$)$_a$-$L^M$]$_b$-$R^D$, ($A^c$)$_a$-$L^M$-($A^c$)$_b$, or ($A^c$)$_a$-$L^M$-($R^D$)$_b$, or 5'-PX0-N1-PX1-N2-PX2-N3-PX3-N4-PX4-N5-PX5-N6-PX6-N7-PX7-N8-PX8-N9-PX9-N1 O—PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-(N26-PX26-N27-PX27)$_{yz}$-(CAP)$_{zz}$-3', is independently an optionally substituted or protected nucleobase of adenine, cytosine, guanosine, thymine, or uracil.

In some embodiments, each base (BA) is independently an optionally substituted or protected nucleobase of adenine, cytosine, guanosine, thymine, or uracil. As appreciated by those skilled in the art, various protected nucleobases, including those widely known in the art, for example, those used in oligonucleotide preparation (e.g., protected nucleobases of WO/2010/064146, WO/2011/005761, WO/2013/012758, WO/2014/010250, US2013/0178612, WO/2014/012081, WO/2015/107425, WO2017/015555, and WO2017/062862, protected nucleobases of each of which are incorporated herein by reference), and can be utilized in accordance with the present disclosure.

In some embodiments, a provided oligonucleotide comprises one or more optionally substituted sugars. In some embodiments, a provided oligonucleotide comprises one or more optionally substituted sugars found in naturally occurring DNA and RNA. In some embodiments, a provided oligonucleotide comprises one or more optionally substituted ribose or deoxyribose. In some embodiments, a provided oligonucleotide comprises one or more optionally substituted ribose or deoxyribose, wherein one or more hydroxyl groups of the ribose or deoxyribose moiety is optionally and independently replaced by halogen, R', —N(R')$_2$, —OR', or —SR', wherein each R' is independently as defined above and described herein. In some embodiments, a provided oligonucleotide comprises one or more optionally substituted deoxyribose, wherein the 2' position of the deoxyribose is optionally and independently substituted with halogen, R', —N(R')$_2$, —OR', or —SR', wherein each R' is independently as defined above and described herein. In some embodiments, a provided oligonucleotide comprises one or more optionally substituted deoxyribose, wherein the 2' position of the deoxyribose is optionally and independently substituted with halogen. In some embodiments, a provided oligonucleotide comprises one or more optionally substituted deoxyribose, wherein the 2' position of the deoxyribose is optionally and independently substituted with one or more —F. halogen. In some embodiments, a provided oligonucleotide comprises one or more optionally substituted deoxyribose, wherein the 2' position of the deoxyribose is optionally and independently substituted with —OR', wherein each R' is independently as defined above and described herein. In some embodiments, a provided oligonucleotide comprises one or more optionally substituted deoxyribose, wherein the 2' position of the deoxyribose is optionally and independently substituted with —OR', wherein each R' is independently an optionally substituted C$_1$-C$_6$ aliphatic. In some embodiments, a provided oligonucleotide comprises one or more optionally substituted deoxyribose, wherein the 2' position of the deoxyribose is optionally and independently substituted with —OR', wherein each R' is independently an optionally substituted C$_1$-C$_6$ alkyl. In some embodiments, a provided oligonucleotide comprises one or more optionally substituted deoxyribose, wherein the 2' position of the deoxyribose is optionally and independently substituted with —OMe. In some embodiments, a provided oligonucleotide comprises one or more optionally substituted deoxyribose, wherein the 2' position of the deoxyribose is optionally and independently substituted with —O-methoxyethyl.

In some embodiments, a provided oligonucleotide is single-stranded oligonucleotide.

In some embodiments, a provided oligonucleotide is a hybridized oligonucleotide strand. In certain embodiments, a provided oligonucleotide is a partially hybridized oligonucleotide strand. In certain embodiments, a provided oligonucleotide is a completely hybridized oligonucleotide strand. In certain embodiments, a provided oligonucleotide is a double-stranded oligonucleotide. In certain embodiments, a provided oligonucleotide is a triple-stranded oligonucleotide (e.g., a triplex).

In some embodiments, a provided oligonucleotide is chimeric. For example, in some embodiments, a provided oligonucleotide is DNA-RNA chimera, DNA-LNA chimera, etc.

In some embodiments, any one of the structures comprising an oligonucleotide depicted in WO2012/030683 can be modified in accordance with methods of the present disclosure to provide chirally controlled compositions thereof. For example, in some embodiments, chirally controlled composition comprises a stereochemical control at any one or more of chiral linkage phosphorus atoms, optionally through incorporation of one or more P-modifications described in WO2012/030683 or the present disclosure. For example, in some embodiments, a particular nucleotide unit of an oligonucleotide of WO2012/030683 is preselected to be provided with chiral control at the linkage phosphorus of that nucleotide unit and/or to be P-modified with chiral control at the linkage phosphorus of that nucleotide unit.

In some embodiments, a provided oligonucleotide comprises a nucleic acid analog, e.g., GNA, LNA, PNA, TNA, F-HNA (F-THP or 3'-fluoro tetrahydropyran), MNA (mannitol nucleic acid, e.g., Leumann 2002 Bioorg. Med. Chem. 10: 841-854), ANA (anitol nucleic acid), and Morpholino.

In some embodiments, a provided oligonucleotide is characterized as having the ability to indirectly or directly increase or decrease activity of a protein or inhibition or promotion of the expression of a protein. In some embodiments, a provided oligonucleotide is characterized in that it is useful in the control of cell proliferation, viral replication, and/or any other cell signaling process.

In some embodiments, a provided oligonucleotide is about 2-500 nucleotide units in length. In some embodiments, a provided oligonucleotide is about 5-500 nucleotide units in length. In some embodiments, a provided oligonucleotide is about 10-50 nucleotide units in length. In some embodiments, a provided oligonucleotide is about 15-50 nucleotide units in length. In some embodiments, each nucleotide unit independently comprises a heteroaryl nucleobase unit (e.g., adenine, cytosine, guanosine, thymine, or uracil, each of which is optionally and independently substituted or protected), a sugar unit comprising a 5-10 membered heterocyclyl ring, and an internucleotidic linkage having the structure of formula I. In some embodiments, a provided oligonucleotide is from about 2 to about 200 nucleotide units in length. In some embodiments, a provided oligonucleotide is from about 2 to about 180 nucleotide units in length. In some embodiments, a provided oligonucleotide is from about 2 to about 160 nucleotide units in length. In some embodiments, a provided oligonucleotide is from about 2 to about 140 nucleotide units in length. In some embodiments, a provided oligonucleotide is from about 2 to about 120 nucleotide units in length. In some embodiments, a provided oligonucleotide is from about 2 to about 100 nucleotide units in length. In some embodiments, a provided oligonucleotide is from about 2 to about 90 nucleotide units in length. In some embodiments, a provided oligonucleotide is from about 2 to about 80 nucleotide units in length. In some embodiments, a provided oligonucleotide is from about 2 to about 70 nucleotide units in length. In some embodiments, a provided oligonucleotide is from about 2 to about 60 nucleotide units in length. In some embodiments, a provided oligonucleotide is from about 2 to about 50 nucleotide units in length. In some embodiments, a provided oligonucleotide is from about 2 to about 40 nucleotide units in length. In some embodiments, a provided oligonucleotide is from about 2 to about 30 nucleotide units in length. In some embodiments, a provided oligonucleotide is from about 2 to about 29 nucleotide units in length. In some embodiments, a provided oligonucleotide is from about 2 to about 28 nucleotide units in length. In some embodiments, a provided oligonucleotide is from about 2 to about 27 nucleotide units in length. In some embodiments, a provided oligonucleotide is from about 2 to about 26 nucleotide units in length. In some embodiments, a provided oligonucleotide is from about 2 to about 25 nucleotide units in length. In some embodiments, a provided oligonucleotide is from about 2 to about 24 nucleotide units in length. In some embodiments, a provided oligonucleotide is from about 2 to about 23 nucleotide units in length. In some embodiments, a provided oligonucleotide is from about 2 to about 22 nucleotide units in length. In some embodiments, a provided oligonucleotide is from about 2 to about 21 nucleotide units in length. In some embodiments, a provided oligonucleotide is from about 2 to about 20 nucleotide units in length.

In some embodiments, a provided oligonucleotide is from about 4 to about 200 nucleotide units in length. In some embodiments, a provided oligonucleotide is from about 4 to about 180 nucleotide units in length. In some embodiments, a provided oligonucleotide is from about 4 to about 160 nucleotide units in length. In some embodiments, a provided oligonucleotide is from about 4 to about 140 nucleotide units in length. In some embodiments, a provided oligonucleotide is from about 4 to about 120 nucleotide units in length. In some embodiments, a provided oligonucleotide is from about 4 to about 100 nucleotide units in length. In some embodiments, a provided oligonucleotide is from about 4 to about 90 nucleotide units in length. In some embodiments, a provided oligonucleotide is from about 4 to about 80 nucleotide units in length. In some embodiments, a provided oligonucleotide is from about 4 to about 70 nucleotide units in length. In some embodiments, a provided oligonucleotide is from about 4 to about 60 nucleotide units in length. In some embodiments, a provided oligonucleotide is from about 4 to about 50 nucleotide units in length. In some embodiments, a provided oligonucleotide is from about 4 to about 40 nucleotide units in length. In some embodiments, a provided oligonucleotide is from about 4 to about 30 nucleotide units in length. In some embodiments, a provided oligonucleotide is from about 4 to about 29 nucleotide units in length. In some embodiments, a provided oligonucleotide is from about 4 to about 28 nucleotide units in length. In some embodiments, a provided oligonucleotide is from about 4 to about 27 nucleotide units in length. In some embodiments, a provided oligonucleotide is from about 4 to about 26 nucleotide units in length. In some embodiments, a provided oligonucleotide is from about 4 to about 25 nucleotide units in length. In some embodiments, a provided oligonucleotide is from about 4 to about 24 nucleotide units in length. In some embodiments, a provided oligonucleotide is from about 4 to about 23 nucleotide units in length. In some embodiments, a provided oligonucleotide is from about 4 to about 22 nucleotide units in length. In some embodiments, a provided oligonucleotide is from about 4 to about 21 nucleotide units in length. In some embodiments, a provided oligonucleotide is from about 4 to about 20 nucleotide units in length.

In some embodiments, a provided oligonucleotide is from about 5 to about 10 nucleotide units in length. In some embodiments, a provided oligonucleotide is from about 10 to about 30 nucleotide units in length. In some embodiments, a provided oligonucleotide is from about 15 to about 25 nucleotide units in length. In some embodiments, a provided oligonucleotide is from about 5, 6, 7, 8, 9, 10, 11, 12, 13, 14, 15, 16, 17, 18, 19, 20, 21, 22, 23, 24, or 25 nucleotide units in length.

In some embodiments, an oligonucleotide is at least 2 nucleotide units in length. In some embodiments, an oligonucleotide is at least 2, 3, 4, 5, 6, 7, 8, 9, 10, 11, 12, 13, 14, 15, 16, 17, 18, 19, 20, 21, 22, 23, 24, or 25 nucleotide units in length. In some embodiments, an oligonucleotide is at least 5 nucleotide units in length. In some embodiments, an oligonucleotide is at least 10 nucleotide units in length. In some embodiments, an oligonucleotide is at least 15 nucleotide units in length. In some embodiments, an oligonucleotide is at least 16 nucleotide units in length. In some embodiments, an oligonucleotide is at least 17 nucleotide units in length. In some embodiments, an oligonucleotide is at least 18 nucleotide units in length. In some embodiments, an oligonucleotide is at least 19 nucleotide units in length. In some embodiments, an oligonucleotide is at least 20 nucleotide units in length. In some embodiments, an oligonucleotide is at least 21 nucleotide units in length. In some embodiments, an oligonucleotide is at least 22 nucleotide units in length. In some embodiments, an oligonucleotide is at least 23 nucleotide units in length. In some embodiments, an oligonucleotide is at least 24 nucleotide units in length. In some embodiments, an oligonucleotide is at least 25 nucleotide units in length. In some other embodiments, an oligonucleotide is at least 30 nucleotide units in length. In some other embodiments, an oligonucleotide is a duplex of complementary strands of at least 18 nucleotide units in length. In some other embodiments, an oligonucleotide is a duplex of complementary strands of at least 21 nucleotide units in length.

In some embodiments, the 5'-end and/or the 3'-end of a provided oligonucleotide is modified. In some embodiments, the 5'-end and/or the 3'-end of a provided oligonucleotide is modified with a terminal cap moiety. Examples of such modifications, including terminal cap moieties are extensively described herein and in the art, for example but not limited to those described in US Patent Application Publication US 2009/0023675A1.

In some embodiments, oligonucleotides of an oligonucleotide type characterized by 1) a common base sequence and length, 2) a common pattern of backbone linkages, and 3) a common pattern of backbone chiral centers, have the same chemical structure. For example, they have the same base sequence, the same pattern of nucleoside modifications, the same pattern of backbone linkages (i.e., pattern of internucleotidic linkage types, for example, phosphate, phosphorothioate, etc), the same pattern of backbone chiral centers (i.e. pattern of linkage phosphorus stereochemistry (Rp/Sp)), and the same pattern of backbone phosphorus modifications (e.g., pattern of "-XLR$^1$" groups in Formula I).

Single-Stranded RNAi Agents and Antisense Oligonucleotides

In some embodiments, the present disclosure provides oligonucleotides. In some embodiments, the present disclosure provides oligonucleotides which decrease the expression and/or level of a target gene or its gene product. Those of ordinary skill in the art, reading the present disclosure, will appreciate that, in some embodiments, provided oligonucleotides may act as RNAi agents. Alternatively or additionally, in some embodiments, provided oligonucleotides may act via an RNase H-dependent mechanism and/or another biochemical mechanism that does not involve RNA interference.

Among other things, the present disclosure defines certain structural attributes that may be particularly desirable and/or effective in an oligonucleotide. Among other things, the present disclosure defines certain structural attributes that may be particularly desirable and/or effective in an oligonucleotide that acts as an RNAi agent. In some embodiments, the present disclosure defines certain structural attributes that may be particularly desirable and/or effective in an oligonucleotide that acts via an RNase H-dependent mechanism and/or other biochemical mechanism. In some embodiments, the present disclosure defines certain structural attributes that may be particularly desirable and/or effective in a single-stranded ssRNAi agent (ssRNAi or ssRNAi agent); in some such embodiments, as described further herein below, such structural attributes may be distinct from those that are particularly desirable and/or effective in a corresponding strand of a double-stranded RNAi agent (dsRNAi or dsRNAi agent). In some embodiments, provided oligonucleotides are single-stranded RNAi agents (e.g., which can be loaded into RISC and/or can direct or enhance RISC-mediated target). In some embodiments, provided oligonucleotides are antisense oligonucleotides (e.g., which can be loaded into RNase H and/or direct or enhance RNase-H-mediated cleavage of a target and/or operate via a different biochemical mechanism).

In some embodiments (including in some single-stranded oligonucleotide embodiments), oligonucleotides that act as RNAi agents may have one or more different structural attributes and/or functional properties from those oligonucleotides that act via an RNase H-dependent mechanism. In some embodiments, an oligonucleotide can direct a decrease in the expression and/or level of a target gene or its gene product by sterically blocking translation after binding to a target gene mRNA, and/or by altering or interfering with mRNA splicing and/or exon inclusion or exclusion (e.g., skipping). In some embodiments, an oligonucleotide can perform a function, or a significant percentage of a function (for example, 10-100%, no less than 10%, 20%, 30%, 40%, 50%, 60%, 70%, 80%, 90% percent or more) independent of RNA interference or RISC.

In some embodiments, a provided oligonucleotide is an antisense oligonucleotide (ASO) which directs cleavage of a target RNA mediated by RNase H and not RISC (RNA interference silencing complex).

In some embodiments, a provided oligonucleotide is a single-stranded RNAi (ssRNAi) agent which directs cleavage of a target mRNA mediated by the RISC (RNA interference silencing complex) and not the enzyme RNase H. In some embodiments, an oligonucleotide can perform a function, or a significant percentage of a function (for example, 10-100%, no less than 10%, 20%, 30%, 40%, 50%, 60%, 70%, 80%, 90% percent or more) independent of RNase H.

A double-stranded RNAi agent can also direct cleavage of a target mRNA using RISC and not the enzyme RNase H. In some embodiments, a single-stranded RNAi agent differs from a double-stranded RNAi agent in that a ssRNAi agent includes only a single oligonucleotide strand and generally does not comprise a double-stranded region of significant length, and a dsRNAi agent comprises a double stranded region of significant length (e.g., at least about 15 bp, or about 19 bp in a "canonical" siRNA). In some embodiments, a dsRNAi comprises two separate, complementary strands (which are not covalently linked) which form a double-stranded region (e.g., in a "canonical" siRNA), or a long single strand which comprises two complementary sequences which together form a double-stranded region (e.g., in a shRNA or short hairpin RNA). In some embodiments of a dsRNAi, the passenger strand has a single-stranded nick, forming two strands. In some embodiments, the present disclosure demonstrates that sequences and/or structural elements (chemical modifications, stereochemistry, etc.) required for efficacious single-stranded RNAi agents may differ from those required for efficacious double-stranded RNAi agents.

Among other things, the present disclosure encompasses the recognition that certain designs (e.g., sequences and/or structural elements) which may be suitable for double-stranded RNAi agents may not be suitable for single-stranded RNAi agents (including single-stranded RNAi agents of provided formats described herein), and vice versa. In some embodiments, the present disclosure provides designs for effective ssRNAi. In some embodiments, the present disclosure demonstrates that certain base sequences, when combined with structural elements (modifications, stereochemistry, additional chemical moiety or moieties, etc.) in accordance with the present disclosure, can provided oligonucleotides having unexpectedly high activities, for example, when administered as ssRNAi agents, particularly in comparison with oligonucleotides comprising the same sequences but double-stranded and administered as dsRNAi agents. In some embodiments, the present disclosure demonstrates that certain base sequences, when combined with structural elements (modifications, stereochemistry, additional chemical moiety or moieties, etc.) in accordance with the present disclosure, can provided oligonucleotides having unexpectedly high activities, for example, the ability to decrease the expression and/or level of a target gene or its gene product.

Structural and functional differences between single-stranded RNAi (ssRNAi) agents, double-stranded RNAi (dsRNAi) agents, and RNase H-dependent antisense oligonucleotides (ASOs)

In some embodiments, single-stranded RNAi (ssRNAi) agents, double-stranded RNAi (dsRNAi) agents and RNase H-dependent antisense oligonucleotides (ASOs) all involve binding of an agent or oligonucleotide (or portion thereof) to a complementary (or substantially complementary) target RNA (e.g., a mRNA or pre-mRNA), followed by cleavage of the target RNA and/or a decrease the expression and/or level of a target gene or its gene product. In some embodiments, RNAi agents, whether double- or single-stranded, employ the RISC, or RNA interference silencing complex, which includes the enzyme Ago-2 (Argonaute-2). In some embodiments, RNase H-dependent antisense oligonucleotides are single-stranded and employ a different enzyme, RNase H. RNAse H is reportedly a cellular endonuclease which cleaves the RNA strand of an RNA:DNA duplex; see U.S. Pat. No. 7,919,472. See also, Saetrom (2004 Bioinformatics 20: 3055-3063); Kretschmer-Kazemi Far et al. (2003 Nucleic Acids 31: 4417-4424); Bertrand et al. (2002) Biochem. Biophys. Res. Comm. 296: 1000-1004); Vickers et al. (2003 J. Biol. Chem. 278: 7108). In some embodiments, oligonucleotides that can direct RNase H-mediated knockdown include, but are not limited to, those consisting of or comprising a region of consecutive 2'-deoxy nucleotide units which contain no 2'-modifications. In some embodiments, oligonucleotides that can direct RNase H-mediated knockdown are gap-widened oligonucleotides or gapmers. In some embodiments, a gapmer comprises an internal region comprises a plurality of nucleotides that supports RNase H cleavage and is positioned between external regions having a plurality of nucleotides that are chemically distinct from the nucleosides of the internal region. In some embodiments, a gapmer comprise a span of 2'-deoxy nucleotides containing no 2'-modifications, flanked or adjacent to one or two wings. In some embodiments, a gap directs RNase H cleavage of the corresponding RNA target. In some embodiments, the wings do not direct or act as substrates for RNase H cleavage. The wings can be of varying lengths (including, but not limited to, 1 to 8 nt) and can comprise various modifications or analogs (including, but not limited to, 2'-modifications, including, but not limited to, 2'-OMe and 2'-MOE). See, as non-limiting examples, U.S. Pat. Nos. 9,550,988; 7,919,472; 5,013,830; 5,149,797; 5,220,007; 5,256,775; 5,366,878; 5,403,711; 5,491,133; 5,565,350; 5,623,065; 5,652,355; 5,652,356; and 5,700,922. In some embodiments, presence of one or more such modifications or analogs may correlate with modified (e.g., increased, reduced, or altered) RNase H cleavage of a target.

In some embodiments, double-stranded RNAi agents, even the antisense strand thereof, differ structurally from a RNase H-dependent antisense oligonucleotide. In some embodiments, RNase H-dependent antisense oligonucleotides and siRNA oligonucleotides seem to have completely opposite characteristics, both regarding 5'-end structures and overall duplex stability.

Double-stranded RNAi agents can reportedly be naturally-produced in a cell by the Dicer enzyme, which cleaves larger RNA molecules, such as double-stranded RNA from invading viruses, into a dsRNA. The canonical structure of a dsRNA agent comprises two strands of RNA, each about 19 to 23 nt long, which are annealed to form an about 19-21 bp double-stranded region and two 3' dinucleotide overhangs. For a double-stranded RNAi agent, the sense strand is reportedly unwound from the duplex before the antisense strand is incorporated into RISC. Aside from the natural separation of a double-stranded RNAi agent into antisense and sense strands, single-stranded RNAi agents have not been reported to be naturally produced in a human cell.

Among other things, the present disclosure provides teaching that, in many cases, a single-stranded RNAi agent is not simply an isolated antisense strand of a double-stranded RNAi agent in that, for example, an antisense strand of an effective dsRNAi agent may be much less effective than the dsRNAi agent, and a ssRNAi agent, when formulated as a dsRNAi agent (for example, by annealing with a sense strand), may be much less effective than the ssRNAi agent. In some embodiments, double-stranded and single-stranded RNAi agents differ in many significant ways. Structural parameters of double-stranded RNAi agents are not necessarily reflected in single-stranded RNAi agents.

In some embodiments, the present disclosure teaches that target sequences which are suitable for double-stranded RNAi agents may not be suitable for single-stranded RNAi agents, and vice versa. For example, in at least some cases, single-stranded versions of double-stranded RNAi agents may not be efficacious. As a non-limiting example, Table 46A shows that several ssRNAi agents were constructed with sequences derived from dsRNAi. These ssRNAi based on dsRNAi were generally less efficacious than the corresponding dsRNAi.

In some embodiments, double-stranded and single-stranded RNAi agents also differ in their sensitivity to incorporation of chirally controlled internucleotidic linkages. For example, Matranga et al. (2005 Cell 123: 607-620) reported that introduction of a single Sp internucleotidic linkage (e.g., a single Sp PS) into the sense strand of a double-stranded RNAi agent greatly decreased RISC assembly and RNA interference activity. In contrast, in some embodiments, data shown herein demonstrate that, surprisingly, incorporation of a Sp internucleotidic linkage)(e.g., Sp PS) can perform two functions for a single-stranded RNAi agent: (a) it increases stability against nucleases; and (b) does not interfere with RNA interference activity. Many example oligonucleotides can perform as efficacious single-stranded RNAi agents comprising one or more chirally controlled internucleotidic linkages (e.g., Sp internucleotidic linkages, or Sp PS (phosphorothioate) are shown herein).

Alternatively or additionally, in some embodiments, double-stranded and single-stranded RNAi agents differ in their maximum GC content. In some embodiments, a double-stranded RNAi agent is more limited, for example, in its GC content, as too high a GC content interferes with duplex unwinding, as reported in, for example, U.S. Pat. No. 7,507,811 to Khvorova et al., which reports that a double-stranded RNAi agent can have a GC content up to 52%. In contrast, in some embodiments, data shown herein shows that efficacious single-stranded RNAi agents can have a GC content of up to 70%. Among other things, some target sequences with a GC content of up to 70% may be explorable for use as ssRNAi while not suitable for dsRNAi.

Alternatively or additionally, double-stranded and single-stranded RNAi agents can differ in the maximum length of a GC span. For example, Naito et al. 2004 Nucl. Acids Res. 32: W124-W129 reported a rule indicating that highly effective double-stranded RNAi agents should lack a GC stretch over 9 bp in length. In some embodiments, the present disclosure shows examples of efficacious single-stranded RNAi agents comprising GC stretches of up to 11 in length.

Alternatively or additionally, double-stranded and single-stranded RNAi agents can differ in immunogenicity. In some embodiments, some single-stranded RNAi agents are reportedly more immunogenic than double-stranded RNAi agents. Sioud J. Mol. Biol. (2005) 348, 1079-1090. In some embodiments, several double-stranded RNAi agents reportedly did not induce an immune response, whereas corresponding single-stranded RNAi agents did. In some embodiments, the present disclosure provides oligonucleotides with low immunogenicity. In some embodiments, such oligonucleotides can be utilized as ssRNAi reagent.

Among other things, the present disclosure encompasses the recognition that certain conventional designs of single-stranded RNAi agents, which derive single-stranded RNAi agents, including base sequences, from double-stranded RNAi agents, often fail to provide effective single-stranded RNAi agents. In some embodiments, the present disclosure demonstrates that, surprisingly, ssRNAi agents derived from base sequences of effective RNase H-dependent ASOs can produce efficacious ssRNAi agents (see Table 46A).

In some embodiments, the present disclosure provides oligonucleotides which can be utilized as efficacious RNase-H dependent ASOs, which comprise regions of 2'-deoxy nucleotides without 2'-modifications, and which are complementary or substantially complementary to RNA sequences or portions thereof. In some embodiments, a region can be, for example, a core sequence of about 10 nt flanked on one or both sides by wings, wherein the wings differ from the core in chemistry and can comprise, as non-limiting examples, 2'-modifications or internucleotidic linkage modifications.

Oligonucleotides

In some embodiments, provided oligonucleotides can direct a decrease in the expression and/or level of a target gene or its gene product. In some embodiments, provided oligonucleotides can direct a decrease in the expression and/or level of a target gene or its gene product via RNA interference. In some embodiments, provided oligonucleotides can direct a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides can direct a decrease in the expression and/or level of a target gene or its gene product via RNA interference and/or RNase H-mediated knockdown. In some embodiments, provided oligonucleotides can direct a decrease in the expression and/or level of a target gene or its gene product by sterically blocking translation after binding to a target gene mRNA, and/or by altering or interfering with mRNA splicing and/or exon inclusion or exclusion.

In some embodiments, a provided oligonucleotide has a structural element or format or portion thereof described herein.

In some embodiments, a provided oligonucleotide capable of directing a decrease in the expression and/or level of a target gene or its gene product has a structural element or format or portion thereof described herein.

In some embodiments, a provided oligonucleotide capable of directing a decrease in the expression and/or level of a target gene or its gene product has the format of any oligonucleotide disclosed herein, e.g., in Table 1A, or in the Figures or Tables, or otherwise disclosed herein.

Figure 1F:
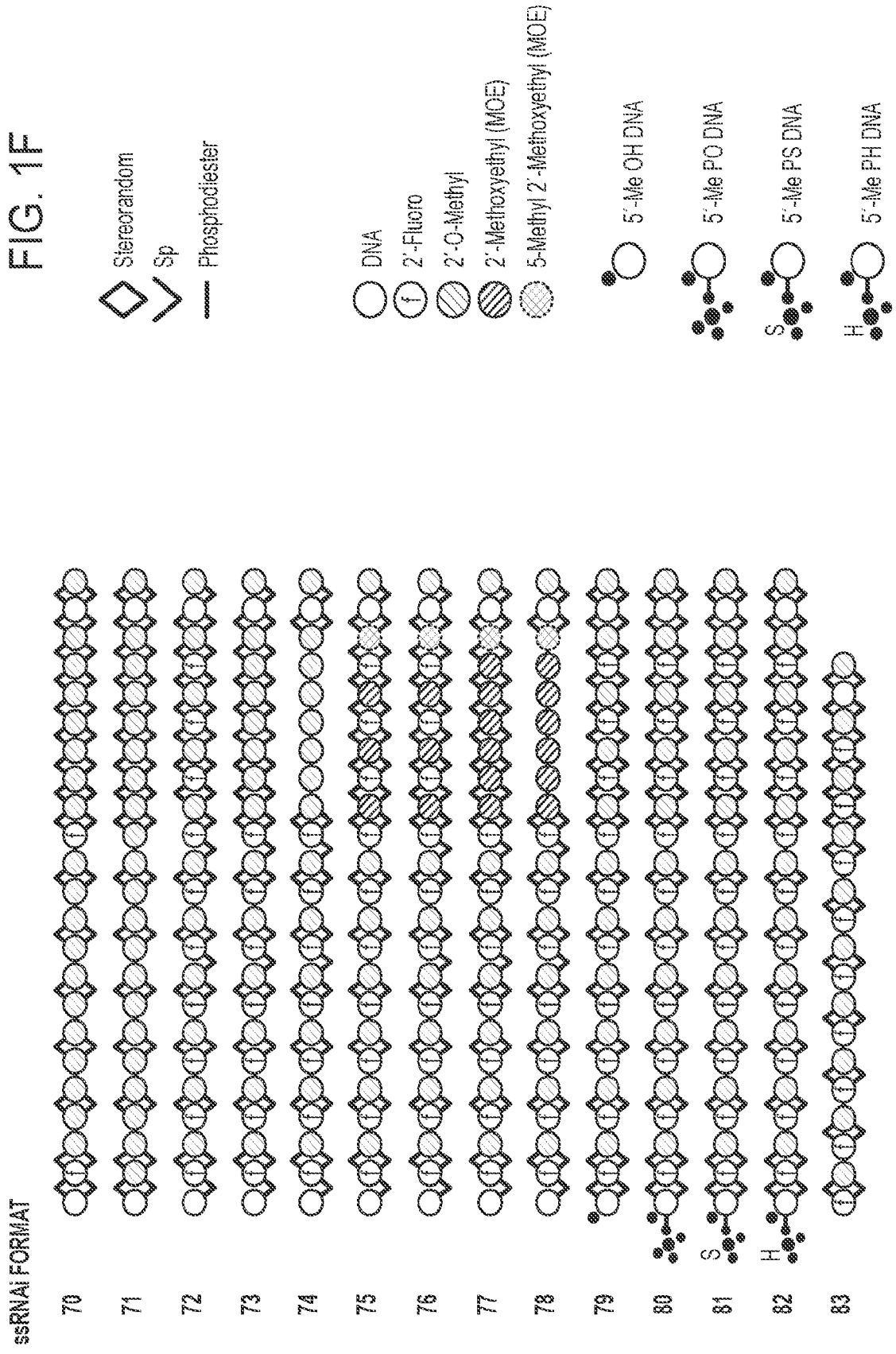

In some embodiments, a provided oligonucleotide has any of Formats illustrated in FIG. 1.

The present disclosure presents data showing that various oligonucleotides of various formats are capable of directing a decrease in the expression and/or level of a target gene or its gene product targeted against any of multiple different sequences, in multiple different genes, in multiple different species; additional data was generated supporting the efficacy of ssRNAi agents of the disclosed Formats and not shown.

In some embodiments, a provided oligonucleotide capable of directing RNase H-mediated knockdown has a structural element or format or portion thereof described herein.

In some embodiments, a provided oligonucleotide capable of directing RNase H-mediated knockdown has the format of any oligonucleotide disclosed herein, e.g., in Table 1A or in the Figures or Tables, or otherwise disclosed herein.

In some embodiments, a provided oligonucleotide has any of Formats illustrated in FIG. 1.

The present disclosure presents data showing that various oligonucleotides of various formats are capable of directing RNase H-mediated knockdown against any of multiple different sequences, in multiple different genes, in multiple different species; additional data was generated supporting the efficacy of ssRNAi agents of the disclosed Formats and not shown.

In some embodiments, a provided oligonucleotide capable of directing single-stranded RNA interference has a structural element or format or portion thereof described herein.

In some embodiments, a provided oligonucleotide capable of directing single-stranded RNA interference has the format of any oligonucleotide disclosed herein, e.g., in Table 1A or in the Figures or Tables, or otherwise disclosed herein.

In some embodiments, a provided single-stranded RNAi agent has any of the Formats illustrated in FIG. 1.

The present disclosure presents data showing that various RNAi agents of various formats are capable of directing RNA interference against any of multiple different sequences, in any of multiple different genes; additional data was generated supporting the efficacy of ssRNAi agents of the disclosed Formats and not shown.

In some embodiments, a target of RNAi is a transcript. In some embodiments, a transcript is pre-mRNA. In some embodiments, a transcript is mature RNA. In some embodiments, a transcript is mRNA. In some embodiments, a transcript comprises a mutation. In some embodiments, a mutation is a frameshift. In some embodiments, a transcript comprises a premature termination codon. In some embodiments, a target of RNAi is a RNA which is not a mRNA. In some embodiments, a target of RNAi is a non-coding RNA. In some embodiments, a target of RNAi is a long non-coding RNA. In some embodiments, provided oligonucleotides in provided compositions, e.g., oligonucleotides of a first plurality, comprise base modifications, sugar modifications, and/or internucleotidic linkage modifications. In some embodiments, provided oligonucleotides comprise base modifications and sugar modifications. In some embodiments, provided oligonucleotides comprise base modifications and internucleotidic linkage modifications. In some embodiments, provided oligonucleotides comprise sugar modifications and internucleotidic modifications. In some embodiments, provided compositions comprise base modifications, sugar modifications, and internucleotidic linkage modifications. Example chemical modifications, such as base modifications, sugar modifications, internucleotidic linkage modifications, etc. are widely known in the art including but not limited to those described in this disclosure. In some embodiments, a modified base is substituted A, T, C, G or U. In some embodiments, a sugar modification is 2'-modification. In some embodiments, a 2'-modification is 2-F modification. In some embodiments, a 2'-modification is 2'—OR'. In some embodiments, a 2'-modification is 2'—OR', wherein $R^1$ is optionally substituted alkyl. In some embodiments, a 2'-modification is 2'-OMe. In some embodiments, a 2'-modification is 2'-MOE. In some embodiments, a modified sugar moiety is a bridged bicyclic or polycyclic ring. In some embodiments, a modified sugar moiety is a bridged bicyclic or polycyclic ring having 5-20 ring atoms wherein one or more ring atoms are optionally and independently heteroatoms. Example ring structures are widely known in the art, such as those found in BNA, LNA, etc. In some embodiments, provided oligonucleotides comprise both one or more modified internucleotidic linkages and one or more natural phosphate linkages. In some embodiments, oligonucleotides comprising both modified internucleotidic linkage and natural phosphate linkage and compositions thereof provide improved properties, e.g., activities, etc. In some embodiments, a modified internucleotidic linkage is a chiral internucleotidic linkage. In some embodiments, a modified internucleotidic linkage is a phosphorothioate linkage. In some embodiments, a modified internucleotidic linkage is a substituted phosphorothioate linkage.

Among other things, the present disclosure encompasses the recognition that stereorandom oligonucleotide preparations contain a plurality of distinct chemical entities that differ from one another, e.g., in the stereochemical structure of individual backbone chiral centers within the oligonucleotide chain. Without control of stereochemistry of backbone chiral centers, stereorandom oligonucleotide preparations provide uncontrolled compositions comprising undetermined levels of oligonucleotide stereoisomers. Even though these stereoisomers may have the same base sequence, they are different chemical entities at least due to their different backbone stereochemistry, and they can have, as demonstrated herein, different properties, e.g., activities, etc. Among other things, the present disclosure provides new compositions that are or contain particular stereoisomers of oligonucleotides of interest. In some embodiments, a particular stereoisomer may be defined, for example, by its base sequence, its length, its pattern of backbone linkages, and its pattern of backbone chiral centers. As is understood in the art, in some embodiments, base sequence may refer to the identity and/or modification status of nucleoside residues (e.g., of sugar and/or base components, relative to standard naturally occurring nucleotides such as adenine, cytosine, guanosine, thymine, and uracil) in an oligonucleotide and/or to the hybridization character (i.e., the ability to hybridize with particular complementary residues) of such residues. In some embodiments, the present disclosure provide an oligonucleotide composition comprising a predetermined level of oligonucleotides of an individual oligonucleotide type which are chemically identical, e.g., they have the same base sequence, the same pattern of nucleoside modifications (modifications to sugar and base moieties, if any), the same pattern of backbone chiral centers, and the same pattern of backbone phosphorus modifications. The present disclosure demonstrates, among other things, that individual stereoisomers of a particular oligonucleotide can show different stability and/or activity from each other. In some embodiments, property improvements achieved through inclusion and/or location of particular chiral structures within an oligonucleotide can be comparable to, or even better than those achieved through use of particular backbone linkages, residue modifications, etc. (e.g., through use of certain types of modified phosphates [e.g., phosphorothioate, substituted phosphorothioate, etc.], sugar modifications [e.g., 2'-modifications, etc.], and/or base modifications [e.g., methylation, etc.]). Among other things, the present disclosure recognizes that, in some embodiments, properties (e.g., activities, etc.) of an oligonucleotide can be adjusted by optimizing its pattern of backbone chiral centers, optionally in combination with adjustment/optimization of one or more other features (e.g., linkage pattern, nucleoside modification pattern, etc.) of the oligonucleotide. As exemplified by various examples in the present disclosure, provided chirally controlled oligonucleotide compositions can demonstrate improved properties, e.g., improved single-stranded RNA interference activity, RNase H-mediated knockdown, improved delivery, etc.

In some embodiments, oligonucleotide properties can be adjusted by optimizing stereochemistry (pattern of backbone chiral centers) and chemical modifications (modifications of base, sugar, and/or internucleotidic linkage) or patterns thereof.

In some embodiments, a pattern of backbone chiral centers provides increased stability. In some embodiments, a pattern of backbone chiral centers provides surprisingly increased activity. In some embodiments, a pattern of backbone chiral centers provides increased stability and activity. In some embodiments, a pattern of backbone chiral centers provides surprisingly increased binding to certain proteins. In some embodiments, a pattern of backbone chiral centers provides surprisingly enhanced delivery. In some embodiments, a pattern of backbone chiral centers comprises or is (Sp)m(Rp)n, (Rp)n(Sp)m, (Np)t(Rp)n(Sp)m, or (Sp)t(Rp)n(Sp)m. In some embodiments, a pattern of backbone chiral centers comprises or is (Rp)n(Sp)m, (Np)t(Rp)n(Sp)m, or (Sp)t(Rp)n(Sp)m, wherein m>2. In some embodiments, a pattern of backbone chiral centers comprises or is (Rp)n(Sp)m, (Np)t(Rp)n(Sp)m, or (Sp)t(Rp)n(Sp)m, wherein n is 1, t>1, and m>2. In some embodiments, m>3. In some embodiments, m>4. In some embodiments, a pattern of backbone chiral centers comprises one or more achiral natural phosphate linkages.

In some embodiments, a pattern of backbone chiral centers comprises or is (Rp)n(Sp)m, (Sp)t(Rp)n, (Np)t(Rp)n(Sp)m, (Sp)t(Sp)m or (Sp)t(Rp)n(Sp)m. In some embodiments, a pattern of backbone chiral centers comprises or is (Rp)n(Sp)m, (Sp)t(Rp)n, (Np)t(Rp)n(Sp)m, or (Sp)t(Rp)n(Sp)m, and the oligonucleotides comprises one or more 2'-modifications as described herein. In some embodiments, a pattern of backbone chiral centers comprises or is (Rp)n (Sp)m, (Sp)t(Rp)n, (Np)t(Rp)n(Sp)m, or (Sp)t(Rp)n(Sp)m, and the oligonucleotides comprises one or more 2'-F modifications as described herein. In some embodiments, a pattern of backbone chiral centers comprises or is (Rp)n(Sp) m, (Sp)t(Rp)n, (Np)t(Rp)n(Sp)m, or (Sp)t(Rp)n(Sp)m, and the oligonucleotides comprises one or more 2'—OR modifications as described herein. In some embodiments, a pattern of backbone chiral centers comprises or is (Rp)n(Sp) m. In some embodiments, a pattern of backbone chiral centers comprises or is (Sp)t(Rp)n. In some embodiments, a pattern of backbone chiral centers comprises or is (Np)t(Rp) n(Sp)m. In some embodiments, a pattern of backbone chiral centers comprises or is (Sp)t(Sp)m, optionally with n achiral phosphate diester internucleotidic linkages and/or stereorandom (non-chirally controlled) chiral internucleotidic linkages between the section having (Sp)t and the section having (Sp)m. In some embodiments, there are n achiral phosphate diester internucleotidic linkages in between. In some embodiments, there are n stereorandom chiral internucleotidic linkages in between. In some embodiments, a pattern of backbone chiral centers comprises or is (Sp)t(Rp)n(Sp)m. In some embodiments, each of t and m is independently equal to or greater than 1, 2, 3, 4, 5, 6, 7, 8, 9, 10, 11, 12, 13, 14, 15, 16, 17, 18, 19 or 20.

In some embodiments, a common pattern of backbone chiral centers (e.g., a pattern of backbone chiral centers in a single-stranded RNAi agent) comprises a pattern of $i^o$-$i^s$-$i^o$-$i^s$-$i^o$, $i^o$-$i^s$-$i^s$-$i^s$-$i^o$, $i^o$-$i^s$-$i^s$-$i^s$-$i^o$-$i^s$, $i^s$-$i^o$-$i^s$-$i^o$, $i^s$-$i^o$-$i^s$-$i^o$, $i^s$-$i^o$-$i^s$-$i^o$-is $i^s$- $i^o$-$i^s$-$i^o$-$i^s$-$i^o$, $i^s$-$i^o$-$i^s$-$i^o$-$i^s$-$i^o$-$i^s$-$i^o$, $i^s$-$i^o$-$i^s$-$i^s$-$i^s$-$i^o$, $i^s$-$i^s$-$i^o$-$i^s$-$i^s$-$i^o$-$i^s$-$i^s$, $i^s$-$i^s$-$i^s$-$i^s$-$i^o$-$i^s$-$i^o$-$i^s$-$i^s$-, $i^s$-$i^s$, $i^s$-$i^s$-$i^s$-$i^s$, $i^s$-$i^s$-$i^s$-$i^s$-$i^s$, $i^s$-$i^s$-$i^s$-$i^s$-$i^s$-$i^s$, $i^s$-$i^s$-$i^s$-$i^s$-$i^s$-$i^s$, $i^s$-$i^s$-$i^s$-$i^s$-$i^s$-$i^s$-$i^s$-$i^s$, or $i^r$- $i^r$-$i^r$, wherein $i^s$ represents an internucleotidic linkage in the Sp configuration; $i^o$ represents an achiral internucleotidic linkage; and $i^r$ represents an internucleotidic linkage in the Rp configuration.

In some embodiments, a common pattern of backbone chiral centers (e.g., a pattern of backbone chiral centers in a single-stranded RNAi agent) comprises a pattern of OSOSO, OSSSO, OSSSOS, SOSO, SOSO, SOSOS, SOSOSO, SOSOSOSO, SOSSSO, SSOSSSOSS, SSSOSOSSS, SSSSOSOSSSS, SSSSS, SSSSSS, SSSSSSS, SSSSSSSS, SSSSSSSSS, or RRR, wherein S represents a phosphorothioate in the Sp configuration, and O represents a phosphodiester. wherein R represents a phosphorothioate in the Rp configuration.

In some embodiments, the non-chiral center is a phosphodiester linkage. In some embodiments, the chiral center in a Sp configuration is a phosphorothioate linkage. In some embodiments, the non-chiral center is a phosphodiester linkage. In some embodiments, the chiral center in a Sp configuration is a phosphorothioate linkage.

In some embodiments, provided oligonucleotides comprise at least two pairs of alternating phosphodiester and phosphorothioate internucleotidic linkages. In some embodiments, provided oligonucleotides comprise at least 3 pairs of alternating phosphodiester and phosphorothioate internucleotidic linkages. In some embodiments, provided oligonucleotides comprise at least two pairs of alternating phosphodiester and phosphorothioate internucleotidic linkages; and further comprise a block comprising 5 or more consecutive phosphorothioate internucleotidic linkages, wherein at least one phosphorothioate linkage is chirally controlled. In some embodiments, provided oligonucleotides comprise at least two pairs of alternating phosphodiester and phosphorothioate internucleotidic linkages; and further comprise a block comprising 3, 4, 5, 6, 7 or more consecutive phosphorothioate internucleotidic linkages, wherein at least one phosphorothioate linkage is chirally controlled. In some embodiments, provided oligonucleotides comprise at least 5 pairs of alternating phosphodiester and phosphorothioate internucleotidic linkages; and further comprise a block comprising 3, 4, 5, 6, 7 or more consecutive phosphorothioate internucleotidic linkages, wherein at least one phosphorothioate linkage is chirally controlled. In some embodiments, provided oligonucleotides comprise at least 6 pairs of alternating phosphodiester and phosphorothioate internucleotidic linkages; and further comprise a block comprising 3, 4, 5, 6, 7 or more consecutive phosphorothioate internucleotidic linkages, wherein at least one phosphorothioate linkage is chirally controlled. In some embodiments, provided oligonucleotides comprise at least two pairs of alternating phosphodiester and phosphorothioate internucleotidic linkages; and further comprise a block comprising 5 or more consecutive phosphodiester internucleotidic linkages, wherein at least one phosphorothioate linkage is chirally controlled. In some embodiments, provided oligonucleotides comprise one or more natural phosphate linkages and one or more modified internucleotidic linkages. Provided oligonucleotides can comprise various number of natural phosphate linkages.

In some embodiments, provided oligonucleotides comprise no natural phosphate linkages. In some embodiments, provided oligonucleotides comprise one natural phosphate linkage. In some embodiments, provided oligonucleotides comprise 2 or more natural phosphate linkages. In some embodiments, provided oligonucleotides comprise 3 or more natural phosphate linkages. In some embodiments, provided oligonucleotides comprise 4 or more natural phosphate linkages. In some embodiments, provided oligonucleotides comprise 5 or more natural phosphate linkages. In some embodiments, provided oligonucleotides comprise 6 or more natural phosphate linkages. In some embodiments, provided oligonucleotides comprise 7 or more natural phosphate linkages. In some embodiments, provided oligonucleotides comprise 8 or more natural phosphate linkages. In some embodiments, provided oligonucleotides comprise 9 or more natural phosphate linkages. In some embodiments, provided oligonucleotides comprise 10 or more natural phosphate linkages. In some embodiments, provided oligonucleotides comprise 15 or more natural phosphate linkages. In some embodiments, provided oligonucleotides comprise 20 or more natural phosphate linkages. In some embodiments, provided oligonucleotides comprise 25 or more natural phosphate linkages. In some embodiments, provided oligonucleotides comprise 30 or more natural phosphate linkages. In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, 5% or more of the internucleotidic linkages of provided oligonucleotides are natural phosphate linkages. In some embodiments, 10% or more of the internucleotidic linkages of provided oligonucleotides are natural phosphate linkages. In some embodiments, 15% or more of the internucleotidic linkages of provided oligonucleotides are natural phosphate linkages. In some embodiments, 20% or more of the internucleotidic linkages of provided oligonucleotides are natural phosphate linkages. In some embodiments, 25% or more of the internucleotidic linkages of provided oligonucleotides are natural phosphate linkages. In some embodiments, 30% or more of the internucleotidic linkages of provided oligonucleotides are natural phosphate linkages. In some embodiments, 35% or more of the internucleotidic linkages of provided oligonucleotides are natural phosphate linkages. In some embodiments, 40% or more of the internucleotidic linkages of provided oligonucleotides are natural phosphate linkages In some embodiments, 5% or more of the internucleotidic linkages of provided oligonucleotides are modified internucleotidic linkages. In some embodiments, 10% or more of the internucleotidic linkages of provided oligonucleotides are modified internucleotidic linkages. In some embodiments, 15% or more of the internucleotidic linkages of provided oligonucleotides are modified internucleotidic linkages. In some embodiments, 20% or more of the internucleotidic linkages of provided oligonucleotides are modified internucleotidic linkages. In some embodiments, 25% or more of the internucleotidic linkages of provided oligonucleotides are modified internucleotidic linkages. In some embodiments, 30% or more of the internucleotidic linkages of provided oligonucleotides are modified internucleotidic linkages. In some embodiments, 35% or more of the internucleotidic linkages of provided oligonucleotides are modified internucleotidic linkages. In some embodiments, 40% or more of the internucleotidic linkages of provided oligonucleotides are modified internucleotidic linkages. In some embodiments, provided oligonucleotides can bind to a transcript, and improve single-stranded RNA interference of the transcript. In some embodiments, provided oligonucleotides improve single-stranded RNA interference, with efficiency greater than a comparable oligonucleotide under one or more suitable conditions.

In some embodiments, a provided improved single-stranded RNA interference is at least 10%, 20%, 30%, 40%, 50%, 60%, 70%, 80%, 90%, 100%, 110%, 120%, 130%, 140%, 150%, 160%, 170%, 180%, 190% more than, or 2, 3, 4, 5, 6, 7, 8, 9, 10, 11, 12, 13, 14, 15, 16, 17, 18, 19, 20, 30, 40, 50 or more fold of, that of a comparable oligonucleotide under one or more suitable conditions.

In some embodiments, expression or level of a target gene or its gene product is decreased by at least about 10%, 15%, 20%, 25%, 30%, 35%, 40%, 45%, 50%, 60%, 70%, or 80% by administration of an oligonucleotide. In some embodiments, expression or level of a target gene or its gene product is decreased by at least about 10%, 15%, 20%, 25%, 30%, 35%, 40%, 45%, 50%, 60%, 70%, or 80% total by RNase H-mediated knockdown and/or RNA interference directed by an oligonucleotide. In some embodiments, expression or level of a target gene or its gene product is decreased by at least about 10%, 15%, 20%, 25%, 30%, 35%, 40%, 45%, 50%, 60%, 70%, or 80% total by RNase H-mediated knockdown and/or RNA interference directed by an oligonucleotide at a concentration of 5 nm or less in a cell(s) in vitro. In some embodiments, a cell(s) is a mammalian cell(s). In some embodiments, a cell(s) is a human cell(s). In some embodiments, a cell(s) is a hepatic cell(s). In some embodiments, a cell(s) is a Huh7 or Hep3B cell(s). In some embodiments, a single-stranded RNAi agent is capable of decreasing expression or level of a target gene or its gene product by at least about 20% in a cell(s) in vitro at a concentration of 25 nM or less. In some embodiments, a single-stranded RNAi agent is capable of decreasing expression or level of a target gene or its gene product by at least about 50% in a cell(s) in vitro at a concentration of 25 nM or less. In some embodiments, an oligonucleotide is capable of decreasing expression or level of a target gene or its gene product by at least about 20% in a cell(s) in vitro at a concentration of 25 nM or less. In some embodiments, an oligonucleotide is capable of decreasing expression or level of a target gene or its gene product by at least about 50% in a cell(s) in vitro at a concentration of 25 nM or less. In some embodiments, IC50 is inhibitory concentration to decrease expression or level or a target gene or its gene product by 50% in a cell(s) in vitro. In some embodiments, a single-stranded RNAi agent has an IC50 of no more than about 10 nM in a cell(s) in vitro. In some embodiments, a single-stranded RNAi agent has an IC50 of no more than about 2 nM in a cell(s) in vitro. In some embodiments, an oligonucleotide has an IC50 of no more than about 10 nM in a cell(s) in vitro. In some embodiments, an oligonucleotide has an IC50 of no more than about 2 nM in a cell(s) in vitro.

In some embodiments, the present disclosure provides an oligonucleotide, e.g., a single-stranded RNAi agent of an oligonucleotide type whose pattern of backbone chiral centers comprises (Sp)mRp or Rp(Sp)m. In some embodiments, the present disclosure provides a single-stranded RNAi agent of an oligonucleotide type whose pattern of backbone chiral centers comprises Rp(Sp)m. In some embodiments, the present disclosure provides a single-stranded RNAi agent of an oligonucleotide type whose pattern of backbone chiral centers comprises (Sp)mRp. In some embodiments, m is 2. In some embodiments, the present disclosure provides a single-stranded RNAi agent of an oligonucleotide type whose pattern of backbone chiral centers comprises Rp(Sp)$_2$. In some embodiments, the present disclosure provides a single-stranded RNAi agent of an oligonucleotide type whose pattern of backbone chiral centers comprises (Sp)$_2$Rp(Sp)$_2$. In some embodiments, the present disclosure provides a single-stranded RNAi agent of an oligonucleotide type whose pattern of backbone chiral centers comprises (Rp)$_2$Rp(Sp)$_2$. In some embodiments, the present disclosure provides a single-stranded RNAi agent of an oligonucleotide type whose pattern of backbone chiral centers comprises RpSpRp(Sp)$_2$. In some embodiments, the present disclosure provides a single-stranded RNAi agent of an oligonucleotide type whose pattern of backbone chiral centers comprises SpRpRp(Sp)$_2$. In some embodiments, the present disclosure provides a single-stranded RNAi agent of an oligonucleotide type whose pattern of backbone chiral centers comprises (Sp)$_2$Rp.

As defined herein, m is 1-50. In some embodiments, m is 1. In some embodiments, m is 2-50. In some embodiments, m is 2, 3, 4, 5, 6, 7 or 8. In some embodiments, m is 3, 4, 5, 6, 7 or 8. In some embodiments, m is 4, 5, 6, 7 or 8. In some embodiments, m is 5, 6, 7 or 8. In some embodiments, m is 6, 7 or 8. In some embodiments, m is 7 or 8. In some embodiments, m is 2. In some embodiments, m is 3. In some embodiments, m is 4. In some embodiments, m is 5. In some embodiments, m is 6. In some embodiments, m is 7. In some embodiments, m is 8. In some embodiments, m is 9. In some embodiments, m is 10. In some embodiments, m is 11. In some embodiments, m is 12. In some embodiments, m is 13. In some embodiments, m is 14.

In some embodiments, m is 15. In some embodiments, m is 16. In some embodiments, m is 17. In some embodiments, m is 18. In some embodiments, m is 19. In some embodiments, m is 20. In some embodiments, m is 21. In some embodiments, m is 22. In some embodiments, m is 23. In some embodiments, m is 24. In some embodiments, m is 25. In some embodiments, m is greater than 25.

In some embodiments, a provided oligonucleotide comprises any pattern of stereochemistry described herein. In some embodiments, a provided oligonucleotide comprises any pattern of stereochemistry described herein and is capable of directing RNA interference. In some embodiments, a provided oligonucleotide comprises any pattern of stereochemistry described herein and is capable of directing RNase H-mediated knockdown. In some embodiments, a provided oligonucleotide comprises any pattern of stereochemistry described herein and is capable of directing RNA interference and RNase H-mediated knockdown. In some embodiments, a provided oligonucleotide comprises any pattern of stereochemistry described herein and is capable of directing RNA interference, wherein the pattern of stereochemistry is in the seed and/or post-seed region. In some embodiments, a provided oligonucleotide comprises any pattern of stereochemistry described herein and is capable of directing RNA interference and RNase H-mediated knockdown, wherein the pattern of stereochemistry is in the seed and/or post-seed region.

In some embodiments, a provided oligonucleotide comprises any modification or pattern of modification described herein. In some embodiments, a provided oligonucleotide comprises any modification or pattern of modification described herein and is capable of directing RNA interference. In some embodiments, a provided oligonucleotide comprises any pattern of modification described herein and is capable of directing RNase H-mediated knockdown. In some embodiments, a provided oligonucleotide comprises any pattern of modification described herein and is capable of directing RNA interference and RNase H-mediated knockdown. In some embodiments, a provided oligonucleotide comprises any pattern of modification described herein and is capable of directing RNA interference, wherein the pattern of modification is in the seed and/or post-seed region. In some embodiments, a provided oligonucleotide comprises any pattern of modification described herein and is capable of directing RNA interference and RNase H-mediated knockdown, wherein the pattern of modification is in the seed and/or post-seed region. In some embodiments, a modification or pattern of modification is a modification or pattern of modifications at the 2' position of a sugar. In some embodiments, a modification or pattern of modification is a modification or pattern of modifications of sugars, e.g., at the 2' position of a sugar, including but not limited to, 2'-deoxy, 2'-F, 2'-OMe, 2'-MOE, and 2'—OR1, wherein R1 is optionally substituted $C_{1-6}$ alkyl.

In some embodiments, the present disclosure demonstrates that 2'-F modifications, among other things, can improve single-stranded RNA interference. In some embodiments, the present disclosure demonstrates that Sp internucleotidic linkages, among other things, at the 5'- and 3'-ends can improve oligonucleotide stability. In some embodiments, the present disclosure demonstrates that, among other things, natural phosphate linkages and/or Rp internucleotidic linkages can improve removal of oligonucleotides from a system. As appreciated by a person having ordinary skill in the art, various assays known in the art can be utilized to assess such properties in accordance with the present disclosure.

In some embodiments, provided oligonucleotides capable of directing single-stranded RNA interference comprise one or more modified sugar moieties. In some embodiments, 5% or more of the sugar moieties of provided oligonucleotides are modified.

In some embodiments, provided oligonucleotides comprise one or more modified sugar moieties. In some embodiments, 5%, 10%, 15%, 20%, 25%, 30%, 35%, 40%, 45%, 50%, 55%, 60%, 65%, 70%, 75%, 80%, 85%, 90%, 95% or more, or 100%, of the sugar moieties of provided oligonucleotides are modified. In some embodiments, a modified sugar moiety comprises a 2'-modification. In some embodiments, a modified sugar moiety comprises a 2'-modification. In some embodiments, a 2'-modification is 2'—OR'. In some embodiments, a 2'-modification is a 2'-OMe. In some embodiments, a 2'-modification is a 2'-MOE. In some embodiments, a 2'-modification is an LNA sugar modification. In some embodiments, a 2'-modification is 2'-F. In some embodiments, each sugar modification is independently a 2'-modification. In some embodiments, each sugar modification is independently 2'—OR' or 2'-F. In some embodiments, each sugar modification is independently 2'—OR' or 2'-F, wherein $R^1$ is optionally substituted $C_{1-6}$ alkyl. In some embodiments, each sugar modification is independently 2'—OR' or 2'-F, wherein at least one is 2'-F. In some embodiments, each sugar modification is independently 2'—OR' or 2'-F, wherein $R^1$ is optionally substituted $C_{1-6}$ alkyl, and wherein at least one is 2'—OR'. In some embodiments, each sugar modification is independently 2'—OR' or 2'-F, wherein at least one is 2'-F, and at least one is 2'—OR'. In some embodiments, each sugar modification is independently 2'—OR' or 2'-F, wherein $R^1$ is optionally substituted $C_{1-6}$ alkyl, and wherein at least one is 2'-F, and at least one is 2'—OR'.

In some embodiments, a nucleoside comprising a 2'-modification is followed by a modified internucleotidic linkage. In some embodiments, a nucleoside comprising a 2'-modification is preceded by a modified internucleotidic linkage. In some embodiments, a modified internucleotidic linkage is a chiral internucleotidic linkage. In some embodiments, a modified internucleotidic linkage is a phosphorothioate. In some embodiments, a chiral internucleotidic linkage is Sp. In some embodiments, a nucleoside comprising a 2'-modification is followed by an Sp chiral internucleotidic linkage. In some embodiments, a nucleoside comprising a 2'-F is followed by an Sp chiral internucleotidic linkage. In some embodiments, a nucleoside comprising a 2'-modification is preceded by an Sp chiral internucleotidic linkage. In some embodiments, a nucleoside comprising a 2'-F is preceded by an Sp chiral internucleotidic linkage. In some embodiments, a chiral internucleotidic linkage is Rp. In some embodiments, a nucleoside comprising a 2'-modification is followed by an Rp chiral internucleotidic linkage. In some embodiments, a nucleoside comprising a 2'-F is followed by an Rp chiral internucleotidic linkage. In some embodiments, a nucleoside comprising a 2'-modification is preceded by an Rp chiral internucleotidic linkage. In some embodiments, a nucleoside comprising a 2'-F is preceded by an Rp chiral internucleotidic linkage.

In some embodiments, the present disclosure provides an oligonucleotide composition comprising a first plurality of oligonucleotides, wherein:
  oligonucleotides of the first plurality have the same base sequence; and
  oligonucleotides of the first plurality comprise one or more modified sugar moieties, or comprise one or more natural phosphate linkages and one or more modified internucleotidic linkages.

In some embodiments, oligonucleotides of the first plurality comprise one or more modified sugar moieties. In some embodiments, provided oligonucleotides comprise one or more modified sugar moieties. In some embodiments, provided oligonucleotides comprise 2, 3, 4, 5, 6, 7, 8, 9, 10, 11, 12, 13, 14, 15, 16, 17, 18, 19, 20, 21, 22, 23, 24, or 35 modified sugar moieties.

In some embodiments, provided oligonucleotides comprise one or more 2'-F. In some embodiments, provided oligonucleotides comprise two or more 2'-F. In some embodiments, provided oligonucleotides comprise three or more 2'-F. In some embodiments, provided oligonucleotides comprise four or more 2'-F. In some embodiments, provided oligonucleotides comprise five or more 2'-F. In some embodiments, provided oligonucleotides comprise six or more 2'-F. In some embodiments, provided oligonucleotides comprise seven or more 2'-F. In some embodiments, provided oligonucleotides comprise eight or more 2'-F. In some embodiments, provided oligonucleotides comprise nine or more 2'-F. In some embodiments, provided oligonucleotides comprise ten or more 2'-F. In some embodiments, provided oligonucleotides comprise 11 or more 2'-F. In some embodiments, provided oligonucleotides comprise 12 or more 2'-F. In some embodiments, provided oligonucleotides comprise 13 or more 2'-F. In some embodiments, provided oligonucleotides comprise 14 or more 2'-F. In some embodiments, provided oligonucleotides comprise 15 or more 2'-F. In some embodiments, provided oligonucleotides comprise 16 or more 2'-F. In some embodiments, provided oligonucleotides comprise 17 or more 2'-F. In some embodiments, provided oligonucleotides comprise 18 or more 2'-F. In some embodiments, provided oligonucleotides comprise 19 or more 2'-F. In some embodiments, provided oligonucleotides comprise 20 or more 2'-F. In some embodiments, provided oligonucleotides comprise 21 or more 2'-F. In some embodiments, provided oligonucleotides comprise 22 or more 2'-F. In some embodiments, provided oligonucleotides comprise 23 or more 2'-F. In some embodiments, provided oligonucleotides comprise 24 or more 2'-F. In some embodiments, provided oligonucleotides comprise 25 or more 2'-F. In some embodiments, provided oligonucleotides comprise 30 or more 2'-F. In some embodiments, provided oligonucleotides comprise 35 or more 2'-F. In some embodiments, in provided oligonucleotides, a nucleoside comprising a 2'-modification is followed by a modified internucleotidic linkage. In some embodiments, in provided oligonucleotides, a nucleoside comprising a 2'-modification is preceded by a modified internucleotidic linkage. In some embodiments, a modified internucleotidic linkage is a chiral internucleotidic linkage. In some embodiments, a modified internucleotidic linkage is a phosphorothioate. In some embodiments, a chiral internucleotidic linkage is Sp. In some embodiments, in provided oligonucleotides, a nucleoside comprising a 2'-modification is followed by an Sp chiral internucleotidic linkage. In some embodiments, in provided oligonucleotides, a nucleoside comprising a 2'-F is followed by an Sp chiral internucleotidic linkage. In some embodiments, in provided oligonucleotides, a nucleoside comprising a 2'-modification is preceded by an Sp chiral internucleotidic linkage. In some embodiments, in provided oligonucleotides, a nucleoside comprising a 2'-F is preceded by an Sp chiral internucleotidic linkage. In some embodiments, a chiral internucleotidic linkage is Rp. In some embodiments, in provided oligonucleotides, a nucleoside comprising a 2'-modification is followed by an Rp chiral internucleotidic linkage. In some embodiments, in provided oligonucleotides, a nucleoside comprising a 2'-F is followed by an Rp chiral internucleotidic linkage. In some embodiments, in provided oligonucleotides, a nucleoside comprising a 2'-modification is preceded by an Rp chiral internucleotidic linkage. In some embodiments, in provided oligonucleotides, a nucleoside comprising a 2'-F is preceded by an Rp chiral internucleotidic linkage. In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, oligonucleotides of the first plurality comprise one or more natural phosphate linkages and one or more modified internucleotidic linkages.

Provided oligonucleotides can comprise various number of natural phosphate linkages. In some embodiments, provided oligonucleotides comprise no natural phosphate linkages. In some embodiments, provided oligonucleotides comprise one natural phosphate linkage. In some embodiments, provided oligonucleotides comprise 2 or more natural phosphate linkages. In some embodiments, provided oligonucleotides comprise about 5 or more consecutive modified sugar moieties. In some embodiments, provided oligonucleotides comprise no more than about 95% unmodified sugar moieties. In some embodiments, provided oligonucleotides comprise no more than about 50% unmodified sugar moieties. In some embodiments, each sugar moiety of the oligonucleotides of the first plurality is independently modified. Provided oligonucleotides can comprise various number of natural phosphate linkages. In some embodiments, provided oligonucleotides comprise no natural phosphate linkages. In some embodiments, provided oligonucleotides comprise one natural phosphate linkage. In some embodiments, provided oligonucleotides comprise 2 or more natural phosphate linkages. In some embodiments, provided oligonucleotides comprise 3 or more natural phosphate linkages. In some embodiments, provided oligonucleotides comprise 4 or more natural phosphate linkages. In some embodiments, provided oligonucleotides comprise 5 or more natural phosphate linkages. In some embodiments, provided oligonucleotides comprise 6 or more natural phosphate linkages. In some embodiments, provided oligonucleotides comprise 7 or more natural phosphate linkages. In some embodiments, provided oligonucleotides comprise 8 or more natural phosphate linkages. In some embodiments, provided oligonucleotides comprise 9 or more natural phosphate linkages. In some embodiments, provided oligonucleotides comprise 10 or more natural phosphate linkages. In some embodiments, provided oligonucleotides comprise 15 or more natural phosphate linkages. In some embodiments, provided oligonucleotides comprise 20 or more natural phosphate linkages. In some embodiments, provided oligonucleotides comprise 25 or more natural phosphate linkages. In some embodiments, provided oligonucleotides comprise 30 or more natural phosphate linkages. In some embodiments, provided oligonucleotides comprise about 25 or more consecutive modified sugar moieties. In some embodiments, provided oligonucleotides comprise about 20 or more consecutive modified sugar moieties. In some embodiments, provided oligonucleotides comprise about 15 or more consecutive modified sugar moieties. In some embodiments, provided oligonucleotides comprise about 10 or more consecutive modified sugar moieties. In some embodiments, provided oligonucleotides comprise about 9 or more consecutive modified sugar moieties. In some embodiments, provided oligonucleotides comprise about 8 or more consecutive modified sugar moieties. In some embodiments, provided oligonucleotides comprise about 7 or more consecutive modified sugar moieties. In some embodiments, provided oligonucleotides comprise about 6 or more consecutive modified sugar moieties. In some embodiments, provided oligonucleotides comprise about 5 or more consecutive modified sugar moieties. In some embodiments, provided oligonucleotides comprise about 4 or more consecutive modified sugar moieties. In some embodiments, provided oligonucleotides comprise about 3 or more consecutive modified sugar moieties. In some embodiments, provided oligonucleotides comprise about 2 or more consecutive modified sugar moieties. In some embodiments, provided oligonucleotides comprise about 25 or more consecutive modified sugar moieties. In some embodiments, provided oligonucleotides comprise about 20 or more consecutive modified sugar moieties. In some embodiments, provided oligonucleotides comprise about 15 or more consecutive modified sugar moieties. In some embodiments, provided oligonucleotides comprise about 10 or more consecutive modified sugar moieties. In some embodiments, provided oligonucleotides comprise about 5 or more consecutive modified sugar moieties. In some embodiments, provided oligonucleotides comprise no more than about 95% unmodified sugar moieties. In some embodiments, provided oligonucleotides comprise no more than about 90% unmodified sugar moieties. In some embodiments, provided oligonucleotides comprise no more than about 85% unmodified sugar moieties. In some embodiments, provided oligonucleotides comprise no more than about 80% unmodified sugar moieties. In some embodiments, provided oligonucleotides comprise no more than about 70% unmodified sugar moieties. In some embodiments, provided oligonucleotides comprise no more than about 60% unmodified sugar moieties. In some embodiments, provided oligonucleotides comprise no more than about 50% unmodified sugar moieties. In some embodiments, provided oligonucleotides comprise no more than about 40% unmodified sugar moieties. In some embodiments, provided oligonucleotides comprise no more than about 30% unmodified sugar moieties. In some embodiments, provided oligonucleotides comprise no more than about 20% unmodified sugar moieties. In some embodiments, provided oligonucleotides comprise no more than about 10% unmodified sugar moieties. In some embodiments, provided oligonucleotides comprise no more than about 5% unmodified sugar moieties. In some embodiments, each sugar moiety of the oligonucleotides of the first plurality is independently modified. In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown.

In some embodiments, provided compositions alter transcript single-stranded RNA interference so that an undesired target and/or biological function are suppressed. In some embodiments, in such cases provided composition can also induce cleavage of the transcript after hybridization.

In some embodiments, each oligonucleotide of the first plurality comprises one or more modified sugar moieties and/or one or more modified internucleotidic linkages.

In some embodiments, each oligonucleotide of the first plurality comprises no more than about 95% unmodified sugar moieties. In some embodiments, each oligonucleotide of the first plurality comprises no more than about 50% unmodified sugar moieties. In some embodiments, each oligonucleotide of the first plurality comprises no more than about 5% unmodified sugar moieties. In some embodiments, each sugar moiety of the oligonucleotides of the first plurality is independently modified.

In some embodiments, each oligonucleotide of the first plurality comprises two or more modified internucleotidic linkages. In some embodiments, each oligonucleotide of the first plurality comprises three or more modified internucleotidic linkages. In some embodiments, each oligonucleotide of the first plurality comprises four or more modified internucleotidic linkages. In some embodiments, each oligonucleotide of the first plurality comprises five or more modified internucleotidic linkages. In some embodiments, each oligonucleotide of the first plurality comprises ten or more modified internucleotidic linkages.

In some embodiments, each oligonucleotide of the first plurality comprises about 15 or more modified internucleotidic linkages. In some embodiments, each oligonucleotide of the first plurality comprises about 20 or more modified internucleotidic linkages. In some embodiments, each oligonucleotide of the first plurality comprises about 25 or more modified internucleotidic linkages.

In some embodiments, each oligonucleotide of the first plurality comprises no more than about 30% natural phosphate linkages. In some embodiments, each oligonucleotide of the first plurality comprises no more than about 20% natural phosphate linkages. In some embodiments, each oligonucleotide of the first plurality comprises no more than about 10% natural phosphate linkages. In some embodiments, each oligonucleotide of the first plurality comprises no more than about 5% natural phosphate linkages.

In some embodiments, compared to a reference condition, provided chirally controlled oligonucleotide compositions are surprisingly effective. In some embodiments, desired biological effects (e.g., as measured by increased levels of desired mRNA, proteins, etc., decreased levels of undesired mRNA, proteins, etc.) can be enhanced by more than 5, 10, 15, 20, 25, 30, 40, 50, or 100 fold. In some embodiments, a change is measured by increase of a desired mRNA level compared to a reference condition. In some embodiments, a change is measured by decrease of an undesired mRNA level compared to a reference condition. In some embodiments, a reference condition is absence of oligonucleotide treatment. In some embodiments, a reference condition is a stereorandom composition of oligonucleotides having the same base sequence and chemical modifications.

In some embodiments, provided oligonucleotides contain increased levels of one or more isotopes. In some embodiments, provided oligonucleotides are labeled, e.g., by one or more isotopes of one or more elements, e.g., hydrogen, carbon, nitrogen, etc. In some embodiments, provided oligonucleotides in provided compositions, e.g., oligonucleotides of a first plurality, comprise base modifications, sugar modifications, and/or internucleotidic linkage modifications, wherein the oligonucleotides contain an enriched level of deuterium. In some embodiments, provided oligonucleotides are labeled with deuterium (replacing $-^1$H with $-^2$H) at one or more positions. In some embodiments, one or more $^1$H of an oligonucleotide or any moiety conjugated to the oligonucleotide (e.g., a targeting moiety, lipid moiety, etc.) is substituted with $^2$H. Such oligonucleotides can be used in any composition or method described herein.

The present invention includes all pharmaceutically acceptable isotopically-labelled compounds wherein one or more atoms are replaced by atoms having the same atomic number, but an atomic mass or mass number different from the atomic mass or mass number usually found in nature.

Examples of isotopes suitable for inclusion in the compounds of the invention include isotopes of hydrogen, such as $^2$H and $^3$H, carbon, such as $^{11}$C, $^{13}$C and $^{14}$C, chlorine, such as $^{36}$Cl, fluorine, such as $^{18}$F, iodine, such as $^{123}$I, $^{124}$I and $^{125}$I, nitrogen, such as $^{13}$N and $^{15}$N, oxygen, such as $^{15}$O, $^{17}$O and $^{18}$O, phosphorus, such as $^{32}$P, and sulphur, such as $^{35}$S.

Certain isotopically-labelled compounds of Formula (I), for example, those incorporating a radioactive isotope, are useful in drug and/or substrate tissue distribution studies. The radioactive isotopes tritium, i.e. $^3$H, and carbon-14, i.e. $^{14}$C, are particularly useful for this purpose in view of their ease of incorporation and ready means of detection.

Substitution with heavier isotopes such as deuterium, i.e. $^2$H, may afford certain therapeutic advantages resulting from greater metabolic stability, for example, increased in vivo half-life or reduced dosage requirements, and hence may be preferred in some circumstances.

Substitution with positron emitting isotopes, such as $^{11}$C, $^{18}$F, $^{15}$O an $^{13}$N, can be useful in Positron Emission Tomography (PET) studies for examining substrate receptor occupancy.

Isotopically-labelled compounds can generally be prepared by conventional techniques known to those skilled in the art or by processes analogous to those described in the accompanying Examples and Preparations using an appropriate isotopically-labelled reagent in place of the non-labelled reagent previously employed.

In some embodiments, controlling structural elements of oligonucleotides, such as chemical modifications (e.g., modifications of a sugar, base and/or internucleotidic linkage) or patterns thereof, alterations in stereochemistry (e.g., stereochemistry of a backbone chiral internucleotidic linkage) or patterns thereof, substitution of an atom with an isotope of the same element, and/or conjugation with an additional chemical moiety (e.g., a lipid moiety, targeting moiety, etc.) can have a significant impact on a desired biological effect. In some embodiments, a desired biological effect is enhanced by more than 2 fold.

In some embodiments, a desired biological effect is enhanced by more than 3, 4, 5, 6, 7, 8, 9, 10, 11, 12, 13, 14, 15, 20, 25, 30, 40, 50, 60, 70, 80, 90, or 100 fold.

In some embodiments, a desired biological effect is directing a decrease in the expression and/or level of a target gene or its gene product. In some embodiments, a desired biological effect is improved single-stranded RNA interference. In some embodiments, a desired biological effect is improved RNase H-mediated knockdown. In some embodiments, a desired biological effect is improved single-stranded RNA interference and/or RNase H-mediated knockdown.

In some embodiments, the present disclosure provides an oligonucleotide composition comprising a first plurality of oligonucleotides which:

1) have a common base sequence complementary to a target sequence in a transcript; and
2) comprise one or more modified sugar moieties and modified internucleotidic linkages.

In some embodiments, a provided oligonucleotide composition is characterized in that, when it is contacted with the transcript in a single-stranded RNA interference system, RNAi-mediated knockdown of the transcript is improved relative to that observed under reference conditions selected from the group consisting of absence of the composition, presence of a reference composition, and combinations thereof.

In some embodiments, the present disclosure provides an oligonucleotide composition comprising a first plurality of oligonucleotides capable of directing single-stranded RNA interference, wherein an oligonucleotide type is defined by:

1) base sequence;
2) pattern of backbone linkages;
3) pattern of backbone chiral centers; and
4) pattern of backbone phosphorus modifications, which composition is chirally controlled in that it is enriched, relative to a substantially racemic preparation of oligonucleotides having the same base sequence, for oligonucleotides of the particular oligonucleotide type, the oligonucleotide composition being characterized in that, when it is contacted with the transcript in a single-stranded RNA interference system, RNAi-mediated knockdown of the transcript is improved relative to that observed under reference conditions selected from the group consisting of absence of the composition, presence of a reference composition, and combinations thereof.

In some embodiments, each of the consecutive nucleoside units is independently preceded and/or followed by a modified internucleotidic linkage. In some embodiments, each of the consecutive nucleoside units is independently preceded and/or followed by a phosphorothioate linkage. In some embodiments, each of the consecutive nucleoside units is independently preceded and/or followed by a chirally controlled modified internucleotidic linkage. In some embodiments, each of the consecutive nucleoside units is independently preceded and/or followed by a chirally controlled phosphorothioate linkage. In some embodiments, a modified internucleotidic linkage has a structure of Formula I. In some embodiments, a modified internucleotidic linkage has a structure of Formula I-a.

In some embodiments, the present disclosure provides a single-stranded RNAi agent comprising a predetermined level of a first plurality of oligonucleotides, wherein:

oligonucleotides of the first plurality have the same base sequence;

oligonucleotides of the first plurality comprise a seed region comprising 2, 3, 4, 5, 6, 7 or more consecutive Sp modified internucleotidic linkages, a post-seed region comprising 2, 3, 4, 5, 6, 7, 8, 9, 10 or more consecutive Sp modified internucleotidic linkages.

In some embodiments, a seed region comprises 2 or more consecutive Sp modified internucleotidic linkages. In some embodiments, a seed region comprises 3, 4, 5, 6, 7, 8, 9, 10 or more consecutive Sp modified internucleotidic linkages. In some embodiments, a seed region comprises 3 or more consecutive Sp modified internucleotidic linkages. In some embodiments, a seed region comprises 4 or more consecutive Sp modified internucleotidic linkages. In some embodiments, a post-seed region comprises 4 or more consecutive Sp modified internucleotidic linkages.

In some embodiments, the present disclosure provides a single-stranded RNAi agent comprising a predetermined level of a first plurality of oligonucleotides, wherein:

oligonucleotides of the first plurality have the same base sequence;

oligonucleotides of the first plurality comprise a seed region comprising 4, 5, 6, 7, 8 or more consecutive Sp modified internucleotidic linkages, a post-seed region comprising 4, 5, 6, 7, 8, 9, 10 or more consecutive Sp modified internucleotidic linkages, and a middle region between the seed region and the 3'-region comprising 1, 2, 3, 4, 5, 6, 7, 8, 9, 10 or more natural phosphate linkages.

In some embodiments, the present disclosure provides a single-stranded RNAi agent comprising a predetermined level of a first plurality of oligonucleotides, wherein:

oligonucleotides of the first plurality have the same base sequence;

oligonucleotides of the first plurality comprise a seed region comprising 5, 6, 7, 8 or more consecutive Sp modified internucleotidic linkages, a post-seed region comprising 5, 6, 7, 8, 9, 10 or more consecutive Sp modified internucleotidic linkages, and a middle region between the seed region and the 3'-region comprising 2, 3, 4, 5, 6, 7, 8 or more natural phosphate linkages.

In some embodiments, the present disclosure provides a single-stranded RNAi agent comprising a predetermined level of a first plurality of oligonucleotides, wherein:

oligonucleotides of the first plurality have the same base sequence;

oligonucleotides of the first plurality comprise a seed region comprising 6, 7 or more consecutive Sp modified internucleotidic linkages, a post-seed region comprising 6, 7, 8, 9, 10 or more consecutive Sp modified internucleotidic linkages.

In some embodiments, the present disclosure provides a single-stranded RNAi agent comprising a predetermined level of a first plurality of oligonucleotides, wherein:

oligonucleotides of the first plurality have the same base sequence;

oligonucleotides of the first plurality comprise a seed region comprising 6, 7, 8 or more consecutive Sp modified internucleotidic linkages, a post-seed region comprising 6, 7, 8, 9, 10 or more consecutive Sp modified internucleotidic linkages.

In some embodiments, a modified internucleotidic linkage has a structure of Formula I. In some embodiments, a modified internucleotidic linkage has a structure of Formula I-a.

As demonstrated in the present disclosure, in some embodiments, a provided oligonucleotide composition is characterized in that, when it is contacted with the transcript in a single-stranded RNA interference system, RNAi-mediated knockdown of the transcript is improved relative to that observed under reference conditions selected from the group consisting of absence of the composition, presence of a reference composition, and combinations thereof. In some embodiments, single-stranded RNA interference is increased 10%, 20%, 30%, 40%, 50%, 60%, 70%, 80%, 90%, 100%, or 2, 3, 4, 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 200, 300, 400, 500, 600, 700, 800, 900, 1000 fold or more. In some embodiments, as exemplified in the present disclosure, levels of the plurality of oligonucleotides, e.g., a first plurality of oligonucleotides, in provided compositions are pre-determined.

In some embodiments, the present disclosure provides an oligonucleotide composition comprising a first plurality of oligonucleotides defined by having:

1) a common base sequence and length;
2) a common pattern of backbone linkages; and
3) a common pattern of backbone chiral centers, which composition is a substantially pure preparation of a single oligonucleotide in that a predetermined level of the oligonucleotides in the composition have the common base sequence and length, the common pattern of backbone linkages, and the common pattern of backbone chiral centers.

In some embodiments, a common base sequence and length may be referred to as a common base sequence. In some embodiments, oligonucleotides having a common base sequence may have the same pattern of nucleoside modifications, e.g., sugar modifications, base modifications, etc. In some embodiments, a pattern of nucleoside modifications may be represented by a combination of locations and modifications. In some embodiments, a pattern of backbone linkages comprises locations and types (e.g., phosphate, phosphorothioate, substituted phosphorothioate, etc.) of each internucleotidic linkages. A pattern of backbone chiral centers of an oligonucleotide can be designated by a combination of linkage phosphorus stereochemistry (Rp/Sp) from 5' to 3'. As exemplified above, locations of non-chiral linkages may be obtained, for example, from pattern of backbone linkages.

As understood by a person having ordinary skill in the art, a stereorandom or racemic preparation of oligonucleotides is prepared by non-stereoselective and/or low-stereoselective coupling of nucleotide monomers, typically without using any chiral auxiliaries, chiral modification reagents, and/or chiral catalysts. In some embodiments, in a substantially racemic (or chirally uncontrolled) preparation of oligonucleotides, all or most coupling steps are not chirally controlled in that the coupling steps are not specifically conducted to provide enhanced stereoselectivity. An example substantially racemic preparation of oligonucleotides is the preparation of phosphorothioate oligonucleotides through sulfurizing phosphite triesters from commonly used phosphoramidite oligonucleotide synthesis with either tetraethylthiuram disulfide or (TETD) or 3H-1, 2-bensodithiol-3-one 1,1-dioxide (BDTD), a well-known process in the art. In some embodiments, substantially racemic preparation of oligonucleotides provides substantially racemic oligonucleotide compositions (or chirally uncontrolled oligonucleotide compositions).

In some embodiments, at least one coupling of a nucleotide monomer has a diastereoselectivity lower than about 60:40, 70:30, 80:20, 85:15, 90:10, 91:9, 92:8, 97:3, 98:2, or 99:1. In some embodiments, in a stereorandom or racemic preparations, at least one internucleotidic linkage has a diastereoselectivity lower than about 60:40, 70:30, 80:20, 85:15, 90:10, 91:9, 92:8, 97:3, 98:2, or 99:1.

In some embodiments, a chirally controlled internucleotidic linkage, such as those of oligonucleotides of chirally controlled oligonucleotide compositions, has a diastereoselectivity of 90:10, 91:9, 92:8, 93:7, 94:6, 95:5, 96:4, 97:3, 98:2, 99:1 or more.

As understood by a person having ordinary skill in the art, in some embodiments, diastereoselectivity of a coupling or a linkage can be assessed through the diastereoselectivity of a dimer formation under the same or comparable conditions, wherein the dimer has the same 5'- and 3'-nucleosides and internucleotidic linkage.

In some embodiments, the present disclosure provides chirally controlled (and/or stereochemically pure) oligonucleotide compositions comprising a first plurality of oligonucleotides defined by having:

1) a common base sequence and length;
2) a common pattern of backbone linkages; and
3) a common pattern of backbone chiral centers, which composition is a substantially pure preparation of a single oligonucleotide in that at least about 10% of the oligonucleotides in the composition have the common base sequence and length, the common pattern of backbone linkages, and the common pattern of backbone chiral centers.

In some embodiments, the present disclosure provides chirally controlled oligonucleotide composition of a first plurality of oligonucleotides in that the composition is enriched, relative to a substantially racemic preparation of the same oligonucleotides, for oligonucleotides of a single oligonucleotide type. In some embodiments, the present disclosure provides chirally controlled oligonucleotide composition of a first plurality of oligonucleotides in that the composition is enriched, relative to a substantially racemic preparation of the same oligonucleotides, for oligonucleotides of a single oligonucleotide type that share:

1) a common base sequence and length;
2) a common pattern of backbone linkages; and
3) a common pattern of backbone chiral centers.

In some embodiments, the present disclosure provides an oligonucleotide composition comprising a first plurality of oligonucleotides capable of directing single-stranded RNA interference, wherein oligonucleotides are of a particular oligonucleotide type characterized by:

1) a common base sequence and length;
2) a common pattern of backbone linkages; and
3) a common pattern of backbone chiral centers;

which composition is chirally controlled in that it is enriched, relative to a substantially racemic preparation of oligonucleotides having the same base sequence and length, for oligonucleotides of the particular oligonucleotide type.

In some embodiments, oligonucleotides having a common base sequence and length, a common pattern of backbone linkages, and a common pattern of backbone chiral centers have a common pattern of backbone phosphorus modifications and a common pattern of base modifications. In some embodiments, oligonucleotides having a common base sequence and length, a common pattern of backbone linkages, and a common pattern of backbone chiral centers have a common pattern of backbone phosphorus modifications and a common pattern of nucleoside modifications. In some embodiments, oligonucleotides having a common base sequence and length, a common pattern of backbone linkages, and a common pattern of backbone chiral centers have identical structures.

In some embodiments, oligonucleotides of an oligonucleotide type have a common pattern of backbone phosphorus modifications and a common pattern of sugar modifications. In some embodiments, oligonucleotides of an oligonucleotide type have a common pattern of backbone phosphorus modifications and a common pattern of base modifications. In some embodiments, oligonucleotides of an oligonucleotide type have a common pattern of backbone phosphorus modifications and a common pattern of nucleoside modifications. In some embodiments, oligonucleotides of an oligonucleotide type are identical.

In some embodiments, at least about 20% of the oligonucleotides in the composition have a common base sequence and length, a common pattern of backbone linkages, and a common pattern of backbone chiral centers. In some embodiments, at least about 25% of the oligonucleotides in the composition have a common base sequence and length, a common pattern of backbone linkages, and a common pattern of backbone chiral centers. In some embodiments, at least about 30% of the oligonucleotides in the composition have a common base sequence and length, a common pattern of backbone linkages, and a common pattern of backbone chiral centers. In some embodiments, at least about 35% of the oligonucleotides in the composition have a common base sequence and length, a common pattern of backbone linkages, and a common pattern of backbone chiral centers. In some embodiments, at least about 40% of the oligonucleotides in the composition have a common base sequence and length, a common pattern of backbone linkages, and a common pattern of backbone chiral centers. In some embodiments, at least about 45% of the oligonucleotides in the composition have a common base sequence and length, a common pattern of backbone linkages, and a common pattern of backbone chiral centers. In some embodiments, at least about 50% of the oligonucleotides in the composition have a common base sequence and length, a common pattern of backbone linkages, and a common pattern of backbone chiral centers. In some embodiments, at least about 55% of the oligonucleotides in the composition have a common base sequence and length, a common pattern of backbone linkages, and a common pattern of backbone chiral centers. In some embodiments, at least about 60% of the oligonucleotides in the composition have a common base sequence and length, a common pattern of backbone linkages, and a common pattern of backbone chiral centers. In some embodiments, at least about 65% of the oligonucleotides in the composition have a common base sequence and length, a common pattern of backbone linkages, and a common pattern of backbone chiral centers. In some embodiments, at least about 70% of the oligonucleotides in the composition have a common base sequence and length, a common pattern of backbone linkages, and a common pattern of backbone chiral centers. In some embodiments, at least about 75% of the oligonucleotides in the composition have a common base sequence and length, a common pattern of backbone linkages, and a common pattern of backbone chiral centers. In some embodiments, at least about 80% of the oligonucleotides in the composition have a common base sequence and length, a common pattern of backbone linkages, and a common pattern of backbone chiral centers. In some embodiments, at least about 85% of the oligonucleotides in the composition have a common base sequence and length, a common pattern of backbone linkages, and a common pattern of backbone chiral centers. In some embodiments, at least about 90% of the oligonucleotides in the composition have a common base sequence and length, a common pattern of backbone linkages, and a common pattern of backbone chiral centers. In some embodiments, at least about 92% of the oligonucleotides in the composition have a common base sequence and length, a common pattern of backbone linkages, and a common pattern of backbone chiral centers. In some embodiments, at least about 94% of the oligonucleotides in the composition have a common base sequence and length, a common pattern of backbone linkages, and a common pattern of backbone chiral centers. In some embodiments, at least about 95% of the oligonucleotides in the composition have a common base sequence and length, a common pattern of backbone linkages, and a common pattern of backbone chiral centers. In some embodiments, at least about 91%, 92%, 93%, 94%, 95%, 96%, 97%, 98%, or 99% of the oligonucleotides in the composition have a common base sequence and length, a common pattern of backbone linkages, and a common pattern of backbone chiral centers. In some embodiments, greater than about 99% of the oligonucleotides in the composition have a common base sequence and length, a common pattern of backbone linkages, and a common pattern of backbone chiral centers. In some embodiments, purity of a single-stranded RNAi agent of an oligonucleotide can be expressed as the percentage of oligonucleotides in the composition that have a common base sequence and length, a common pattern of backbone linkages, and a common pattern of backbone chiral centers.

In some embodiments, oligonucleotides having a common base sequence and length, a common pattern of backbone linkages, and a common pattern of backbone chiral centers have a common pattern of backbone phosphorus modifications. In some embodiments, oligonucleotides having a common base sequence and length, a common pattern of backbone linkages, and a common pattern of backbone chiral centers have a common pattern of backbone phosphorus modifications and a common pattern of nucleoside modifications. In some embodiments, oligonucleotides having a common base sequence and length, a common pattern of backbone linkages, and a common pattern of backbone chiral centers have a common pattern of backbone phosphorus modifications and a common pattern of sugar modifications. In some embodiments, oligonucleotides having a common base sequence and length, a common pattern of backbone linkages, and a common pattern of backbone chiral centers have a common pattern of backbone phosphorus modifications and a common pattern of base modifications. In some embodiments, oligonucleotides having a common base sequence and length, a common pattern of backbone linkages, and a common pattern of backbone chiral centers have a common pattern of backbone phosphorus modifications and a common pattern of nucleoside modifications. In some embodiments, oligonucleotides having a common base sequence and length, a common pattern of backbone linkages, and a common pattern of backbone chiral centers are identical.

In some embodiments, oligonucleotides in provided compositions have a common pattern of backbone phosphorus modifications. In some embodiments, a common base sequence is a base sequence of an oligonucleotide type. In some embodiments, a provided composition is an oligonucleotide composition that is chirally controlled in that the composition contains a predetermined level of a first plurality of oligonucleotides of an individual oligonucleotide type, wherein an oligonucleotide type is defined by:
1) base sequence;
2) pattern of backbone linkages;
3) pattern of backbone chiral centers; and
4) pattern of backbone phosphorus modifications.

As noted above and understood in the art, in some embodiments, the base sequence of an oligonucleotide may refer to the identity and/or modification status of nucleoside residues (e.g., of sugar and/or base components, relative to standard naturally occurring nucleotides such as adenine, cytosine, guanosine, thymine, and uracil) in the oligonucleotide and/or to the hybridization character (i.e., the ability to hybridize with particular complementary residues) of such residues.

In some embodiments, oligonucleotides of a particular type are identical in that they have the same base sequence (including length), the same pattern of chemical modifications to sugar and base moieties, the same pattern of backbone linkages (e.g., pattern of natural phosphate linkages, phosphorothioate linkages, phosphorothioate triester linkages, and combinations thereof), the same pattern of backbone chiral centers (e.g., pattern of stereochemistry (Rp/Sp) of chiral internucleotidic linkages), and the same pattern of backbone phosphorus modifications (e.g., pattern of modifications on the internucleotidic phosphorus atom, such as —S⁻, and -L-R¹ of Formula I).

In some embodiments, purity of a single-stranded RNAi agent of an oligonucleotide type is expressed as the percentage of oligonucleotides in the composition that are of the oligonucleotide type. In some embodiments, at least about 10% of the oligonucleotides in a single-stranded RNAi agent are of the same oligonucleotide type. In some embodiments, at least about 50% of the oligonucleotides in a single-stranded RNAi agent are of the same oligonucleotide type. In some embodiments, at least about 60% of the oligonucleotides in a single-stranded RNAi agent are of the same oligonucleotide type. In some embodiments, at least about 70% of the oligonucleotides in a single-stranded RNAi agent are of the same oligonucleotide type. In some embodiments, at least about 80% of the oligonucleotides in a single-stranded RNAi agent are of the same oligonucleotide type. In some embodiments, at least about 90% of the oligonucleotides in a single-stranded RNAi agent are of the same oligonucleotide type.

In some embodiments, purity of a single-stranded RNAi agent can be controlled by stereoselectivity of each coupling step in its preparation process. In some embodiments, a coupling step has a stereoselectivity (e.g., diastereoselectivity) of 60% (60% of the new internucleotidic linkage formed from the coupling step has the intended stereochemistry). After such a coupling step, the new internucleotidic linkage formed may be referred to have a 60% purity. In some embodiments, each coupling step has a stereoselectivity of at least 60%, 70%, 80%, or 90%. In some embodiments, each coupling step has a stereoselectivity of at least 95%.

In some embodiments, each coupling step has a stereoselectivity of at least 96%. In some embodiments, each coupling step has a stereoselectivity of at least 97%. In some embodiments, each coupling step has a stereoselectivity of at least 98%. In some embodiments, each coupling step has a stereoselectivity of at least 99%. In some embodiments, each coupling step has a stereoselectivity of at least 99.5%. In some embodiments, each coupling step has a stereoselectivity of virtually 100%. In some embodiments, a coupling step has a stereoselectivity of virtually 100% in that all detectable product from the coupling step by an analytical method (e.g., NMR, HPLC, etc) has the intended stereoselectivity.

Among other things, the present disclosure recognizes that combinations of oligonucleotide structural elements (e.g., patterns of chemical modifications, backbone linkages, backbone chiral centers, and/or backbone phosphorus modifications) can provide surprisingly improved properties such as bioactivities.

In some embodiments, provided chirally controlled (and/or stereochemically pure) preparations are RNAi agent oligonucleotides.

In some embodiments, provided chirally controlled (and/or stereochemically pure) preparations are of oligonucleotides that include one or more modified backbone linkages, bases, and/or sugars.

In some embodiments, provided chirally controlled (and/or stereochemically pure) preparations are of oligonucleotides having a common base sequence of at least 8 bases. In some embodiments, provided chirally controlled (and/or stereochemically pure) preparations are of oligonucleotides having a common base sequence of at least 14 bases. In some embodiments, provided chirally controlled (and/or stereochemically pure) preparations are of oligonucleotides having a common base sequence of at least 15 to 25 bases. In some embodiments, provided chirally controlled (and/or stereochemically pure) preparations are of oligonucleotides having a common base sequence of at least 30, 35, 40, 45, 50, 55, 60, 65, 70, or 75 bases.

In some embodiments, provided compositions comprise oligonucleotides containing one or more residues which are modified at the sugar moiety. In some embodiments, provided compositions comprise oligonucleotides containing one or more residues which are modified at the 2' position of the sugar moiety (referred to herein as a "2'-modification"). Examples of such modifications are described above and herein and include, but are not limited to, 2'-OMe, 2'-MOE, 2'-LNA, 2'-F, FRNA, FANA, S-cEt, etc. In some embodiments, provided compositions comprise oligonucleotides containing one or more residues which are 2'-modified. For example, in some embodiments, provided oligonucleotides contain one or more residues which are 2'-O-methoxyethyl (2'-MOE)-modified residues. In some embodiments, provided compositions comprise oligonucleotides which do not contain any 2'-modifications. In some embodiments, provided compositions are oligonucleotides which do not contain any 2'-MOE residues. That is, in some embodiments, provided oligonucleotides are not MOE-modified. Additional example sugar modifications are described in the present disclosure.

In some embodiments, one or more is one. In some embodiments, one or more is two. In some embodiments, one or more is three. In some embodiments, one or more is four. In some embodiments, one or more is five. In some embodiments, one or more is six. In some embodiments, one or more is seven. In some embodiments, one or more is eight. In some embodiments, one or more is nine. In some embodiments, one or more is ten. In some embodiments, one or more is at least one. In some embodiments, one or more is at least two. In some embodiments, one or more is at least three. In some embodiments, one or more is at least four. In some embodiments, one or more is at least five. In some embodiments, one or more is at least six. In some embodiments, one or more is at least seven. In some embodiments, one or more is at least eight. In some embodiments, one or more is at least nine. In some embodiments, one or more is at least ten.

In some embodiments, a 5'-internucleotidic linkage connected to a sugar moiety without a 2'-modification is a modified linkage. In some embodiments, a 5'-internucleotidic linkage connected to a sugar moiety without a 2'-modification is a linkage having the structure of Formula I. In some embodiments, a 5'-internucleotidic linkage connected to a sugar moiety without a 2'-modification is phosphorothioate linkage. In some embodiments, a 5'-internucleotidic linkage connected to a sugar moiety without a 2'-modification is a substituted phosphorothioate linkage. In some embodiments, a 5'-internucleotidic linkage connected to a sugar moiety without a 2'-modification is a phosphorothioate triester linkage. In some embodiments, each 5'-internucleotidic linkage connected to a sugar moiety without a 2'-modification is a modified linkage. In some embodiments, each 5'-internucleotidic linkage connected to a sugar moiety without a 2'-modification is a linkage having the structure of Formula I. In some embodiments, each 5'-internucleotidic linkage connected to a sugar moiety without a 2'-modification is phosphorothioate linkage. In some embodiments, each 5'-internucleotidic linkage connected to a sugar moiety without a 2'-modification is a substituted phosphorothioate linkage. In some embodiments, each 5'-internucleotidic linkage connected to a sugar moiety without a 2'-modification is a phosphorothioate triester linkage.

In some embodiments, a 3'-internucleotidic linkage connected to a sugar moiety without a 2'-modification is a modified linkage. In some embodiments, a 3'-internucleotidic linkage connected to a sugar moiety without a 2'-modification is a linkage having the structure of Formula I. In some embodiments, a 3'-internucleotidic linkage connected to a sugar moiety without a 2'-modification is phosphorothioate linkage. In some embodiments, a 3'-internucleotidic linkage connected to a sugar moiety without a 2'-modification is a substituted phosphorothioate linkage. In some embodiments, a 3'-internucleotidic linkage connected to a sugar moiety without a 2'-modification is a phosphorothioate triester linkage. In some embodiments, each 3'-internucleotidic linkage connected to a sugar moiety without a 2'-modification is a modified linkage. In some embodiments, each 3'-internucleotidic linkage connected to a sugar moiety without a 2'-modification is a linkage having the structure of Formula I. In some embodiments, each 3'-internucleotidic linkage connected to a sugar moiety without a 2'-modification is phosphorothioate linkage. In some embodiments, each 3'-internucleotidic linkage connected to a sugar moiety without a 2'-modification is a substituted phosphorothioate linkage. In some embodiments, each 3'-internucleotidic linkage connected to a sugar moiety without a 2'-modification is a phosphorothioate triester linkage.

In some embodiments, both internucleotidic linkages connected to a sugar moiety without a 2'-modification are modified linkages. In some embodiments, both internucleotidic linkages connected to a sugar moiety without a 2'-modification are linkage having the structure of Formula I. In some embodiments, both internucleotidic linkages connected to a sugar moiety without a 2'-modification are phosphorothioate linkages. In some embodiments, both internucleotidic linkages connected to a sugar moiety without a 2'-modification are substituted phosphorothioate linkages. In some embodiments, both internucleotidic linkages connected to a sugar moiety without a 2'-modification are phosphorothioate triester linkages. In some embodiments, each internucleotidic linkage connected to a sugar moiety without a 2'-modification is a modified linkage. In some embodiments, each internucleotidic linkage connected to a sugar moiety without a 2'-modification is a linkage having the structure of Formula I. In some embodiments, each internucleotidic linkage connected to a sugar moiety without a 2'-modification is phosphorothioate linkage. In some embodiments, each internucleotidic linkage connected to a sugar moiety without a 2'-modification is a substituted phosphorothioate linkage. In some embodiments, each internucleotidic linkage connected to a sugar moiety without a 2'-modification is a phosphorothioate triester linkage.

In some embodiments, a sugar moiety without a 2'-modification is a sugar moiety found in a natural DNA nucleoside.

A person of ordinary skill in the art understands that various regions of a target transcript can be targeted by provided compositions and methods. In some embodiments, a base sequence of provided oligonucleotides comprises an intron sequence. In some embodiments, a base sequence of provided oligonucleotides comprises an exon sequence. In some embodiments, a base sequence of provided oligonucleotides comprises an intron and an exon sequence.

As understood by a person having ordinary skill in the art, provided oligonucleotides and compositions, among other things, can target a great number of nucleic acid polymers. For instance, in some embodiments, provided oligonucleotides and compositions may target a transcript of a nucleic acid sequence, wherein a common base sequence of oligonucleotides (e.g., a base sequence of an oligonucleotide type) comprises or is a sequence complementary to a sequence of the transcript. In some embodiments, a common base sequence comprises a sequence complimentary to a sequence of a target. In some embodiments, a common base sequence is a sequence complimentary to a sequence of a target. In some embodiments, a common base sequence comprises or is a sequence 100% complimentary to a sequence of a target. In some embodiments, a common base sequence comprises a sequence 100% complimentary to a sequence of a target. In some embodiments, a common base sequence is a sequence 100% complimentary to a sequence of a target.

In some embodiments, as described in this disclosure, provided oligonucleotides and compositions may provide new cleavage patterns, higher cleavage rate, higher cleavage degree, higher cleavage selectivity, etc. In some embodiments, provided compositions can selectively suppress (e.g., cleave) a transcript from a target nucleic acid sequence which has one or more similar sequences exist within a subject or a population, each of the target and its similar sequences contains a specific nucleotidic characteristic sequence element that defines the target sequence relative to the similar sequences. In some embodiments, for example, a target sequence is a wild-type allele or copy of a gene, and a similar sequence is a sequence has very similar base sequence, e.g., a sequence having SNP, mutations, etc.

In some embodiments, a similar sequence has greater than 60%, 65%, 70%, 75%, 80%, 85%, 90%, 91%, 92%, 93%, 94%, 95%, 96%, 97%, 98% or 99% sequence homology with a target sequence. In some embodiments, a target sequence is a disease-causing copy of a nucleic acid sequence comprising one or more mutations and/or SNPs, and a similar sequence is a copy not causing the disease (wild type). In some embodiments, a target sequence comprises a mutation, wherein a similar sequence is the corresponding wild-type sequence. In some embodiments, a target sequence is a mutant allele, while a similar sequence is a wild-type allele. In some embodiments, a target sequence comprises an SNP that is associated with a disease-causing allele, while a similar sequence comprises the same SNP that is not associates with the disease-causing allele. In some embodiments, the region of a target sequence that is complementary to a common base sequence of a provided oligonucleotide composition has greater than 60%, 65%, 70%, 75%, 80%, 85%, 90%, 91%, 92%, 93%, 94%, 95%, 96%, 97%, 98% or 99% sequence homology with the corresponding region of a similar sequence. In some embodiments, the region of a target sequence that is complementary to a common base sequence of a provided oligonucleotide composition differs from the corresponding region of a similar sequence at less than 5, less than 4, less than 3, less than 2, or only 1 base pairs. In some embodiments, the region of a target sequence that is complementary to a common base sequence of a provided oligonucleotide composition differs from the corresponding region of a similar sequence only at a mutation site or SNP site. In some embodiments, the region of a target sequence that is complementary to a common base sequence of a provided oligonucleotide composition differs from the corresponding region of a similar sequence only at a mutation site. In some embodiments, the region of a target sequence that is complementary to a common base sequence of a provided oligonucleotide composition differs from the corresponding region of a similar sequence only at an SNP site.

In some embodiments, a common base sequence comprises or is a sequence complementary to a characteristic sequence element. In some embodiments, a common base sequence comprises a sequence complementary to a characteristic sequence element. In some embodiments, a common base sequence is a sequence complementary to a characteristic sequence element. In some embodiments, a common base sequence comprises or is a sequence 100% complementary to a characteristic sequence element. In some embodiments, a common base sequence comprises a sequence 100% complementary to a characteristic sequence element. In some embodiments, a common base sequence is a sequence 100% complementary to a characteristic sequence element. In some embodiments herein, a characteristic sequence element is, as non-limiting examples, a seed region, a post-seed region or a portion of a seed region, or a portion of a post-seed region or a 3'-terminal dinucleotide.

In some embodiments, a characteristic sequence element comprises or is a mutation. In some embodiments, a characteristic sequence element comprises a mutation. In some embodiments, a characteristic sequence element is a mutation. In some embodiments, a characteristic sequence element comprises or is a point mutation. In some embodiments, a characteristic sequence element comprises a point mutation. In some embodiments, a characteristic sequence element is a point mutation. In some embodiments, a characteristic sequence element comprises or is an SNP. In some embodiments, a characteristic sequence element comprises an SNP. In some embodiments, a characteristic sequence element is an SNP.

In some embodiments, a common base sequence 100% matches a target sequence, which it does not 100% match a similar sequence of the target sequence.

For example, in some embodiments, a common base sequence matches a mutation in the disease-causing copy or allele of a target nucleic acid sequence, but does not match a non-disease-causing copy or allele at the mutation site; in some other embodiments, a common base sequence matches an SNP in the disease-causing allele of a target nucleic acid sequence, but does not match a non-disease-causing allele at the corresponding site.

Among other things, the present disclosure recognizes that a base sequence may have impact on oligonucleotide properties. In some embodiments, a base sequence may have impact on cleavage pattern of a target when oligonucleotides having the base sequence are utilized for suppressing a target, e.g., through a pathway involving RNase H: for example, structurally similar (all phosphorothioate linkages, all stereorandom) oligonucleotides have different sequences may have different cleavage patterns.

In some embodiments, a common base sequence is a base sequence that comprises a SNP.

As a person having ordinary skill in the art understands, provided oligonucleotide compositions and methods have various uses as known by a person having ordinary skill in the art. Methods for assessing provided compositions, and properties and uses thereof, are also widely known and practiced by a person having ordinary skill in the art. Example properties, uses, and/or methods include but are not limited to those described in WO/2014/012081 and WO/2015/107425.

In some embodiments, a common base sequence comprises or is a sequence complementary to a nucleic acid sequence. In some embodiments, a common base sequence comprises or is a sequence 100% complementary to a nucleic acid sequence. In some embodiments, a common base sequence comprises or is a sequence complementary to a disease-causing or disease-related nucleic acid sequence. In some embodiments, a common base sequence comprises or is a sequence 100% complementary to a disease-causing nucleic acid sequence. In some embodiments, a common base sequence comprises or is a sequence complementary to a characteristic sequence element of disease-causing nucleic acid sequence, which characteristic sequences differentiate a disease-causing nucleic acid sequence from a non-diseasing-causing nucleic acid sequence. In some embodiments, a common base sequence comprises or is a sequence 100% complementary to a characteristic sequence element of disease-causing nucleic acid sequence, which characteristic sequences differentiate a disease-causing nucleic acid sequence from a non-diseasing-causing nucleic acid sequence. In some embodiments, a common base sequence comprises or is a sequence complementary to a disease-associated nucleic acid sequence. In some embodiments, a common base sequence comprises or is a sequence 100% complementary to a disease-associated nucleic acid sequence. In some embodiments, a common base sequence comprises or is a sequence complementary to a characteristic sequence element of disease-associated nucleic acid sequence, which characteristic sequences differentiate a disease-associated nucleic acid sequence from a non-diseasing-associated nucleic acid sequence. In some embodiments, a common base sequence comprises or is a sequence 100% complementary to a characteristic sequence element of disease-associated nucleic acid sequence, which characteristic sequences differentiate a disease-associated nucleic acid sequence from a non-diseasing-associated nucleic acid sequence.

In some embodiments, a common base sequence comprises or is a sequence complementary to a gene. In some embodiments, a common base sequence comprises or is a sequence 100% complementary to a gene. In some embodiments, a common base sequence comprises or is a sequence complementary to a characteristic sequence element of a gene, which characteristic sequences differentiate the gene from a similar sequence sharing homology with the gene. In some embodiments, a common base sequence comprises or is a sequence 100% complementary to a characteristic sequence element of a gene, which characteristic sequences differentiate the gene from a similar sequence sharing homology with the gene. In some embodiments, a common base sequence comprises or is a sequence complementary to characteristic sequence element of a target gene, which characteristic sequences comprises a mutation that is not found in other copies of the gene, e.g., the wild-type copy of the gene, another mutant copy the gene, etc. In some embodiments, a common base sequence comprises or is a sequence 100% complementary to characteristic sequence element of a target gene, which characteristic sequences comprises a mutation that is not found in other copies of the gene, e.g., the wild-type copy of the gene, another mutant copy the gene, etc.

In some embodiments, a chiral internucleotidic linkage has the structure of Formula I. In some embodiments, a chiral internucleotidic linkage is phosphorothioate. In some embodiments, each chiral internucleotidic linkage in a single oligonucleotide of a provided composition independently has the structure of Formula I. In some embodiments, each chiral internucleotidic linkage in a single oligonucleotide of a provided composition is a phosphorothioate.

In some embodiments, oligonucleotides of the present disclosure comprise one or more modified sugar moieties. In some embodiments, oligonucleotides of the present disclosure comprise one or more modified base moieties. As known by a person of ordinary skill in the art and described in the disclosure, various modifications can be introduced to a sugar and/or moiety. For example, in some embodiments, a modification is a modification described in U.S. Pat. No. 9,006,198, WO2014/012081 and WO/2015/107425, the sugar and base modifications of each of which are incorporated herein by reference.

In some embodiments, a sugar modification is a 2'-modification. Commonly used 2'-modifications include but are not limited to 2'—OR', wherein $R^1$ is not hydrogen. In some embodiments, a modification is 2'—OR, wherein R is optionally substituted aliphatic. In some embodiments, a modification is 2'-OMe. In some embodiments, a modification is 2'-O-MOE. In some embodiments, the present disclosure demonstrates that inclusion and/or location of particular chirally pure internucleotidic linkages can provide stability improvements comparable to or better than those achieved through use of modified backbone linkages, bases, and/or sugars. In some embodiments, a provided single oligonucleotide of a provided composition has no modifications on the sugars. In some embodiments, a provided single oligonucleotide of a provided composition has no modifications on 2'-positions of the sugars (i.e., the two groups at the 2'-position are either —H/—H or -H/-OH). In some embodiments, a provided single oligonucleotide of a provided composition does not have any 2'-MOE modifications.

In some embodiments, a 2'-modification is —O-L- or -L- which connects the 2'-carbon of a sugar moiety to another carbon of a sugar moiety. In some embodiments, a 2'-modification is —O-L- or -L- which connects the 2'-carbon of a sugar moiety to the 4'-carbon of a sugar moiety. In some embodiments, a 2'-modification is S-cEt. In some embodiments, a modified sugar moiety is an LNA moiety.

In some embodiments, a 2'-modification is —F. In some embodiments, a 2'-modification is FANA. In some embodiments, a 2'-modification is FRNA.

In some embodiments, a sugar modification is a 5'-modification, e.g., R-5'-Me, S-5'-Me, etc.

In some embodiments, a sugar modification changes the size of the sugar ring. In some embodiments, a sugar modification is the sugar moiety in FHNA.

In some embodiments, a sugar modification replaces a sugar moiety with another cyclic or acyclic moiety. Examples of such moieties are widely known in the art, including but not limited to those used in morpholino (optionally with its phosphorodiamidate linkage), glycol nucleic acids, etc.

In some embodiments, a single oligonucleotide in a provided composition has at least about 25% of its internucleotidic linkages in Sp configuration. In some embodiments, a single oligonucleotide in a provided composition has at least about 30% of its internucleotidic linkages in Sp configuration. In some embodiments, a single oligonucleotide in a provided composition has at least about 35% of its internucleotidic linkages in Sp configuration. In some embodiments, a single oligonucleotide in a provided composition has at least about 40% of its internucleotidic linkages in Sp configuration. In some embodiments, a single oligonucleotide in a provided composition has at least about 45% of its internucleotidic linkages in Sp configuration. In some embodiments, a single oligonucleotide in a provided composition has at least about 50% of its internucleotidic linkages in Sp configuration. In some embodiments, a single oligonucleotide in a provided composition has at least about 55% of its internucleotidic linkages in Sp configuration. In some embodiments, a single oligonucleotide in a provided composition has at least about 60% of its internucleotidic linkages in Sp configuration. In some embodiments, a single oligonucleotide in a provided composition has at least about 65% of its internucleotidic linkages in Sp configuration. In some embodiments, a single oligonucleotide in a provided composition has at least about 70% of its internucleotidic linkages in Sp configuration. In some embodiments, a single oligonucleotide in a provided composition has at least about 75% of its internucleotidic linkages in Sp configuration. In some embodiments, a single oligonucleotide in a provided composition has at least about 80% of its internucleotidic linkages in Sp configuration. In some embodiments, a single oligonucleotide in a provided composition has at least about 85% of its internucleotidic linkages in Sp configuration. In some embodiments, a single oligonucleotide in a provided composition has at least about 90% of its internucleotidic linkages in Sp configuration.

In some embodiments, an ssRNAi agent is or comprises an oligonucleotide selected from the group consisting of WV-1275, WV-1277, WV-1307, WV-1308, WV-1308, WV-1828, WV-1829, WV-1830, WV-1831, WV-2110, WV-2110, WV-2110, WV-2110, WV-2110, WV-2110, WV-2111, WV-2111, WV-2112, WV-2113, WV-2113, WV-2146, WV-2147, WV-2148, WV-2149, WV-2150, WV-2151, WV-2152, WV-2153, WV-2154, WV-2155, WV-2156, WV-2157, WV-2386, WV-2386, WV-2420, WV-2477, WV-2652, WV-2653, WV-2654, WV-2655, WV-2656, WV-2657, WV-2658, WV-2693, WV-2696, WV-2697, WV-2698, WV-2699, WV-2712, WV-2713, WV-2714, WV-2715, WV-2716, WV-2717, WV-2718, WV-2719, WV-2720, WV-2721, WV-2721, WV-2817, WV-2818, WV-3021, WV-3068, WV-3069, WV-3107, WV-3122, WV-3122, WV-3124 to WV-3127, WV-3133 to WV-3137, WV-3242, WV-3247, WV-3755, WV-3755 to WV-3764, WV-3756, WV-3757, WV-3758, WV-3759, WV-3760, WV-3761, WV-3762, WV-3763, WV-3764, WV-3981, WV-3981 to WV-3985, WV-3982, WV-3983, WV-3984, WV-3985, WV-4007, WV-4007 to WV-4011, WV-4008, WV-4009, WV-4010, WV-4011, WV-4012, WV-4012 to WV-4017, WV-4013, WV-4014, WV-4015, WV-4016, WV-4017, WV-4018, WV-4019, WV-4020, WV-4021, WV-4022, WV-4023, WV-4024, WV-4025, WV-4026, WV-4027, WV-4028, WV-4029, WV-4030, WV-4031, WV-4032, WV-4033, WV-4034, WV-4035, WV-4036, WV-4037, WV-4038, WV-4039, WV-4040, WV-4041, WV-4042, WV-4043, WV-4044, WV-4045, WV-4046, WV-4047, WV-4048, WV-4049, WV-4050, WV-4051, WV-4052, WV-4053, WV-4054, WV-4055, WV-4056, WV-4057, WV-4058, WV-4059, WV-4060, WV-4061, WV-4062, WV-4063, WV-4064, WV-4065, WV-4075, WV-4098, WV-4161, WV-4264, WV-4264 to WV-4267, WV-4265, WV-4266, WV-4267, WV-4268, WV-4268 to WV-4277, WV-4269, WV-4270, WV-4271, WV-4272, WV-4273, WV-4274, WV-4275, WV-4276, WV-4277, WV-5288, WV-5289, WV-5289, WV-5290, WV-5291, WV-5292, WV-5293, WV-5294, WV-5295, WV-5296, WV-5297, WV-5298, WV-5299, WV-5300, WV-5301, WV-6214, WV-6215, WV-6411 to 6430, WV-6431, WV-6431 to WV-6438, WV-6439, WV-6763, WV-6764, WV-6764, WV-6765, WV-6766, WV-7316, WV-7462, WV-7463, WV-7464, WV-7465, WV-7465, WV-7466, WV-7466, WV-7467, WV-7468, WV-7468, WV-7469, WV-7521, WV-7522, WV-7523, WV-7524, WV-7525, WV-7526, WV-7527, WV-7528, WV-7540 to WV-7544, WV-7542, WV-7542, WV-7635, WV-7636, WV-7637, WV-7638, WV-7639, WV-7640, WV-7641, WV-7642, WV-7643, WV-7644, WV-7645, WV-7646, WV-7647, WV-7648, WV-7649, WV-7650, WV-7672, WV-7673, WV-2111, WV-2113, WV-2114, WV-2148, WV-2149, WV-2152, WV-2153, WV-2156, WV-2157, WV-2387, WV-3069, WV-7523, WV-7524, WV-7525, WV-7526, WV-7527, WV-7528, and any ssRNAi of any format described in FIG. 1 or otherwise herein.

In some embodiments, an ssRNAi agent is or comprises an oligonucleotide selected from the group consisting of any ssRNAi of any format described in FIG. 1 or otherwise herein. Those skilled in the art, reading the present specification, will appreciate that the present disclosure specifically does not exclude the possibility that any oligonucleotide described herein which is labeled as a ssRNAi agent may also or alternatively operate through another mechanism (e.g., as an antisense oligonucleotide; mediating knock-down via a RNaseH mechanism; sterically hindering translation; or any other biochemical mechanism).

In some embodiments, an antisense oligonucleotide (ASO) is or comprises an oligonucleotide selected from the group consisting of: WV-1308, WV-1391 to WV-1481, WV-1422, WV-1434 WV-1436, WV-1441, WV-1443, WV-1452, WV-1850 to WV-1891, WV-1863, WV-1864, WV-1868, WV-1870 WV-1871, WV-1876, WV-1878, WV-1883, WV-1884, WV-1885, WV-1886, WV-1887, WV-2110, WV-2111, WV-2114, WV-2115 to WV-2124, WV-2126, WV-2128 to WV-2139, WV-2134, WV-2134, WV-2141 WV-2372, WV-2372, WV-2386, WV-2387, WV-2420 WV-2477 WV-2549, WV-2549 to WV-2554, WV-2549 to WV-2554, WV-2550, WV-2551, WV-2552, WV-2553, WV-2553, WV-2554, WV-2554, WV-2644, WV-2645, WV-2646, WV-2647, WV-2677, WV-2678, WV-2678, WV-2722, WV-2723, WV-2724, WV-2725, WV-2726, WV-2727, WV-3021, WV-3367 to WV-3380, WV-3380, WV-3381, WV-3381 to WV-3394, WV-3387 WV-3387, WV-3390, WV-3391, WV-3392, WV-3393, WV-3394, WV-3394, WV-3394, WV-3395 to WV-3408, WV-3398, WV-3399, WV-3399, WV-3402, WV-3404, WV-3408, WV-3409 to WV-3422, WV-3411, WV-3413, WV-3416, WV-3421, WV-3423 to WV-3436, WV-3433, WV-3437 to WV-3450, WV-3443, WV-3443, WV-3451, WV-3452, WV-3453, WV-3454, WV-3455, WV-3456, WV-3457, WV-3458, WV-3459, WV-3460, WV-3461, WV-3462, WV-3858 to WV-3864, WV-3860 to WV-3864, WV-3860 to WV-3864, WV-3968, WV-4054, WV-437, WV-6003, WV-6003, WV-6822, WV-6823, WV-6824, WV-6825, WV-692 to WV-777, WV-723, WV-737, WV-742, WV-744, WV-753, WV-7778 to WV-7793, WV-7794 to WV-7816, WV-779 to WV-787, WV-7804 to WV-7808, WV-7804 to WV-7808, WV-7817 to WV-7839, WV-7827 to WV-7831, WV-7827 to WV-7831, WV-7840 to WV-7862, WV-7850 to WV-7854, WV-7850 to WV-7854, WV-788 to WV-873, WV-8030, WV-8044, WV-8111, WV-8112, WV-819, WV-833, WV-838, WV-840, WV-849, WV-875 to WV-883, WV-993, WV-1868, WV-2134, WV-3367, WV-3368, WV-3369, WV-3370, WV-3371, WV-3372, WV-3373, WV-3374, WV-3375, WV-3376, WV-3377, WV-3378, WV-3379, WV-3380, WV-3387, WV-6825, WV-2111, WV-2113, WV-2114, WV-2148, WV-2149, WV-2152, WV-2153, WV-2156, WV-2157, WV-2387, WV-3069, WV-7523, WV-7524, WV-7525, WV-7526, WV-7527, WV-7528, and any oligonucleotide of any format described in FIG. 2.

In some embodiments, an antisense oligonucleotide (ASO) is or comprises an oligonucleotide selected from the group consisting of any oligonucleotide of any format described in FIG. 2. Those skilled in the art, reading the present specification, will appreciate that the present disclosure specifically does not exclude the possibility that any oligonucleotide described herein which is labeled as an antisense oligonucleotide (ASO) may also or alternatively operate through another mechanism (e.g., as a ssRNAi utilizing RISC); the disclosure also notes that various ASOs may operate via different mechanisms (utilizing RNaseH, sterically blocking translation or other post-transcriptional processes, changing the conformation of a target nucleic acid, etc.).

In some embodiments, a hybrid oligonucleotide is or comprises an oligonucleotide selected from the group consisting of: WV-2111, WV-2113, WV-2114, WV-2148, WV-2149, WV-2152, WV-2153, WV-2156, WV-2157, WV-2387, WV-3069, WV-7523, WV-7524, WV-7525, WV-7526, WV-7527, WV-7528, and any oligonucleotide of any of Formats S40 to S42 of FIG. 1L; or Formats 30-32, 66-69 or 101-103 of FIG. 1. Those skilled in the art, reading the present specification, will appreciate that the present disclosure specifically does not exclude the possibility that any oligonucleotide described herein which is labeled as a hybrid oligonucleotide may also or alternatively operate through another mechanism (e.g., as an antisense oligonucleotide; mediating knock-down via a RNaseH mechanism; sterically hindering translation; or any other biochemical mechanism).

Chirally Controlled Oligonucleotides and Chirally Controlled Oligonucleotide Compositions In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides are chirally controlled.

The present disclosure provides chirally controlled oligonucleotides, and chirally controlled oligonucleotide compositions which are of high crude purity and of high diastereomeric purity. In some embodiments, the present disclosure provides chirally controlled oligonucleotides, and chirally controlled oligonucleotide compositions which are of high crude purity. In some embodiments, the present disclosure provides chirally controlled oligonucleotides, and chirally controlled oligonucleotide compositions which are of high diastereomeric purity.

In some embodiments, a single-stranded RNAi agent is a substantially pure preparation of an oligonucleotide type in that oligonucleotides in the composition that are not of the oligonucleotide type are impurities form the preparation process of said oligonucleotide type, in some case, after certain purification procedures.

In some embodiments, the present disclosure provides oligonucleotides comprising one or more diastereomerically pure internucleotidic linkages with respect to the chiral linkage phosphorus. In some embodiments, the present disclosure provides oligonucleotides comprising one or more diastereomerically pure internucleotidic linkages having the structure of Formula I. In some embodiments, the present disclosure provides oligonucleotides comprising one or more diastereomerically pure internucleotidic linkages with respect to the chiral linkage phosphorus, and one or more phosphate diester linkages. In some embodiments, the present disclosure provides oligonucleotides comprising one or more diastereomerically pure internucleotidic linkages having the structure of Formula I, and one or more phosphate diester linkages. In some embodiments, the present disclosure provides oligonucleotides comprising one or more diastereomerically pure internucleotidic linkages having the structure of Formula I-c, and one or more phosphate diester linkages. In some embodiments, such oligonucleotides are prepared by using stereoselective oligonucleotide synthesis, as described in this application, to form pre-designed diastereomerically pure internucleotidic linkages with respect to the chiral linkage phosphorus. Example internucleotidic linkages, including those having structures of Formula I, are further described below.

In some embodiments, the present disclosure provides a chirally controlled oligonucleotide, wherein at least two of the individual internucleotidic linkages within the oligonucleotide have different stereochemistry and/or different P-modifications relative to one another.

Internucleotidic Linkages

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides comprise any internucleotidic linkage described herein or known in the art.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any internucleotidic linkage described herein or known in the art.

A non-limiting example of an internucleotidic linkage or unmodified internucleotidic linkage is a phosphodiester; non-limiting examples of modified internucleotidic linkages include those in which one or more oxygen of a phosphodiester has been replaced by, as non-limiting examples, sulfur (as in a phosphorothioate), H, alkyl, or another moiety or element which is not oxygen. A non-limiting example of an internucleotidic linkage is a moiety which does not a comprise a phosphorus but serves to link two sugars. A non-limiting example of an internucleotidic linkage is a moiety which does not a comprise a phosphorus but serves to link two sugars in the backbone of an oligonucleotide. Disclosed herein are additional non-limiting examples of nucleotides, modified nucleotides, nucleotide analogs, internucleotidic linkages, modified internucleotidic linkages, bases, modified bases, and base analogs, sugars, modified sugars, and sugar analogs, and nucleosides, modified nucleosides, and nucleoside analogs.

In certain embodiments, a internucleotidic linkage has the structure of Formula I:

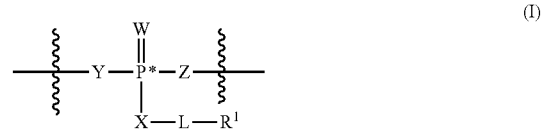

(I)

wherein each variable is as defined and described below. In some embodiments, a linkage of Formula I is chiral. In some embodiments, the present disclosure provides a chirally controlled oligonucleotide comprising one or more modified internucleotidic linkages of Formula I. In some embodiments, the present disclosure provides a chirally controlled oligonucleotide comprising one or more modified internucleotidic linkages of Formula I, and wherein individual internucleotidic linkages of Formula I within the oligonucleotide have different P-modifications relative to one another. In some embodiments, the present disclosure provides a chirally controlled oligonucleotide comprising one or more modified internucleotidic linkages of Formula I, and wherein individual internucleotidic linkages of Formula I within the oligonucleotide have different —X-L-R$^1$ relative to one another. In some embodiments, the present disclosure provides a chirally controlled oligonucleotide comprising one or more modified internucleotidic linkages of Formula I, and wherein individual internucleotidic linkages of Formula I within the oligonucleotide have different X relative to one another. In some embodiments, the present disclosure provides a chirally controlled oligonucleotide comprising one or more modified internucleotidic linkages of Formula I, and wherein individual internucleotidic linkages of Formula I within the oligonucleotide have different -L-R$^1$ relative to one another. In some embodiments, a chirally controlled oligonucleotide is an oligonucleotide in a provided composition that is of the particular oligonucleotide type. In some embodiments, a chirally controlled oligonucleotide is an oligonucleotide in a provided composition that has the common base sequence and length, the common pattern of backbone linkages, and the common pattern of backbone chiral centers. In some embodiments, a chirally controlled oligonucleotide is an oligonucleotide in a chirally controlled composition that is of the particular oligonucleotide type, and the chirally controlled oligonucleotide is of the type. In some embodiments, a chirally controlled oligonucleotide is an oligonucleotide in a provided composition that comprises a predetermined level of a plurality of oligonucleotides that share a common base sequence, a common pattern of backbone linkages, and a common pattern of backbone chiral centers, and the chirally controlled oligonucleotide shares the common base sequence, the common pattern of backbone linkages, and the common pattern of backbone chiral centers.

In some embodiments, a modified internucleotidic linkage is a non-negatively charged internucleotidic linkage. In some embodiments, a modified internucleotidic linkage is a neutral internucleotidic linkage. In some embodiments, provided oligonucleotides comprise one or more non-negatively charged internucleotidic linkages. In some embodiments, a non-negatively charged internucleotidic linkage is a positively charged internucleotidic linkage. In some embodiments, a non-negatively charged internucleotidic linkage is a neutral internucleotidic linkage. In some embodiments, a modified internucleotidic linkage (e.g., a non-negatively charged internucleotidic linkage) comprises optionally substituted triazolyl. In some embodiments, a modified internucleotidic linkage (e.g., a non-negatively charged internucleotidic linkage) comprises optionally substituted alkynyl. In some embodiments, a modified internucleotidic linkage comprises a triazole or alkyne moiety. In some embodiments, a triazole moiety, e.g., a triazolyl group, is optionally substituted. In some embodiments, a triazole moiety, e.g., a triazolyl group) is substituted. In some embodiments, a triazole moiety is unsubstituted. In some embodiments, a modified internucleotidic linkage comprises an optionally substituted cyclic guanidine moiety. In some embodiments, a modified internucleotidic linkage comprises an optionally substituted cyclic guanidine moiety and has the structure of:

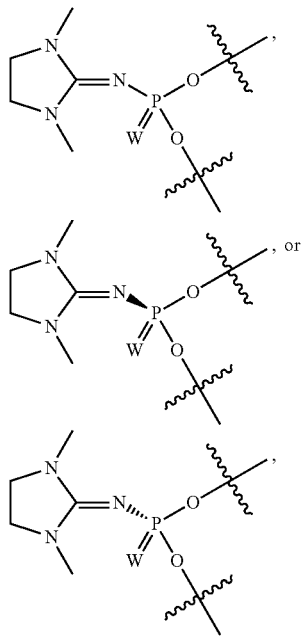

wherein W is O or S. In some embodiments, W is O. In some embodiments, W is S. In some embodiments, a non-negatively charged internucleotidic linkage is stereochemically controlled.

In some embodiments, an internucleotidic linkage comprising a triazole moiety (e.g., an optionally substituted triazolyl group) in a provided oligonucleotide, e.g., a DMD oligonucleotide, has the structure of:

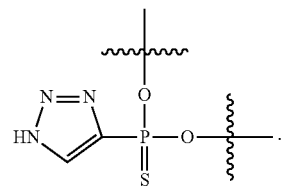

In some embodiments, an internucleotidic linkage comprising a triazole moiety has the formula of

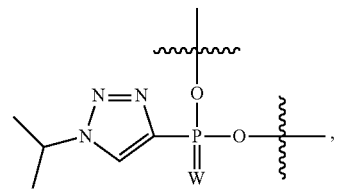

where W is O or S. In some embodiments, an internucleotidic linkage comprising an alkyne moiety (e.g., an optionally substituted alkynyl group) has the formula of:

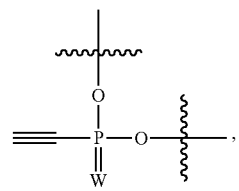

wherein W is O or S. In some embodiments, an internucleotidic linkage comprises a cyclic guanidine moiety. In some embodiments, an internucleotidic linkage comprising a cyclic guanidine moiety has the structure of:

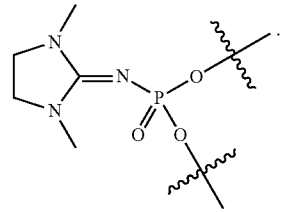

In some embodiments, a neutral internucleotidic linkage or internucleotidic linkage comprising a cyclic guanidine moiety is stereochemically controlled.

In some embodiments, a DMD oligonucleotide comprises a lipid moiety In some embodiments, an internucleotidic linkage comprises a Tmg group

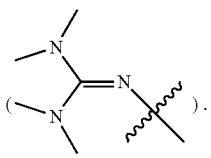 [SMILES: *N=C(N(C)C)N(C)C]

In some embodiments, an internucleotidic linkage comprises a Tmg group and has the structure of

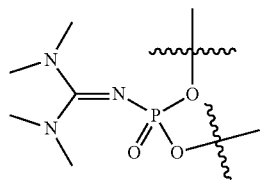

(the "Tmg internucleotidic linkage"). In some embodiments, neutral internucleotidic linkages include internucleotidic linkages of PNA and PMO, and an Tmg internucleotidic linkage.

In some embodiments, the present disclosure provides a composition comprising a plurality of oligonucleotides of a particular oligonucleotide type defined by:
1) base sequence;
2) pattern of backbone linkages;
3) pattern of backbone chiral centers; and
4) pattern of backbone phosphorus modifications,
wherein:
oligonucleotides of the plurality comprise at least 1, 2, 3, 4, 5, 6, 7, 8, 9, 10, 11, 12, 13, 14, 15, 16, 17, 18, 19, or 20 chirally controlled internucleotidic linkages; and
oligonucleotides of the plurality comprise at least 1, 2, 3, 4, 5, 6, 7, 8, 9, 10, 11, 12, 13, 14, 15, 16, 17, 18, 19, or 20 non-negatively charged internucleotidic linkages.

In some embodiments, a modified internucleotidic linkage has the structure of formula I, I-a, I-b, I-c, I-n-1, I-n-2, I-n-3, II, II-a-1, II-a-2, II-b-1, II-b-2, II-c-1, II-c-2, II-d-1, II-d-2, etc., or a salt form thereof. In some embodiments, a modified internucleotidic linkage has a structure of formula I or a salt form thereof. In some embodiments, a modified internucleotidic linkage has a structure of formula I-a or a salt form thereof.

In some embodiments, a modified internucleotidic linkage is a non-negatively charged internucleotidic linkage. In some embodiments, a modified internucleotidic linkage is a positively-charged internucleotidic linkage. In some embodiments, a modified internucleotidic linkage is a neutral internucleotidic linkage. In some embodiments, a non-negatively charged internucleotidic linkage has the structure of formula I, I-a, I-b, I-c, I-n-1, I-n-2, I-n-3, II, II-a-1, II-a-2, II-b-1, II-b-2, II-c-1, II-c-2, II-d-1, II-d-2, etc., or a salt form thereof. In some embodiments, a non-negatively charged internucleotidic linkage comprises an optionally substituted 3-20 membered heterocyclyl or heteroaryl group having 1-10 heteroatoms. In some embodiments, a non-negatively charged internucleotidic linkage comprises an optionally substituted 3-20 membered heterocyclyl or heteroaryl group having 1-10 heteroatoms, wherein at least one heteroatom is nitrogen. In some embodiments, such a heterocyclyl or heteroaryl group is of a 5-membered ring. In some embodiments, such a heterocyclyl or heteroaryl group is of a 6-membered ring.

In some embodiments, a non-negatively charged internucleotidic linkage comprises an optionally substituted 5-20 membered heteroaryl group having 1-10 heteroatoms. In some embodiments, a non-negatively charged internucleotidic linkage comprises an optionally substituted 5-20 membered heteroaryl group having 1-10 heteroatoms, wherein at least one heteroatom is nitrogen. In some embodiments, a non-negatively charged internucleotidic linkage comprises an optionally substituted 5-6 membered heteroaryl group having 1-4 heteroatoms, wherein at least one heteroatom is nitrogen. In some embodiments, a non-negatively charged internucleotidic linkage comprises an optionally substituted 5-membered heteroaryl group having 1-4 heteroatoms, wherein at least one heteroatom is nitrogen. In some embodiments, a heteroaryl group is directly bonded to a linkage phosphorus. In some embodiments, a non-negatively charged internucleotidic linkage comprises an optionally substituted triazolyl group. In some embodiments, a non-negatively charged internucleotidic linkage comprises an unsubstituted triazolyl group, e.g.,

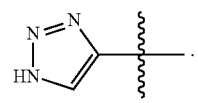

In some embodiments, a non-negatively charged internucleotidic linkage comprises a substituted triazolyl group, e.g.,

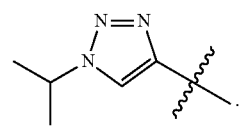 [SMILES: *c1cn(C(C)C)nn1]

In some embodiments, a non-negatively charged internucleotidic linkage comprises an optionally substituted 5-20 membered heterocyclyl group having 1-10 heteroatoms. In some embodiments, a non-negatively charged internucleotidic linkage comprises an optionally substituted 5-20 membered heterocyclyl group having 1-10 heteroatoms, wherein at least one heteroatom is nitrogen. In some embodiments, a non-negatively charged internucleotidic linkage comprises an optionally substituted 5-6 membered heterocyclyl group having 1-4 heteroatoms, wherein at least one heteroatom is nitrogen. In some embodiments, a non-negatively charged internucleotidic linkage comprises an optionally substituted 5-membered heterocyclyl group having 1-4 heteroatoms, wherein at least one heteroatom is nitrogen. In some embodiments, at least two heteroatoms are nitrogen. In some embodiments, a heterocyclyl group is directly bonded to a linkage phosphorus. In some embodiments, a heterocyclyl group is bonded to a linkage phosphorus through a linker, e.g., =N— when the heterocyclyl group is part of a guanidine moiety who directed bonded to a linkage phosphorus through its =N—. In some embodiments, a non-negatively charged internucleotidic linkage comprises an optionally substituted

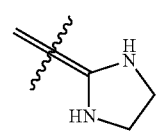

group. In some embodiments, a non-negatively charged internucleotidic linkage comprises an substituted

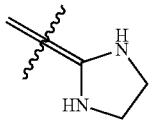

group. In some embodiments, a non-negatively charged internucleotidic linkage comprises a

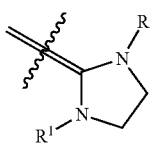

group. In some embodiments, each $R^1$ is independently optionally substituted $C_{1-6}$ alkyl. In some embodiments, each $R^1$ is independently methyl.

In some embodiments, a modified internucleotidic linkage, e.g., a non-negatively charged internucleotidic linkage, comprises a triazole or alkyne moiety, each of which is optionally substituted. In some embodiments, a modified internucleotidic linkage comprises a triazole moiety. In some embodiments, a modified internucleotidic linkage comprises a unsubstituted triazole moiety. In some embodiments, a modified internucleotidic linkage comprises a substituted triazole moiety. In some embodiments, a modified internucleotidic linkage comprises an alkyl moiety. In some embodiments, a modified internucleotidic linkage comprises an optionally substituted alkynyl group. In some embodiments, a modified internucleotidic linkage comprises an unsubstituted alkynyl group. In some embodiments, a modified internucleotidic linkage comprises a substituted alkynyl group. In some embodiments, an alkynyl group is directly bonded to a linkage phosphorus.

In some embodiments, an oligonucleotide comprises different types of internucleotidic phosphorus linkages. In some embodiments, a chirally controlled oligonucleotide comprises at least one natural phosphate linkage and at least one modified (non-natural) internucleotidic linkage. In some embodiments, an oligonucleotide comprises at least one natural phosphate linkage and at least one phosphorothioate. In some embodiments, an oligonucleotide comprises at least one non-negatively charged internucleotidic linkage. In some embodiments, an oligonucleotide comprises at least one natural phosphate linkage and at least one non-negatively charged internucleotidic linkage. In some embodiments, an oligonucleotide comprises at least one phosphorothioate internucleotidic linkage and at least one non-negatively charged internucleotidic linkage. In some embodiments, an oligonucleotide comprises at least one phosphorothioate internucleotidic linkage, at least one natural phosphate linkage, and at least one non-negatively charged internucleotidic linkage. In some embodiments, oligonucleotides comprise one or more, e.g., 1, 2, 3, 4, 5, 6, 7, 8, 9, 10, 11, 12, 13, 14, 15, 16, 17, 18, 19, 20 or more non-negatively charged internucleotidic linkages. In some embodiments, a non-negatively charged internucleotidic linkage is not negatively charged in that at a given pH in an aqueous solution less than 50%, 40%, 40%, 30%, 20%, 10%, 5%, or 1% of the internucleotidic linkage exists in a negatively charged salt form. In some embodiments, a pH is about pH 7.4. In some embodiments, a pH is about 4-9. In some embodiments, the percentage is less than 10%. In some embodiments, the percentage is less than 5%. In some embodiments, the percentage is less than 1%. In some embodiments, an internucleotidic linkage is a non-negatively charged internucleotidic linkage in that the neutral form of the internucleotidic linkage has no pKa that is no more than about 1, 2, 3, 4, 5, 6, or 7 in water. In some embodiments, no pKa is 7 or less. In some embodiments, no pKa is 6 or less. In some embodiments, no pKa is 5 or less. In some embodiments, no pKa is 4 or less. In some embodiments, no pKa is 3 or less. In some embodiments, no pKa is 2 or less. In some embodiments, no pKa is 1 or less. In some embodiments, pKa of the neutral form of an internucleotidic linkage can be represented by pKa of the neutral form of a compound having the structure of $CH_3$-the internucleotidic linkage-$CH_3$. For example, pKa of the neutral form of an internucleotidic linkage having the structure of formula I may be represented by the pKa of the neutral form of a compound having the structure of

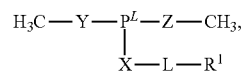

pKa of

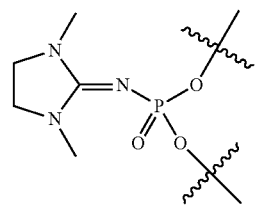

can be represented by pKa

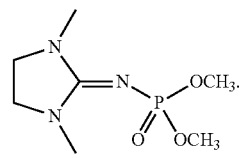

In some embodiments, a non-negatively charged internucleotidic linkage is a neutral internucleotidic linkage. In some embodiments, a non-negatively charged internucleotidic linkage is a positively-charged internucleotidic linkage. In some embodiments, a non-negatively charged internucleotidic linkage comprises a guanidine moiety. In some embodiments, a non-negatively charged internucleotidic linkage comprises a heteroaryl base moiety. In some embodiments, a non-negatively charged internucleotidic linkage comprises a triazole moiety. In some embodiments, a non-negatively charged internucleotidic linkage comprises an alkynyl moiety.

In some embodiments, a non-negatively charged internucleotidic linkage has the structure of formula I, I-a, I-b, I-c, I-n-1, I-n-2, I-n-3, II, II-a-1, II-a-2, II-b-1, II-b-2, II-c-1, II-c-2, II-d-1, II-d-2, or a salt form thereof (not negatively charged). In some embodiments, an internucleotidic linkage, e.g., a non-negatively charged internucleotidic linkage, has the structure of formula I-n-1 or a salt form thereof:

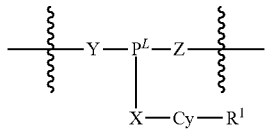

I-n-1

In some embodiments, X is a covalent bond and —X-Cy-$R^1$ is -Cy-$R^1$. In some embodiments, -Cy- is an optionally substituted bivalent group selected from a 5-20 membered heteroaryl ring having 1-10 heteroatoms, and a 3-20 membered heterocyclyl ring having 1-10 heteroatoms. In some embodiments, -Cy- is an optionally substituted bivalent 5-20 membered heteroaryl ring having 1-10 heteroatoms. In some embodiments, -Cy-$R^1$ is optionally substituted 5-20 membered heteroaryl ring having 1-10 heteroatoms, wherein at least one heteroatom is nitrogen. In some embodiments, -Cy-$R^1$ is optionally substituted 5-membered heteroaryl ring having 1-4 heteroatoms, wherein at least one heteroatom is nitrogen. In some embodiments, -Cy-$R^1$ is optionally substituted 6-membered heteroaryl ring having 1-4 heteroatoms, wherein at least one heteroatom is nitrogen. In some embodiments, -Cy-$R^1$ is optionally substituted triazolyl.

In some embodiments, an internucleotidic linkage, e.g., a non-negatively charged internucleotidic linkage, has the structure of formula I-n-2 or a salt form thereof:

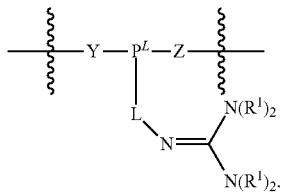

I-n-2

In some embodiments, $R^1$ is R'. In some embodiments, L is a covalent bond. In some embodiments, an internucleotidic linkage, e.g., a non-negatively charged internucleotidic linkage, has the structure of formula I-n-3 or a salt form thereof:

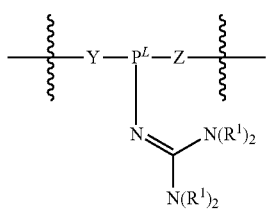

I-n-3

In some embodiments, two R' on different nitrogen atoms are taken together to form a ring as described. In some embodiments, a formed ring is 5-membered. In some embodiments, a formed ring is 6-membered. In some embodiments, a formed ring is substituted. In some embodiments, the two R' group that are not taken together to form a ring are each independently R. In some embodiments, the two R' group that are not taken together to form a ring are each independently hydrogen or an optionally substituted $C_{1-6}$ aliphatic. In some embodiments, the two R' group that are not taken together to form a ring are each independently hydrogen or an optionally substituted $C_{1-6}$ alkyl. In some embodiments, the two R' group that are not taken together to form a ring are the same. In some embodiments, the two R' group that are not taken together to form a ring are different. In some embodiments, both of them are —$CH_3$.

In some embodiments, a internucleotidic linkage, e.g., a non-negatively charged internucleotidic linkage, has the structure of formula II or a salt form thereof:

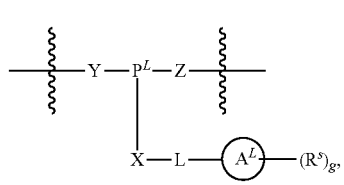

II or a salt form thereof, wherein:
$P^L$ is P(=W), P, or P→B(R')$_3$;
W is O, N(-L-$R^5$), S or Se;
each of X, Y and Z is independently O, S, N(L $R^5$)—, or L;
Ring $A^L$ is an optionally substituted 3-20 membered monocyclic, bicyclic or polycyclic ring having 0-10 heteroatoms;
each $R^s$ is independently —H, halogen, —CN, —$N_3$, —NO, —$NO_2$, -L-R', -L-Si(R)$_3$, -L-OR', -L-SR', -L-N(R')$_2$, —O-L-R', —O-L-Si(R)$_3$, —O-L-OR', —O-L-SR', or —O-L-N(R')$_2$;
g is 0-20;
each L is independently a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with $C_{1-6}$ alkylene, $C_{1-6}$ alkenylene, —C≡C—, a bivalent $C_1$-$C_6$ heteroaliphatic group having 1-5 heteroatoms, —C(R')$_2$—, -Cy-, —O—, —S—, —S—S—, —N(R')—, —C(O)—, —C(S)—, —C(NR')—, —C(O)N(R')—, —N(R')C(O)N (R')—, —N(R')C(O)O—, —S(O)—, —S(O)$_2$—, —S(O)$_2$N (R')—, —C(O)S—, —C(O)O—, —P(O)(OR')—, —P(O) (SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP (NR')O—, —OP(R')O—, or —OP(OR')[B(R')$_3$]O—, and one or more CH or carbon atoms are optionally and independently replaced with Cy$^L$;
each -Cy- is independently an optionally substituted bivalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;
each Cy$^L$ is independently an optionally substituted trivalent or tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;
each R' is independently —R, —C(O)R, —C(O)OR, or —S(O)$_2$R;
each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or, two or more R groups on the same atom are optionally and independently taken together with the atom to form an optionally substituted, 3-30 membered, monocyclic, bicyclic or polycyclic ring having, in addition to the atom, 0-10 heteroatoms, or two or more R groups on two or more atoms are optionally and independently taken together with their intervening atoms to form an optionally substituted, 3-30 membered, monocyclic, bicyclic or polycyclic ring having, in addition to the intervening atoms, 0-10 heteroatoms.

In some embodiments, a internucleotidic linkage, e.g., a non-negatively charged internucleotidic linkage of formula II, has the structure of formula II-a-1 or a salt form thereof:

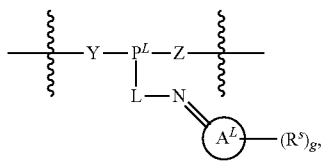

II-a-1 or a salt form thereof.

In some embodiments, a internucleotidic linkage, e.g., a non-negatively charged internucleotidic linkage of formula II, has the structure of formula II-a-2 or a salt form thereof:

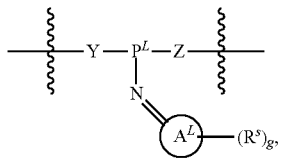

II-a-2 or a salt form thereof.

In some embodiments, $A^L$ is bonded to —N= or L through a carbon atom. In some embodiments, an internucleotidic linkage, e.g., a non-negatively charged internucleotidic linkage of formula II or II-a-1, II-a-2, has the structure of formula II-b-1 or a salt form thereof:

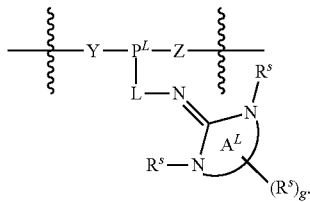

II-b-1

In some embodiments, a structure of formula II-a-1 or II-a-2 may be referred to a structure of formula II-a. In some embodiments, a structure of formula II-b-1 or II-b-2 may be referred to a structure of formula II-b. In some embodiments, a structure of formula II-c-1 or II-c-2 may be referred to a structure of formula II-c. In some embodiments, a structure of formula II-d-1 or II-d-2 may be referred to a structure of formula II-d.

In some embodiments, $A^L$ is bonded to —N= or L through a carbon atom. In some embodiments, an internucleotidic linkage, e.g., a non-negatively charged internucleotidic linkage of formula II or II-a-1, II-a-2, has the structure of formula II-b-2 or a salt form thereof:

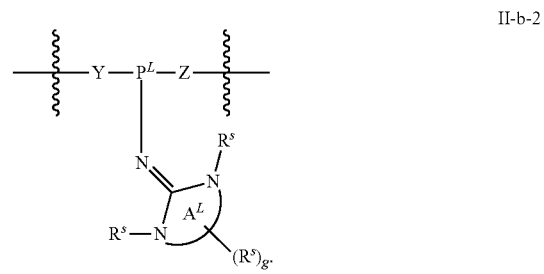

II-b-2

In some embodiments, Ring $A^L$ is an optionally substituted 3-20 membered monocyclic ring having 0-10 heteroatoms (in addition to the two nitrogen atoms for formula II-b). In some embodiments, Ring $A^L$ is an optionally substituted 5-membered monocyclic saturated ring.

In some embodiments, an internucleotidic linkage, e.g., a non-negatively charged internucleotidic linkage of formula II, II-a, or II-b, has the structure of formula II-c-1 or a salt form thereof:

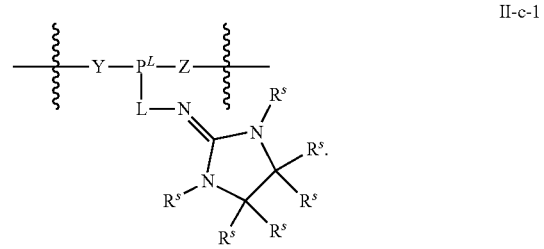

II-c-1

In some embodiments, an internucleotidic linkage, e.g., a non-negatively charged internucleotidic linkage of formula II, II-a, or II-b, has the structure of formula II-c-2 or a salt form thereof:

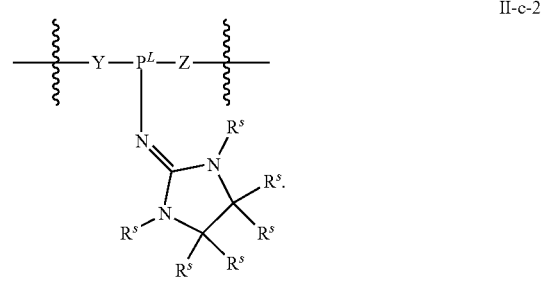

II-c-2

In some embodiments, an internucleotidic linkage, e.g., a non-negatively charged internucleotidic linkage of formula II, II-a, II-b, or II-c has the structure of formula II-d-1 or a salt form thereof:

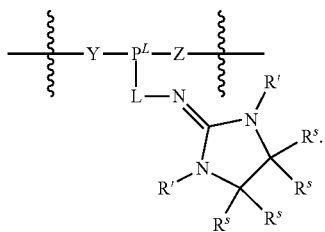

II-d-1

In some embodiments, an internucleotidic linkage, e.g., a non-negatively charged internucleotidic linkage of formula II, II-a, II-b, or II-c has the structure of formula II-d-2 or a salt form thereof:

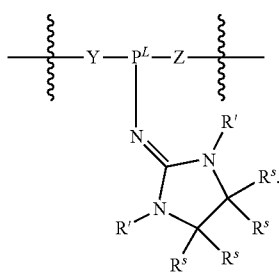

II-d-2

In some embodiments, each R' is independently optionally substituted $C_{1-6}$ aliphatic. In some embodiments, each R' is independently optionally substituted $C_{1-6}$ alkyl. In some embodiments, each R' is independently —$CH_3$. In some embodiments, each $R^s$ is —H.

In some embodiments, a non-negatively charged internucleotidic linkage has the structure of

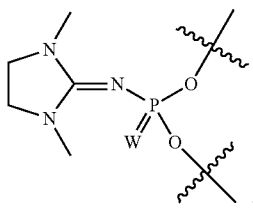

In some embodiments, a non-negatively charged internucleotidic linkage has the structure of

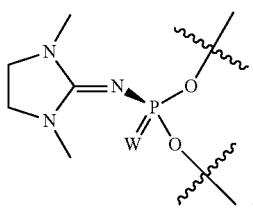

In some embodiments, a non-negatively charged internucleotidic linkage has the structure of

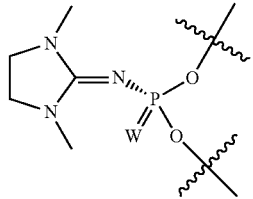

In some embodiments, a non-negatively charged internucleotidic linkage has the structure of

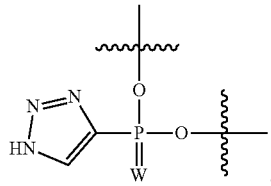

In some embodiments, a non-negatively charged internucleotidic linkage has the structure of

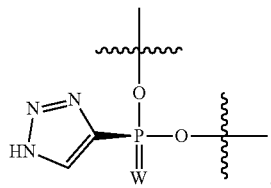

In some embodiments, a non-negatively charged internucleotidic linkage has the structure of

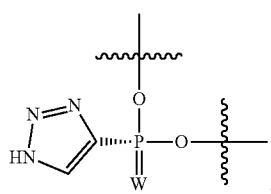

In some embodiments, a non-negatively charged internucleotidic linkage has the structure of

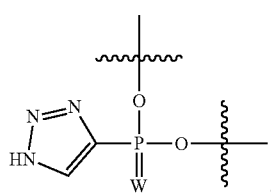

In some embodiments, a non-negatively charged internucleotidic linkage has the structure of

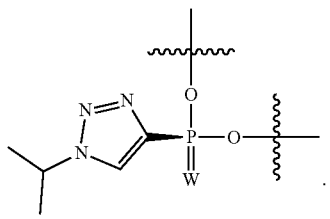

In some embodiments, a non-negatively charged internucleotidic linkage has the structure of

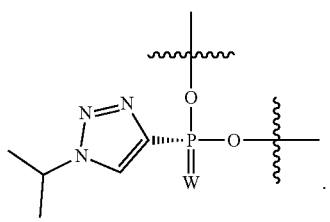

In some embodiments, a non-negatively charged internucleotidic linkage has the structure of

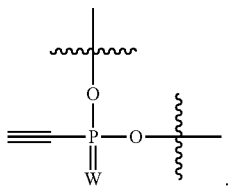

In some embodiments, a non-negatively charged internucleotidic linkage has the structure of

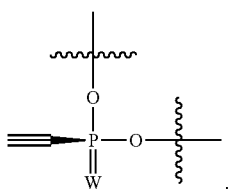

In some embodiments, a non-negatively charged internucleotidic linkage has the structure of

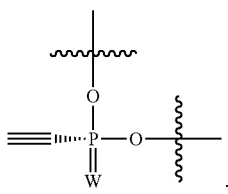

In some embodiments, W is O. In some embodiments, W is S.

In some embodiments, each $L^P$ independently has the structure of formula I, I-a, I-b, I-c, I-n-1, I-n-2, I-n-3, II, II-a-1, II-a-2, II-b-1, II-b-2, II-c-1, II-c-2, II-d-1, II-d-2, or a salt form thereof.

In some embodiments, the present disclosure provides oligonucleotides comprising one or more non-negatively charged internucleotidic linkages. In some embodiments, a non-negatively charged internucleotidic linkage is a neutral internucleotidic linkage. In some embodiments, the present disclosure provides oligonucleotides comprising one or more neutral internucleotidic linkages. In some embodiments, a non-negatively charged internucleotidic linkage has the structure of formula I-n-1, I-n-2, I-n-3, II, II-a-1, II-a-2, II-b-1, II-b-2, II-c-1, II-c-2, II-d-1, II-d-2, or a salt form thereof.

In some embodiments, a non-negatively charged internucleotidic linkage comprises a triazole moiety. In some embodiments, a non-negatively charged internucleotidic linkage comprises an optionally substituted triazolyl group. In some embodiments, a non-negatively charged internucleotidic linkage has the structure of

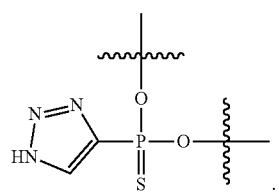

In some embodiments, a non-negatively charged internucleotidic linkage has the structure of

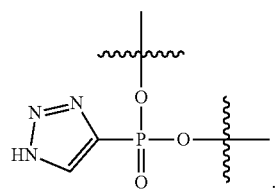

In some embodiments, a non-negatively charged internucleotidic linkage comprises a substituted triazolyl group. In some embodiments, a non-negatively charged internucleotidic linkage has the structure of

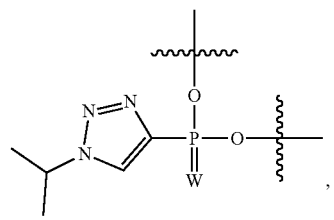

wherein W is O or S. In some embodiments, a non-negatively charged internucleotidic linkage comprises an optionally substituted alkynyl group. In some embodiments, a non-negatively charged internucleotidic linkage has the structure of

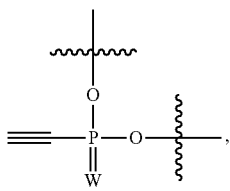

wherein W is O or S.

In some embodiments, the present disclosure provides oligonucleotides comprising an internucleotidic linkage, e.g., a non-negatively charged internucleotidic linkage, which comprises a cyclic guanidine moiety. In some embodiments, an internucleotidic linkage comprises a cyclic guanidine and has the structure of:

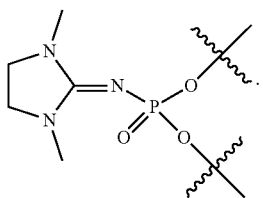

In some embodiments, an internucleotidic linkage, e.g., a non-negatively charged internucleotidic linkage, comprising a cyclic guanidine is stereochemically controlled.

In some embodiments, a non-negatively charged internucleotidic linkage, or a neutral internucleotidic linkage, is or comprising a structure selected from

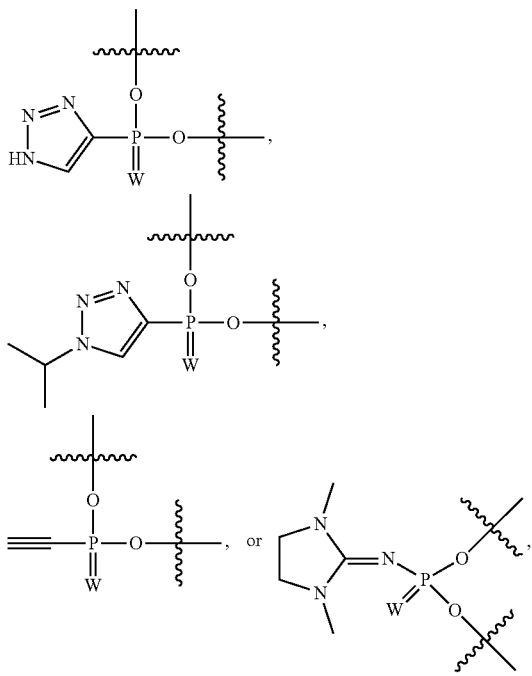

wherein W is O or S. In some embodiments, a non-negatively charged internucleotidic linkage is a chirally controlled internucleotidic linkage. In some embodiments, a neutral internucleotidic linkage is a chirally controlled internucleotidic linkage. In some embodiments, a nucleic acid or an oligonucleotide comprising a modified internucleotidic linkage comprising a cyclic guanidine moiety is a siRNA, double-stranded siRNA, single-stranded siRNA, gapmer, skipmer, blockmer, antisense oligonucleotide, antagomir, microRNA, pre-microRNs, antimir, supermir, ribozyme, U1 adaptor, RNA activator, RNAi agent, decoy oligonucleotide, triplex forming oligonucleotide, aptamer or adjuvant.

In some embodiments, an oligonucleotide comprises a neutral internucleotidic linkage and a chirally controlled internucleotidic linkage. In some embodiments, an oligonucleotide comprises a neutral internucleotidic linkage and a chirally controlled internucleotidic linkage which is a phosphorothioate in the Rp or Sp configuration. In some embodiments, the present disclosure provides an oligonucleotide comprising one or more non-negatively charged internucleotidic linkages and one or more phosphorothioate internucleotidic linkage, wherein each phosphorothioate internucleotidic linkage in the oligonucleotide is independently a chirally controlled internucleotidic linkage. In some embodiments, the present disclosure provides an oligonucleotide comprising one or more neutral internucleotidic linkages and one or more phosphorothioate internucleotidic linkage, wherein each phosphorothioate internucleotidic linkage in the oligonucleotide is independently a chirally controlled internucleotidic linkage. In some embodiments, a provided oligonucleotide comprises at least 5, 6, 7, 8, 9, 10, 11, 12, 13, 14, 15, 16, 17, 18, 19, 20 or more chirally controlled phosphorothioate internucleotidic linkages.

Without wishing to be bound by any particular theory, the present disclosure notes that a neutral internucleotidic linkage can be more hydrophobic than a phosphorothioate internucleotidic linkage (PS), which is more hydrophobic than a phosphodiester linkage (natural phosphate linkage, PO). Typically, unlike a PS or PO, a neutral internucleotidic linkage bears less charge. Without wishing to be bound by any particular theory, the present disclosure notes that incorporation of one or more neutral internucleotidic linkages into an oligonucleotide may increase oligonucleotides' ability to be taken up by a cell and/or to escape from endosomes. Without wishing to be bound by any particular theory, the present disclosure notes that incorporation of one or more neutral internucleotidic linkages can be utilized to modulate melting temperature between an oligonucleotide and its target nucleic acid.

Without wishing to be bound by any particular theory, the present disclosure notes that incorporation of one or more non-negatively charged internucleotidic linkages, e.g., neutral internucleotidic linkages, into an oligonucleotide may be able to increase the oligonucleotide's ability to mediate a function such as exon skipping or gene knockdown. In some embodiments, an oligonucleotide capable of mediating knockdown of level of a nucleic acid or a product encoded thereby comprises one or more non-negatively charged internucleotidic linkages. In some embodiments, an oligonucleotide capable of mediating knockdown of expression of a target gene comprises one or more non-negatively charged internucleotidic linkages. In some embodiments, an oligonucleotide capable of mediating knockdown of expression of a target gene comprises one or more neutral internucleotidic linkages.

In some embodiments, a non-negatively charged internucleotidic linkage is not chirally controlled. In some embodiments, a non-negatively charged internucleotidic linkage is chirally controlled. In some embodiments, a non-negatively charged internucleotidic linkage is chirally controlled and its linkage phosphorus is Rp. In some embodiments, a non-negatively charged internucleotidic linkage is chirally controlled and its linkage phosphorus is Sp.

In some embodiments, a provided oligonucleotide comprises 1, 2, 3, 4, 5, 6, 7, 8, 9, 10, or more non-negatively charged internucleotidic linkages. In some embodiments, a provided oligonucleotide comprises 1, 2, 3, 4, 5, 6, 7, 8, 9, 10, or more neutral internucleotidic linkages. In some embodiments, each of non-negatively charged internucleotidic linkage and/or neutral internucleotidic linkages is optionally and independently chirally controlled. In some embodiments, each non-negatively charged internucleotidic linkage in an oligonucleotide is independently a chirally controlled internucleotidic linkage. In some embodiments, each neutral internucleotidic linkage in an oligonucleotide is independently a chirally controlled internucleotidic linkage. In some embodiments, at least one non-negatively charged internucleotidic linkage/neutral internucleotidic linkage has the structure of

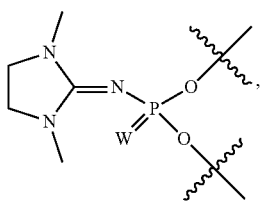

wherein W is O or S. In some embodiments, at least one non-negatively charged internucleotidic linkage/neutral internucleotidic linkage has the structure of

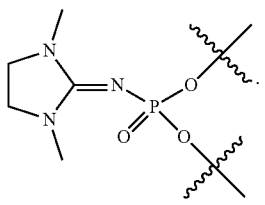

In some embodiments, at least one non-negatively charged internucleotidic linkage/neutral internucleotidic linkage has the structure of

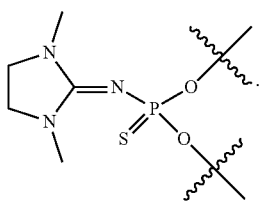

In some embodiments, at least one non-negatively charged internucleotidic linkage/neutral internucleotidic linkage has the structure of

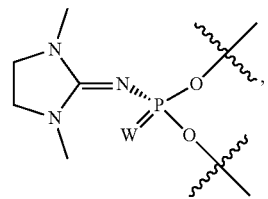

wherein W is O or S. In some embodiments, at least one non-negatively charged internucleotidic linkage/neutral internucleotidic linkage has the structure of

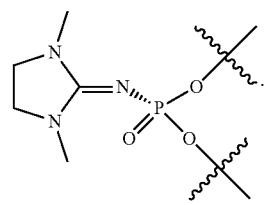

In some embodiments, at least one non-negatively charged internucleotidic linkage/neutral internucleotidic linkage has the structure of

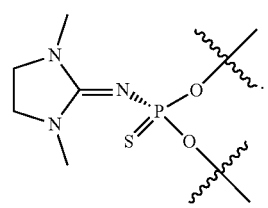

In some embodiments, at least one non-negatively charged internucleotidic linkage/neutral internucleotidic linkage has the structure of

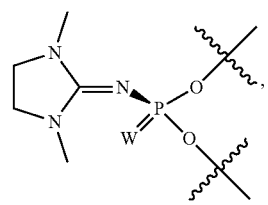

wherein W is O or S. In some embodiments, at least one non-negatively charged internucleotidic linkage/neutral internucleotidic linkage has the structure of

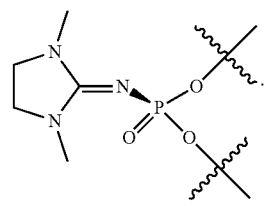

In some embodiments, at least one non-negatively charged internucleotidic linkage/neutral internucleotidic linkage has the structure of

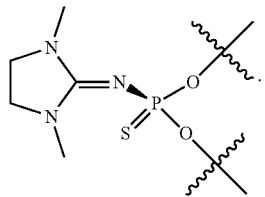

In some embodiments, a provided oligonucleotide comprises at least one non-negatively charged internucleotidic linkage wherein its linkage phosphorus is in Rp configuration, and at least one non-negatively charged internucleotidic linkage wherein its linkage phosphorus is in Sp configuration.

In some embodiments, the present disclosure provides a chirally controlled oligonucleotide, wherein at least two of the individual internucleotidic linkages within the oligonucleotide have different stereochemistry and/or different P-modifications relative to one another and the oligonucleotide has a structure represented by the following formula:

$$[S^Bn1R^Bn2S^Bn3R^Bn4 \ldots S^BnxR^Bny]$$

wherein:
each $R^B$ independently represents a block of nucleotide units having the R configuration at the linkage phosphorus;
each $S^B$ independently represents a block of nucleotide units having the S configuration at the linkage phosphorus;
each of n1-ny is zero or an integer, with the requirement that at least one odd n and at least one even n must be non-zero so that the oligonucleotide includes at least two individual internucleotidic linkages with different stereochemistry relative to one another; and
wherein the sum of n1-ny is between 2 and 200, and in some embodiments is between a lower limit selected from the group consisting of 2, 3, 4, 5, 6, 7, 8, 9, 10, 11, 12, 13, 14, 15, 16, 17, 18, 19, 20, 21, 22, 23, 24, 25 or more and an upper limit selected from the group consisting of 5, 10, 15, 20, 25, 30, 35, 40, 45, 50, 55, 60, 65, 70, 75, 80, 85, 90, 95, 100, 110, 120, 130, 140, 150, 160, 170, 180, 190, and 200, the upper limit being larger than the lower limit.

In some such embodiments, each n has the same value; in some embodiments, each even n has the same value as each other even n; in some embodiments, each odd n has the same value each other odd n; in some embodiments, at least two even ns have different values from one another; in some embodiments, at least two odd ns have different values from one another.

In some embodiments, at least two adjacent ns are equal to one another, so that a provided oligonucleotide includes adjacent blocks of S stereochemistry linkages and R stereochemistry linkages of equal lengths. In some embodiments, provided oligonucleotides include repeating blocks of S and R stereochemistry linkages of equal lengths. In some embodiments, provided oligonucleotides include repeating blocks of S and R stereochemistry linkages, where at least two such blocks are of different lengths from one another; in some such embodiments each S stereochemistry block is of the same length, and is of a different length from each R stereochemistry length, which may optionally be of the same length as one another.

In some embodiments, at least two skip-adjacent ns are equal to one another, so that a provided oligonucleotide includes at least two blocks of linkages of a first stereochemistry that are equal in length to one another and are separated by a block of linkages of the other stereochemistry, which separating block may be of the same length or a different length from the blocks of first stereochemistry.

In some embodiments, ns associated with linkage blocks at the ends of a provided oligonucleotide are of the same length. In some embodiments, provided oligonucleotides have terminal blocks of the same linkage stereochemistry. In some such embodiments, the terminal blocks are separated from one another by a middle block of the other linkage stereochemistry.

In some embodiments, a provided oligonucleotide of formula $[S^Bn1R^Bn2S^Bn3R^Bn4 \ldots S^BnxR^Bny]$ is a stereoblockmer. In some embodiments, a provided oligonucleotide of formula $[S^Bn1R^Bn2S^Bn3R^Bn4 \ldots S^BnxR^Bny]$ is a stereoskipmer. In some embodiments, a provided oligonucleotide of formula $[S^Bn1R^Bn2S^Bn3R^Bn4 \ldots S^BnxR^Bny]$ is a stereoaltmer. In some embodiments, a provided oligonucleotide of formula $[S^Bn1R^Bn2S^Bn3R^Bn4 \ldots S^BnxR^Bny]$ is a gapmer.

In some embodiments, a provided oligonucleotide of formula $[S^Bn1R^Bn2S^Bn3R^Bn4 \ldots S^BnxR^Bny]$ is of any of the above described patterns and further comprises patterns of P-modifications. For instance, in some embodiments, a provided oligonucleotide of formula $[S^Bn1R^Bn2S^Bn3R^Bn4 \ldots S^BnxR^Bny]$ and is a stereoskipmer and P-modification skipmer. In some embodiments, a provided oligonucleotide of formula $[S^Bn1R^Bn2S^Bn3R^Bn4 \ldots S^BnxR^Bny]$ and is a stereoblockmer and P-modification altmer. In some embodiments, a provided oligonucleotide of formula $[S^Bn1R^Bn2S^Bn3R^Bn4 \ldots S^BnxR^Bny]$ and is a stereoaltmer and P-modification blockmer.

In some embodiments, a provided oligonucleotide of formula $[S^Bn1R^Bn2S^Bn3R^Bn4 \ldots S^BnxR^Bny]$ is a chirally controlled oligonucleotide comprising one or more modified internucleotidic linkages independently having the structure of Formula I:

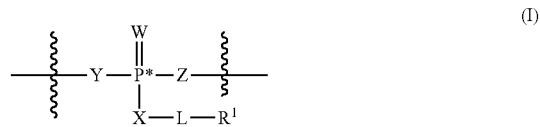

wherein:
P* is a symmetric phosphorus atom, or asymmetric phosphorus atom that is either Rp or Sp;
W is O, S or Se;
each of X, Y and Z is independently —O—, —S—, —N(-L-R¹)—, or L;
L is a covalent bond or an optionally substituted, linear or branched $C_1$-$C_{10}$ alkylene, wherein one or more methylene units of L are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')₂—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)₂—, —S(O)₂N(R')—, —N(R')S(O)₂— —SC(O)—, —C(O)S—, —OC(O)—, and —C(O)O—;

R¹ is halogen, R, or an optionally substituted $C_1$-$C_{50}$ aliphatic wherein one or more methylene units are optionally and independently replaced by an optionally substituted group selected from $C_1$-$C_6$ alkylene, $C_1$-$C_6$ alkenylene, —C≡C—, $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O— each R' is independently —R, —C(O)R, —CO$_2$R, or —SO$_2$R, or:
  two $R^{Z1}$ are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, and heterocyclylene;

each R is independently hydrogen, or an optionally substituted group selected from $C_1$-$C_6$ aliphatic, carbocyclyl, aryl, heteroaryl, and heterocyclyl; and each

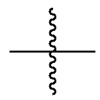

independently represents a connection to a nucleoside.

In some embodiments, L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$, -Cy-, O, S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

R¹ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$, -Cy-, —O—, —S—, —S—S—, N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

each R' is independently —R, —C(O)R, —CO$_2$R, or —SO$_2$R, or:
  two R' on the same nitrogen are taken together with their intervening atoms to form an optionally substituted heterocyclic or heteroaryl ring, or
  two R' on the same carbon are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, and heterocyclylene;

each R is independently hydrogen, or an optionally substituted group selected from $C_1$-$C_6$ aliphatic, phenyl, carbocyclyl, aryl, heteroaryl, and heterocyclyl; and each

independently represents a connection to a nucleoside.

In some embodiments, a chirally controlled oligonucleotide comprises one or more modified internucleotidic phosphorus linkages. In some embodiments, a chirally controlled oligonucleotide comprises, e.g., a phosphorothioate or a phosphorothioate triester linkage. In some embodiments, a chirally controlled oligonucleotide comprises a phosphorothioate triester linkage. In some embodiments, a chirally controlled oligonucleotide comprises at least two phosphorothioate triester linkages. In some embodiments, a chirally controlled oligonucleotide comprises at least three phosphorothioate triester linkages. In some embodiments, a chirally controlled oligonucleotide comprises at least four phosphorothioate triester linkages. In some embodiments, a chirally controlled oligonucleotide comprises at least five phosphorothioate triester linkages. Examples of such modified internucleotidic phosphorus linkages are described further herein.

In some embodiments, a chirally controlled oligonucleotide comprises different internucleotidic phosphorus linkages. In some embodiments, a chirally controlled oligonucleotide comprises at least one phosphate diester internucleotidic linkage and at least one modified internucleotidic linkage. In some embodiments, a chirally controlled oligonucleotide comprises at least one phosphate diester internucleotidic linkage and at least one phosphorothioate triester linkage. In some embodiments, a chirally controlled oligonucleotide comprises at least one phosphate diester internucleotidic linkage and at least two phosphorothioate triester linkages. In some embodiments, a chirally controlled oligonucleotide comprises at least one phosphate diester internucleotidic linkage and at least three phosphorothioate triester linkages. In some embodiments, a chirally controlled oligonucleotide comprises at least one phosphate diester internucleotidic linkage and at least four phosphorothioate triester linkages. In some embodiments, a chirally controlled oligonucleotide comprises at least one phosphate diester internucleotidic linkage and at least five phosphorothioate triester linkages. Examples of such modified internucleotidic phosphorus linkages are described further herein.

In some embodiments, a phosphorothioate triester linkage comprises a chiral auxiliary, which, for example, is used to control the stereoselectivity of a reaction. In some embodiments, a phosphorothioate triester linkage does not comprise a chiral auxiliary. In some embodiments, a phosphorothioate triester linkage is intentionally maintained until and/or during the administration to a subject.

In some embodiments, a chirally controlled oligonucleotide is linked to a solid support. In some embodiments, a chirally controlled oligonucleotide is cleaved from a solid support.

In some embodiments, a chirally controlled oligonucleotide comprises at least one phosphate diester internucleotidic linkage and at least two consecutive modified internucleotidic linkages. In some embodiments, a chirally controlled oligonucleotide comprises at least one phosphate diester internucleotidic linkage and at least two consecutive phosphorothioate triester internucleotidic linkages.

In some embodiments, the present disclosure provides compositions comprising or consisting of a plurality of provided oligonucleotides (e.g., chirally controlled oligonucleotide compositions). In some embodiments, all such provided oligonucleotides are of the same type, i.e., all have the same base sequence, pattern of backbone linkages (i.e., pattern of internucleotidic linkage types, for example, phosphate, phosphorothioate, etc), pattern of backbone chiral centers (i.e. pattern of linkage phosphorus stereochemistry (Rp/Sp)), and pattern of backbone phosphorus modifications (e.g., pattern of "-XLR$^1$" groups in Formula I, disclosed herein). In some embodiments, all oligonucleotides of the same type are identical. In many embodiments, however, provided compositions comprise a plurality of oligonucleotides types, typically in pre-determined relative amounts.

In some embodiments, a provided oligonucleotide comprises a pattern of backbone linkages. In some embodiments, a pattern of backbone linkages is or comprises a sequence of any of: OOO, OOOO, OOOOO, OOOOOOO, OOOOOOO, OOOOOOOO, OOOOOOOOO, OOOOOOOOOO, OXOX, OXOX, OXXO, XOOX, XXOOXX, XOXOXOXX, OXOXOXOO, XXX, XXXX, XXXXX, XXXXXX, XXXXXXX, XXXXXXXX, XXXXXXXXX, XXXXXXXXXX, OOOOOOOOOOOOOOOOO, OOOOOOOOOOOOOOOOO, OOOOOOOOOOOOOOOOO, OOOOOOOOOOOOOOOOO, OOOOOOOOOOOOOOOOOO, OOOOOOOOOOOOOOOOOOO, XOXOXOXOOOXOOXXXXXO, XOXOXOXOXOXOOOOOOOXX, XOXOXOXOXOXOOOOOOXX, XOXOXOXOXOXOOOOOXXX, XOXOXOXOXOXOXOOOOOOXX, XOXOXOXOXOXOXOOOOXX, XOXOXOXOXOXOXXXXXX, XOXOXOXOXOXOXXXXXXO, XOXOXOXOXOXOXXXXXXX, XOXOXOXOXOXOXXXXXXXXXO, XOXOXOXOXOXOXXXXXXXXXX, XXOXOXOXOOOXOOXXXXXO, XXOXOXOXOXOXOOOOOOOXX, XXOXOXOXOXOXOOOOOOXX, XXOXOXOXOXOXOOOOOXXX, XXOXOXOXOXOXOXOOOOOOXX, XXOXOXOXOXOXOXOOOOXX, XXOXOXOXOXOXOXXXXXX, XXOXOXOXOXOXOXXXXXXO, XXOXOXOXOXOXOXXXXXXX, XXOXOXOXOXOXOXXXXXXXXXO, XXOXOXOXOXOXOXXXXXXXXXX, XXOXOXXXOOOXOOXXXXXO, XXOXOXXXOXOXOOOOOOOXX, XXOXOXXXOXOXOOOOOOXX, XXOXOXXXOXOXOOOOOXXX, XXOXOXXXOXOXOXOOOOOOXX, XXOXOXXXOXOXOXOOOOXX, XXOXOXXXOXOXOXXXXXX, XXOXOXXXOXOXOXXXXXXO, XXOXOXXXOXOXOXXXXXXX, XXOXOXXXOXOXOXXXXXXXXXO, XXOXOXXXOXOXOXXXXXXXXXX, XXOXXXOXOXXOOOOOOOOXX, XXOXOXXXOXXXOXXXXXX,
XXOXOXXXOXXXOXXXXXXO,
XXOXOXXXOXXXOXXXXXXX,
XXOXOXXXOXXXOXXXXXXXXXO,
XXOXOXXXOXXXOXXXXXXXXXX,
XXOXOXXXXOOXOOXXXXXO,
XXOXOXXXXXOXOOOOOOOXX,
XXOXOXXXXXOXOOOOOXX,
XXOXOXXXXXOXOOOOOXXX,
XXOXOXXXXXOXOXOOOOOOXX,
XXOXOXXXXXOXOXOOOOXX,
XXOXOXXXXXOXOXXXXXX,
XXOXOXXXXXOXOXXXXXXO,
XXOXOXXXXXOXOXXXXXXX,
XXOXOXXXXXOXOXXXXXXXXXO,
XXOXOXXXXXOXOXXXXXXXXXX,
XXOXXXOXOOOXOOXXXXXO,
XXOXXXOXOXOXOOOOOOOXX,
XXOXXXOXOXOXOOOOOOXX,
XXOXXXOXOXOXOOOOOXXX,
XXOXXXOXOXOXOXOOOOOOXX,
XXOXXXOXOXOXOXOOOOXX,
XXOXXXOXOXOXOXXXXXX,
XXOXXXOXOXOXOXXXXXXO,
XXOXXXOXOXOXOXXXXXXX,
XXOXXXOXOXOXOXXXXXXXXXO,
XXOXXXOXOXOXOXXXXXXXXXX,
XXOXXXOXOXXOOOOOOOOXX,
XXOXXXOXOXXOOOOOOXX,
XXOXXXOXOXXOOOOOXXX,
XXOXXXOXOXXXOXOOOOOOXX,
XXOXXXOXOXXXOXOOOOXX,
XXOXXXOXOXXXOXXXXXX,
XXOXXXOXOXXXOXXXXXXO,
XXOXXXOXOXXXOXXXXXXX,
XXOXXXOXOXXXOXXXXXXXXXO,
XXOXXXOXOXXXOXXXXXXXXXX,
XXOXXXOXXOOXOOXXXXXO,
XXOXXXOXXXOXOOOOOOOXX,
XXOXXXOXXXOXOOOOOOXX,
XXOXXXOXXXOXOOOOOXXX,
XXOXXXXOXXXOXOXOOOOOOXX,
XXOXXXXOXXXOXOXOOOOOXX,
XXOXXXXOXXXOXOXXXXXX,
XXOXXXXOXXXOXOXXXXXXO,
XXOXXXXOXXXOXOXXXXXXX,
XXOXXXXOXXXOXOXXXXXXXXXO,
XXOXXXXOXXXOXOXXXXXXXXXX,
XXOXXXXXOOOXOOXXXXXO,
XXOXXXXXOXOXOOOOOOOXX,
XXOXXXXXOXOXOOOOOOXX,
XXOXXXXXOXOXOOOOOXXX,
XXOXXXXXOXOXOXOOOOOOXX,
XXOXXXXXOXOXOXOOOOXX,
XXOXXXXXOXOXOXXXXXX,
XXOXXXXXOXOXOXXXXXXO,
XXOXXXXXOXOXOXXXXXXX,
XXOXXXXXOXOXOXXXXXXXXXO,
XXOXXXXXOXOXOXXXXXXXXXX,
XXXOXOXOXOOOXOOXXXXXO,
XXXOXOXOXOXOXOOOOOOOXX,
XXXOXOXOXOXOXOOOOOOXX,
XXXOXOXOXOXOXOOOOOXXX,
XXXOXOXOXOXOXOXOOOOOOXX,
XXXOXOXOXOXOXOXOOOOXX,
XXXOXOXOXOXOXOXXXXXX,
XXXOXOXOXOXOXOXXXXXXO, XXXOXOXOXOXOXOXXXXXX,
XXXXOXOXOXOXOXOXXXXXXXXXO,
XXXXOXOXOXOXOXXXXXXXXXXX,
XXXXOXOXOOOXOOXXXXXO,
XXXXOXOXOXOXOOOOOOOXX,
XXXXOXOXOXOXOOOOOOXX,
XXXXOXOXOXOXOOOOOXXX,
XXXXOXOXOXOXOXOOOOOOXX,
XXXXOXOXOXOXOXOOOOXX,
XXXXOXOXOXOXOXXXXXX,
XXXXOXOXOXOXOXXXXXXO,
XXXXOXOXOXOXOXXXXXXX,
XXXXOXOXOXOXOXXXXXXXXXO,
XXXXOXOXOXOXOXXXXXXXXXX,
XXXXOXOXOXXOOOOOOOOXX,
XXXXOXOXOXXOOOOOOXX,
XXXXOXOXOXXOOOOOXXX,
XXXXOXOXOXXOXOOOOOOXX,
XXXXOXOXOXXOXOOOOXX,
XXXXOXOXOXXOXXXXXX,
XXXXOXOXOXXOXXXXXXO,
XXXXOXOXOXXOXXXXXXX,
XXXXOXOXOXXOXXXXXXXXXO,
XXXXOXOXOXXOXXXXXXXXXX,
XXXXOXOXXOOXOOXXXXXO,
XXXXOXOXXOOXOOXXXXXO,
XXXXOXOXXOXOOOOOOOXX,
XXXXOXOXXOXOOOOOOXX,
XXXXOXOXXOXOOOOOXXX,
XXXXOXOXXOXOXOOOOOOXX,
XXXXOXOXXOXOXOOOOXX,
XXXXOXOXXOXOXXXXXX,
XXXXOXOXXOXOXXXXXXO,
XXXXOXOXXOXOXXXXXXX,
XXXXOXOXXOXOXXXXXXXXXO,
XXXX modification described herein; and in some embodiments, the present disclosure pertains to multimers of any such oligonucleotides.

In some embodiments, a chirally controlled oligonucleotide comprises one or more modified internucleotide phosphorus linkages. In some embodiments, a chirally controlled oligonucleotide comprises, e.g., a phosphorothioate or a phosphorothioate triester linkage.

In some embodiments, a chirally controlled oligonucleotide comprises a phosphorothioate triester linkage. In some embodiments, a chirally controlled oligonucleotide comprises at least two phosphorothioate triester linkages. In some embodiments, a chirally controlled oligonucleotide comprises at least three phosphorothioate triester linkages. In some embodiments, a chirally controlled oligonucleotide comprises at least four phosphorothioate triester linkages. In some embodiments, a chirally controlled oligonucleotide comprises at least five phosphorothioate triester linkages. Example modified internucleotidic phosphorus linkages are described further herein. In some embodiments, a chirally controlled oligonucleotide comprises different internucleotidic phosphorus linkages. In some embodiments, a chirally controlled oligonucleotide comprises at least one phosphate diester internucleotidic linkage and at least one modified internucleotidic linkage. In some embodiments, a chirally controlled oligonucleotide comprises at least one phosphate diester internucleotidic linkage and at least one phosphorothioate triester linkage. In some embodiments, a chirally controlled oligonucleotide comprises at least one phosphate diester internucleotidic linkage and at least two phosphorothioate triester linkages. In some embodiments, a chirally controlled oligonucleotide comprises at least one phosphate diester internucleotidic linkage and at least three phosphorothioate triester linkages. In some embodiments, a chirally controlled oligonucleotide comprises at least one phosphate diester internucleotidic linkage and at least four phosphorothioate triester linkages.

In some embodiments, the present disclosure provides oligonucleotides comprising one or more modified internucleotidic linkages independently having the structure of Formula I:

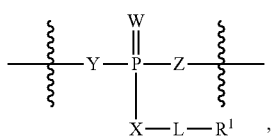

Formula I

W is O, S or Se;
each of X, Y and Z is independently O, S, N(L), or L;
L is a covalent bond or an optionally substituted, linear or branched $C_1$-$C_{10}$ aliphatic, wherein one or more methylene units of L are optionally and independently replaced by an optionally substituted group selected from $C_1$-$C_6$ aliphatic moiety, $C_1$-$C_6$ alkenylene, —C≡C—, a $C_1$-$C_6$ heteroaliphatic moiety, —C(R')$_2$—, -Cy-, —B(R')—, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R)S(O)$_2$— —SC(O)—, —C(O)S—, —OC(O)—, and —C(O)O—;
$R^1$ is halogen, R, or an optionally substituted $C_1$-$C_{80}$ aliphatic wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N (R')—, —N(R')C(O)—, —N(R')C(O)O—, —OC(O)N (R')—, —S(O)—, —S(O)$_2$—, —S(O)$_2$N(R')—, —N(R')S (O)$_2$— —SC(O)—, —C(O)S—, —OC(O)—, and —C(O)O— each R' is independently —R, —C(O)R, —CO$_2$R, or —SO$_2$R, or:
two or more R' are taken together with their intervening atoms to form an optionally substituted $C_3$-$C_{14}$ group selected from aryl, carbocyclyl, heterocyclyl, and heteroaryl;
-Cy- is an optionally substituted bivalent ring selected from phenylene, $C_3$-$C_{14}$ carbocyclylene, $C_{10}$-$C_{14}$ arylene, $C_5$-$C_{14}$ heteroarylene, and $C_3$-$C_{14}$ heterocyclylene; and
each R is independently hydrogen, or an optionally substituted group selected from $C_1$-$C_{20}$ aliphatic, $C_3$-$C_{20}$ carbocyclyl, $C_6$-$C_{20}$ aryl, $C_5$-$C_{20}$ heteroaryl, and $C_3$-$C_{20}$ heterocyclyl.

In some embodiments of Formula I, P in $T^{LD}$ is P*. In some embodiments, P* is an asymmetric phosphorus atom and is either Rp or Sp. In some embodiments, P* is Rp. In other embodiments, P* is Sp. In some embodiments, an oligonucleotide comprises one or more internucleotidic linkages of Formula I wherein each P* is independently Rp or Sp. In some embodiments, an oligonucleotide comprises one or more internucleotidic linkages of Formula I wherein each P* is Rp. In some embodiments, an oligonucleotide comprises one or more internucleotidic linkages of Formula I wherein each P* is Sp. In some embodiments, an oligonucleotide comprises at least one internucleotidic linkage of Formula I wherein P* is Rp. In some embodiments, an oligonucleotide comprises at least one internucleotidic linkage of Formula I wherein P* is Sp. In some embodiments, an oligonucleotide comprises at least one internucleotidic linkage of Formula I wherein P* is Rp, and at least one internucleotidic linkage of Formula I wherein P* is Sp.

In some embodiments of Formula I, W is O, S, or Se. In some embodiments, W is O. In some embodiments, W is S. In some embodiments, W is Se. In some embodiments, an oligonucleotide comprises at least one internucleotidic linkage of Formula I wherein W is O. In some embodiments, an oligonucleotide comprises at least one internucleotidic linkage of Formula I wherein W is S. In some embodiments, an oligonucleotide comprises at least one internucleotidic linkage of Formula I wherein W is Se.

In some embodiments of Formula I, an oligonucleotide comprises at least one internucleotidic linkage of Formula I wherein W is O. In some embodiments, an oligonucleotide comprises at least one internucleotidic linkage of Formula I wherein W is S.

In some embodiments, each R is independently hydrogen, or an optionally substituted group selected from $C_1$-$C_6$ aliphatic, phenyl, carbocyclyl, aryl, heteroaryl, and heterocyclyl.

In some embodiments, R is hydrogen. In some embodiments, R is an optionally substituted group selected from $C_1$-$C_6$ aliphatic, phenyl, carbocyclyl, aryl, heteroaryl, and heterocyclyl.

In some embodiments, R is an optionally substituted $C_1$-$C_6$ aliphatic. In some embodiments, R is an optionally substituted $C_1$-$C_6$ alkyl. In some embodiments, R is optionally substituted, linear or branched hexyl. In some embodiments, R is optionally substituted, linear or branched pentyl. In some embodiments, R is optionally substituted, linear or branched butyl. In some embodiments, R is optionally substituted, linear or branched propyl. In some embodiments, R is optionally substituted ethyl. In some embodiments, R is optionally substituted methyl.

In some embodiments, R is optionally substituted phenyl. In some embodiments, R is substituted phenyl. In some embodiments, R is phenyl.

In some embodiments, R is optionally substituted carbocyclyl. In some embodiments, R is optionally substituted $C_3$-$C_{10}$ carbocyclyl. In some embodiments, R is optionally substituted monocyclic carbocyclyl. In some embodiments, R is optionally substituted cycloheptyl. In some embodiments, R is optionally substituted cyclohexyl. In some embodiments, R is optionally substituted cyclopentyl. In some embodiments, R is optionally substituted cyclobutyl. In some embodiments, R is an optionally substituted cyclopropyl. In some embodiments, R is optionally substituted bicyclic carbocyclyl.

In some embodiments, R is an optionally substituted aryl. In some embodiments, R is an optionally substituted bicyclic aryl ring.

In some embodiments, R is an optionally substituted heteroaryl. In some embodiments, R is an optionally substituted 5-6 membered monocyclic heteroaryl ring having 1-3 heteroatoms independently selected from nitrogen, sulfur, and oxygen. In some embodiments, R is a substituted 5-6 membered monocyclic heteroaryl ring having 1-3 heteroatoms independently selected from nitrogen, oxygen, and sulfur. In some embodiments, R is an unsubstituted 5-6 membered monocyclic heteroaryl ring having 1-3 heteroatoms independently selected from nitrogen, sulfur, and oxygen.

In some embodiments, R is an optionally substituted 5-membered monocyclic heteroaryl ring having 1-3 heteroatoms independently selected from nitrogen, sulfur, and oxygen. In some embodiments, R is an optionally substituted 6 membered monocyclic heteroaryl ring having 1-3 heteroatoms independently selected from nitrogen, oxygen, and sulfur.

In some embodiments, R is an optionally substituted 5-membered monocyclic heteroaryl ring having 1 heteroatom selected from nitrogen, oxygen, and sulfur. In some embodiments, R is selected from pyrrolyl, furanyl, and thienyl.

In some embodiments, R is an optionally substituted 5-membered heteroaryl ring having 2 heteroatoms independently selected from nitrogen, oxygen, and sulfur. In certain embodiments, R is an optionally substituted 5-membered heteroaryl ring having 1 nitrogen atom, and an additional heteroatom selected from sulfur and oxygen. Example R groups include optionally substituted pyrazolyl, imidazolyl, thiazolyl, isothiazolyl, oxazolyl or isoxazolyl.

In some embodiments, R is a 6-membered heteroaryl ring having 1-3 nitrogen atoms. In other embodiments, R is an optionally substituted 6-membered heteroaryl ring having 1-2 nitrogen atoms. In some embodiments, R is an optionally substituted 6-membered heteroaryl ring having 2 nitrogen atoms. In certain embodiments, R is an optionally substituted 6-membered heteroaryl ring having 1 nitrogen. Example R groups include optionally substituted pyridinyl, pyrimidinyl, pyrazinyl, pyridazinyl, triazinyl, or tetrazinyl.

In certain embodiments, R is an optionally substituted 8-10 membered bicyclic heteroaryl ring having 1-4 heteroatoms independently selected from nitrogen, oxygen, and sulfur. In some embodiments, R is an optionally substituted 5,6-fused heteroaryl ring having 1-4 heteroatoms independently selected from nitrogen, oxygen, and sulfur. In other embodiments, R is an optionally substituted 5,6-fused heteroaryl ring having 1-2 heteroatoms independently selected from nitrogen, oxygen, and sulfur. In certain embodiments, R is an optionally substituted 5,6-fused heteroaryl ring having 1 heteroatom independently selected from nitrogen, oxygen, and sulfur. In some embodiments, R is an optionally substituted indolyl. In some embodiments, R is an optionally substituted azabicyclo[3.2.1]octanyl. In certain embodiments, R is an optionally substituted 5,6-fused heteroaryl ring having 2 heteroatoms independently selected from nitrogen, oxygen, and sulfur. In some embodiments, R is an optionally substituted azaindolyl. In some embodiments, R is an optionally substituted benzimidazolyl. In some embodiments, R is an optionally substituted benzothiazolyl. In some embodiments, R is an optionally substituted benzoxazolyl. In some embodiments, R is an optionally substituted indazolyl. In certain embodiments, R is an optionally substituted 5,6-fused heteroaryl ring having 3 heteroatoms independently selected from nitrogen, oxygen, and sulfur.

In certain embodiments, R is an optionally substituted 6,6-fused heteroaryl ring having 1-4 heteroatoms independently selected from nitrogen, oxygen, and sulfur. In some embodiments, R is an optionally substituted 6,6-fused heteroaryl ring having 1-2 heteroatoms independently selected from nitrogen, oxygen, and sulfur. In other embodiments, R is an optionally substituted 6,6-fused heteroaryl ring having 1 heteroatom independently selected from nitrogen, oxygen, and sulfur. In some embodiments, R is an optionally substituted quinolinyl. In some embodiments, R is an optionally substituted isoquinolinyl. According to one aspect, R is an optionally substituted 6,6-fused heteroaryl ring having 2 heteroatoms independently selected from nitrogen, oxygen, and sulfur. In some embodiments, R is a quinazoline or a quinoxaline.

In some embodiments, R is an optionally substituted heterocyclyl. In some embodiments, R is an optionally substituted 3-7 membered saturated or partially unsaturated heterocyclic ring having 1-2 heteroatoms independently selected from nitrogen, oxygen, and sulfur. In some embodiments, R is a substituted 3-7 membered saturated or partially unsaturated heterocyclic ring having 1-2 heteroatoms independently selected from nitrogen, oxygen, and sulfur. In some embodiments, R is an unsubstituted 3-7 membered saturated or partially unsaturated heterocyclic ring having 1-2 heteroatoms independently selected from nitrogen, oxygen, and sulfur.

In some embodiments, R is an optionally substituted heterocyclyl. In some embodiments, R is an optionally substituted 6 membered saturated or partially unsaturated heterocyclic ring having 1-2 heteroatoms independently selected from nitrogen, oxygen, and sulfur. In some embodiments, R is an optionally substituted 6 membered partially unsaturated heterocyclic ring having 2 heteroatoms independently selected from nitrogen, oxygen, and sulfur. In some embodiments, R is an optionally substituted 6 membered partially unsaturated heterocyclic ring having 2 oxygen atom.

In certain embodiments, R is a 3-7 membered saturated or partially unsaturated heterocyclic ring having 1-2 heteroatoms independently selected from nitrogen, oxygen, and sulfur. In certain embodiments, R is oxiranyl, oxetanyl, tetrahydrofuranyl, tetrahydropyranyl, oxepaneyl, aziridineyl, azetidineyl, pyrrolidinyl, piperidinyl, azepanyl, thiiranyl, thietanyl, tetrahydrothiophenyl, tetrahydrothiopyranyl, thiepanyl, dioxolanyl, oxathiolanyl, oxazolidinyl, imidazolidinyl, thiazolidinyl, dithiolanyl, dioxanyl, morpholinyl, oxathianyl, piperazinyl, thiomorpholinyl, dithianyl, dioxepanyl, oxazepanyl, oxathiepanyl, dithiepanyl, diazepanyl, dihydrofuranonyl, tetrahydropyranonyl, oxepanonyl, pyrolidinonyl, piperidinonyl, azepanonyl, dihydrothiophenonyl, tetrahydrothiopyranonyl, thiepanonyl, oxazolidinonyl, oxazinanonyl, oxazepanonyl, dioxolanonyl, dioxanonyl, dioxepanonyl, oxathiolinonyl, oxathianonyl, oxathiepanonyl, thiazolidinonyl, thiazinanonyl, thiazepanonyl, imidazolidinonyl, tetrahydropyrimidinonyl, di azepanonyl, imidazolidinedionyl, oxazolidinedionyl, thiazolidinedionyl, dioxolanedionyl, oxathiolanedionyl, piperazinedionyl, morpholinedionyl, thiomorpholinedionyl, tetrahydropyranyl, tetrahydrofuranyl, morpholinyl, thiomorpholinyl, piperidinyl, piperazinyl, pyrrolidinyl, tetrahydrothiophenyl, or tetrahydrothiopyranyl. In some embodiments, R is an optionally substituted 5-membered saturated or partially unsaturated heterocyclic ring having 1-2 heteroatoms independently selected from nitrogen, oxygen, and sulfur.

In certain embodiments, R is an optionally substituted 5-6 membered partially unsaturated monocyclic ring having 1-2 heteroatoms independently selected from nitrogen, oxygen, and sulfur. In certain embodiments, R is an optionally substituted tetrahydropyridinyl, dihydrothiazolyl, dihydrooxazolyl, or oxazolinyl group.

In some embodiments, R is an optionally substituted 8-10 membered bicyclic saturated or partially unsaturated heterocyclic ring having 1-4 heteroatoms independently selected from nitrogen, oxygen, and sulfur. In some embodiments, R is an optionally substituted indolinyl. In some embodiments, R is an optionally substituted isoindolinyl. In some embodiments, R is an optionally substituted 1, 2, 3, 4-tetrahydroquinoline. In some embodiments, R is an optionally substituted 1, 2, 3, 4-tetrahydroisoquinoline.

In some embodiments, each R' is independently —R, —C(O)R, —CO$_2$R, or —SO$_2$R, or:

two R' on the same nitrogen are taken together with their intervening atoms to form an optionally substituted heterocyclic or heteroaryl ring, or two R' on the same carbon are taken together with their intervening atoms to form an optionally substituted aryl, carbocyclic, heterocyclic, or heteroaryl ring.

In some embodiments, R' is —R, —C(O)R, —CO$_2$R, or —SO$_2$R, wherein R is as defined above and described herein.

In some embodiments, R' is —R, wherein R is as defined and described above and herein. In some embodiments, R' is hydrogen.

In some embodiments, R' is —C(O)R, wherein R is as defined above and described herein. In some embodiments, R' is —CO$_2$R, wherein R is as defined above and described herein. In some embodiments, R' is —SO$_2$R, wherein R is as defined above and described herein.

In some embodiments, two R' on the same nitrogen are taken together with their intervening atoms to form an optionally substituted heterocyclic or heteroaryl ring. In some embodiments, two R' on the same carbon are taken together with their intervening atoms to form an optionally substituted aryl, carbocyclic, heterocyclic, or heteroaryl ring.

In some embodiments, -Cy- is an optionally substituted bivalent ring selected from phenylene, carbocyclylene, arylene, heteroarylene, and heterocyclylene.

In some embodiments, -Cy- is optionally substituted phenylene. In some embodiments, -Cy- is optionally substituted carbocyclylene. In some embodiments, -Cy- is optionally substituted arylene. In some embodiments, -Cy- is optionally substituted heteroarylene. In some embodiments, -Cy- is optionally substituted heterocyclylene.

In some embodiments, each of X, Y and Z is independently O, S, N(L R$^1$)—, or L, wherein each of L and R$^1$ is independently as defined above and described below.

In some embodiments, X is —O—. In some embodiments, X is —S—. In some embodiments, X is —O— or —S—. In some embodiments, an oligonucleotide comprises at least one internucleotidic linkage of Formula I wherein X is —O—. In some embodiments, an oligonucleotide comprises at least one internucleotidic linkage of Formula I wherein X is —S—. In some embodiments, an oligonucleotide comprises at least one internucleotidic linkage of Formula I wherein X is —O—, and at least one internucleotidic linkage of Formula I wherein X is —S—. In some embodiments, an oligonucleotide comprises at least one internucleotidic linkage of Formula I wherein X is —O—, and at least one internucleotidic linkage of Formula I wherein X is —S—, and at least one internucleotidic linkage of Formula I wherein L is an optionally substituted, linear or branched C$_1$-C$_{10}$ alkylene, wherein one or more methylene units of L are optionally and independently replaced by an optionally substituted C$_1$-C$_6$ alkylene, C$_1$-C$_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—.

In some embodiments, X is —N(-L-R$^1$)—. In some embodiments, X is —N(R')—. In some embodiments, X is —N(R')—. In some embodiments, X is —N(R)—. In some embodiments, X is —NH—.

In some embodiments, X is L. In some embodiments, X is a covalent bond. In some embodiments, X is or an optionally substituted, linear or branched C$_1$-C$_{10}$ alkylene, wherein one or more methylene units of L are optionally and independently replaced by an optionally substituted C$_1$-C$_6$ alkylene, C$_1$-C$_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—. In some embodiments, X is an optionally substituted C$_1$-C$_{10}$ alkylene or C$_1$-C$_{10}$ alkenylene. In some embodiments, X is methylene.

In some embodiments, Y is —O—. In some embodiments, Y is —S—.

In some embodiments, Y is —N(-L-R$^1$)—. In some embodiments, Y is —N(R')—. In some embodiments, Y is —N(R')—. In some embodiments, Y is —N(R)—. In some embodiments, Y is —NH—.

In some embodiments, Y is L. In some embodiments, Y is a covalent bond. In some embodiments, Y is or an optionally substituted, linear or branched C$_1$-C$_{10}$ alkylene, wherein one or more methylene units of L are optionally and independently replaced by an optionally substituted C$_1$-C$_6$ alkylene, C$_1$-C$_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—. In some embodiments, Y is an optionally substituted C$_1$-C$_{10}$ alkylene or C$_1$-C$_{10}$ alkenylene. In some embodiments, Y is methylene. In some embodiments, Y is L, wherein at least one methylene units of L is optionally substituted replaced with —O—, —S—, or —N(R')—, wherein Y is connected to $P^L$ through —O—, —S—, or —N(R')—. In some embodiments, Y is L, wherein L is -$L^3$-G-. In some embodiments, G is bonded to $P^L$. In some embodiments, G is —O—. In some embodiments, G is —S—. In some embodiments, G is —N(R')—.

In some embodiments, Z is —O—. In some embodiments, Z is —S—.

In some embodiments, Z is —N(-L-$R^1$)—. In some embodiments, Z is —N(R')—. In some embodiments, Z is —N(R')—. In some embodiments, Z is —N(R)—. In some embodiments, Z is —NH—.

In some embodiments, Z is L. In some embodiments, Z is a covalent bond. In some embodiments, Z is or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—. In some embodiments, Z is an optionally substituted $C_1$-$C_{10}$ alkylene or $C_1$-$C_{10}$ alkenylene. In some embodiments, Z is methylene. In some embodiments, Z is L, wherein at least one methylene units of L is optionally substituted replaced with —O—, —S—, or —N(R')—, wherein Z is connected to $P^L$ through —O—, —S—, or —N(R')—. In some embodiments, Z is L, wherein L is -$L^3$-G-. In some embodiments, G is bonded to $P^L$. In some embodiments, G is —O—. In some embodiments, G is —S—. In some embodiments, G is —N(R')—.

In some embodiments, L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—.

In some embodiments, L is a covalent bond. In some embodiments, L is an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—.

In some embodiments, L has the structure of wherein: $L^1$ is an optionally substituted group selected from

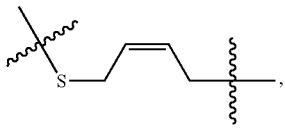

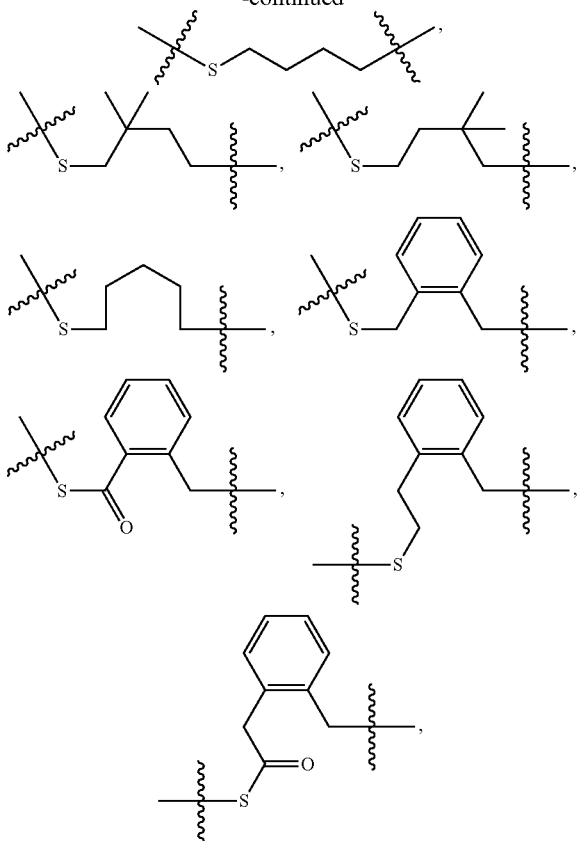

$C_1$-$C_6$ alkylene, $C_1$-$C_6$ alkenylene, carbocyclylene, arylene, $C_1$-$C_6$ heteroalkylene, heterocyclylene, and heteroarylene; V is selected from —O—, —S—, —NR'—, C(R')$_2$, —S—S—, —B—S—S—C—,

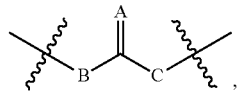

and an optionally substituted group selected from $C_1$-$C_6$ alkylene, arylene, $C_1$-$C_6$ heteroalkylene, heterocyclylene, and heteroarylene;

A is =O, =S, =NR', or =C(R')$_2$; each of B and C is independently —O—, —S—, —NR'—, —C(R')$_2$—, or an optionally substituted group selected from $C_1$-$C_6$ alkylene, carbocyclylene, arylene, heterocyclylene, and heteroarylene; and each R' is independently as defined above and described herein.

In some embodiments, $L^1$ is

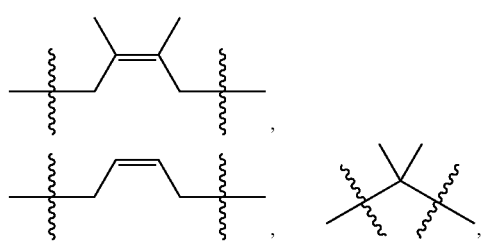

-continued

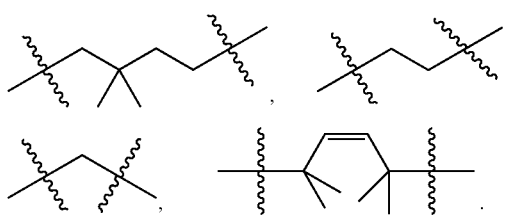

In some embodiments, L¹ is

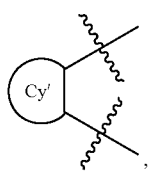

wherein Ring Cy' is an optionally substituted arylene, carbocyclylene, heteroarylene, or heterocyclylene. In some embodiments, L¹ is optionally substituted

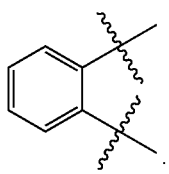 [SMILES: *c1ccccc1*]

In some embodiments, L¹ is

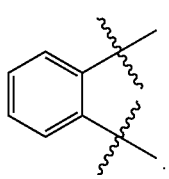 [SMILES: *c1ccccc1*]

In some embodiments, L¹ is connected to X. In some embodiments, L¹ is an optionally substituted group selected from

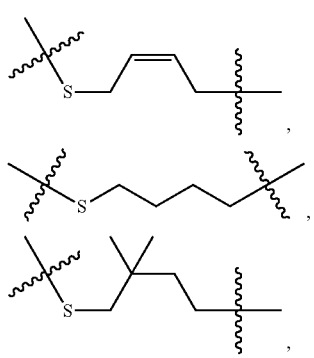

-continued

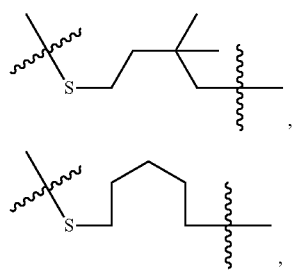

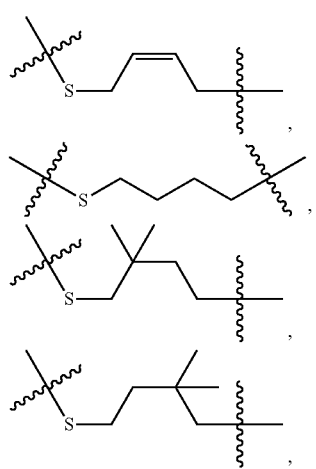

and the sulfur atom being connected to V. In some embodiments, L¹ is an optionally substituted group selected from -continued

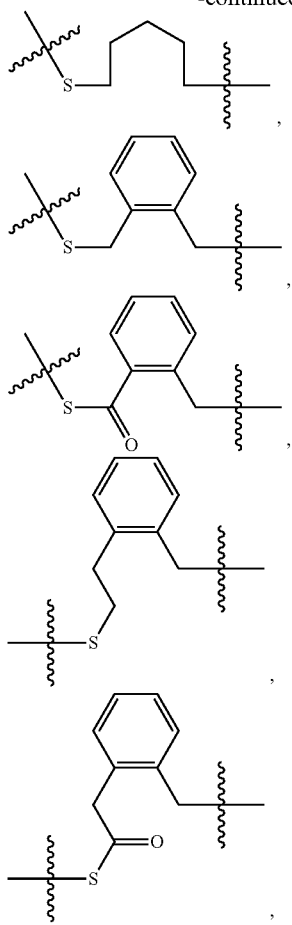

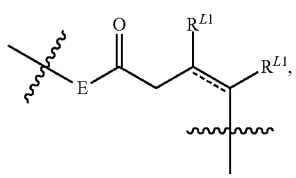

, and

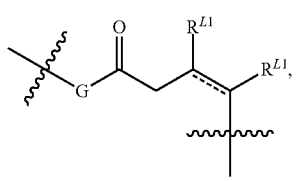

and the carbon atom being connected to X.

In some embodiments, L has the structure of:

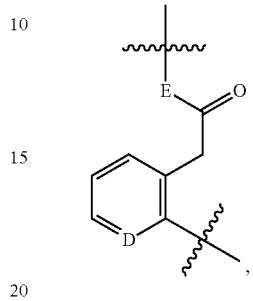

wherein:
E is —O—, —S—, —NR'— or —C(R')$_2$—;
= is a single or double bond;
the two R$^{L1}$ are taken together with the two carbon atoms to which they are bound to form an optionally substituted aryl, carbocyclic, heteroaryl or heterocyclic ring; and each R' is independently as defined above and described herein.

In some embodiments, L has the structure of:

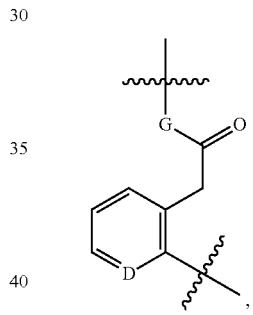

wherein:
G is —O—, —S—, or —NR';
= is a single or double bond; and
the two R$^{L1}$ are taken together with the two carbon atoms to which they are bound to form an optionally substituted aryl, C$_3$-C$_{10}$ carbocyclic, heteroaryl or heterocyclic ring.

In some embodiments, L has the structure of:

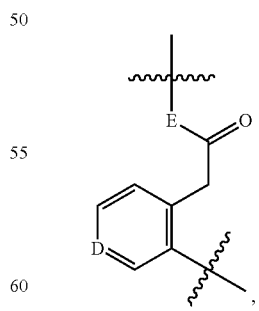

wherein:
E is —O—, —S—, —NR' or C(R')$_2$—;
D is =N—, =C(F)—, =C(Cl)—, =C(Br)—, =C(I)—, =C(CN)—, =C(NO$_2$)—, =C(CO$_2$—(C$_1$-C$_6$ aliphatic))—, or =C(CF$_3$)—; and
each R' is independently as defined above and described herein.

In some embodiments, L has the structure of:

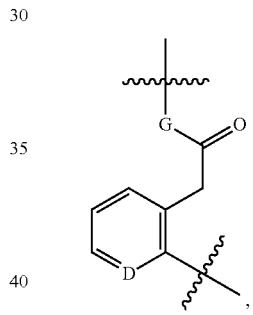

wherein:
G is —O—, —S—, or —NR';
D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—.

In some embodiments, L has the structure of:

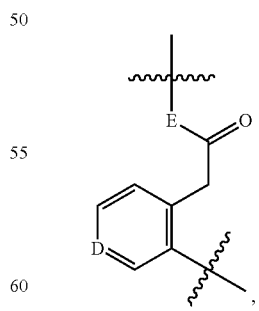

wherein:
E is —O—, —S—, —NR' or —C(R')$_2$—;
D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and each R' is independently as defined above and described herein.

In some embodiments, L has the structure of:

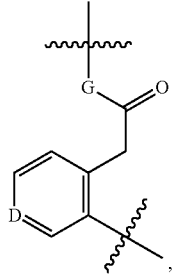

wherein:

G is —O—, —S—, or —NR';

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—.

In some embodiments, L has the structure of:

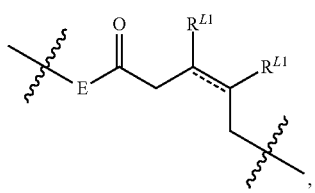

wherein:

E is —O—, —S—, —NR' or C(R')$_2$—;

= is a single or double bond;

the two R$^{L1}$ are taken together with the two carbon atoms to which they are bound to form an optionally substituted aryl, C$_3$-C$_{10}$ carbocyclic, heteroaryl or heterocyclic ring;

and each R' is independently as defined above and described herein.

In some embodiments, L has the structure of:

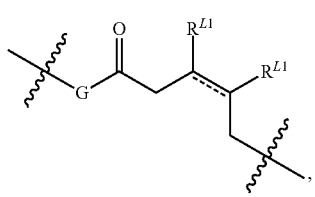

wherein:

G is —O—, —S—, or —NR';

= is a single or double bond;

the two R$^{L1}$ are taken together with the two carbon atoms to which they are bound to form an optionally substituted aryl, C$_3$-C$_{10}$ carbocyclic, heteroaryl or heterocyclic ring;

and each R' is independently as defined above and described herein.

In some embodiments, L has the structure of:

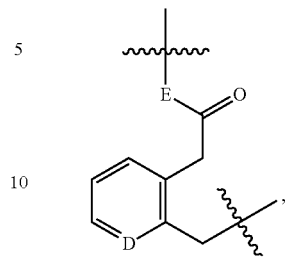

wherein:

E is —O—, —S—, —NR' or C(R')$_2$—;

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and each R' is independently as defined above and described herein.

In some embodiments, L has the structure of:

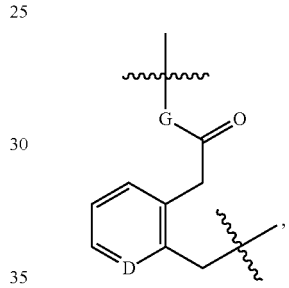

wherein:

G is —O—, —S—, or —NR';

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and each R' is independently as defined above and described herein.

In some embodiments, L has the structure of:

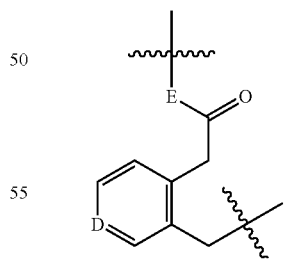

wherein:

E is —O—, —S—, —NR' or C(R')$_2$—;

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and each R' is independently as defined above and described herein.

In some embodiments, L has the structure of:

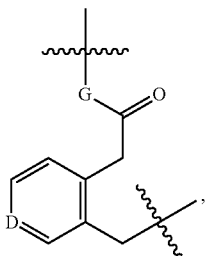

wherein:

G is —O—, —S—, or —NR';

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and each R' is independently as defined above and described herein.

In some embodiments, L has the structure of:

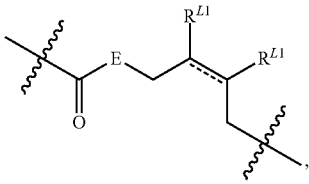

wherein:

E is —O—, —S—, —NR' or C(R')$_2$—;

= is a single or double bond;

the two R$^{L1}$ are taken together with the two carbon atoms to which they are bound to form an optionally substituted aryl, C$_3$-C$_{10}$ carbocyclic, heteroaryl or heterocyclic ring; and each R' is independently as defined above and described herein.

In some embodiments, L has the structure of:

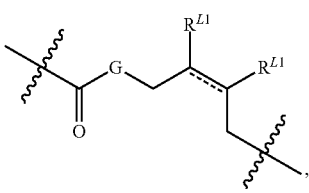

wherein:

G is —O—, —S—, or —NR';

= is a single or double bond;

the two R$^{L1}$ are taken together with the two carbon atoms to which they are bound to form an optionally substituted aryl, C$_3$-C$_{10}$ carbocyclic, heteroaryl or heterocyclic ring; and each R' is independently as defined above and described herein.

In some embodiments, L has the structure of:

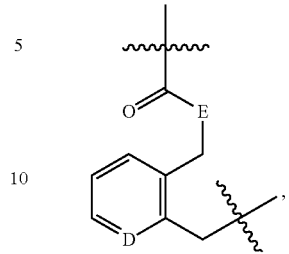

wherein:

E is —O—, —S—, —NR' or C(R')$_2$—;

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and each R' is independently as defined above and described herein.

In some embodiments, L has the structure of:

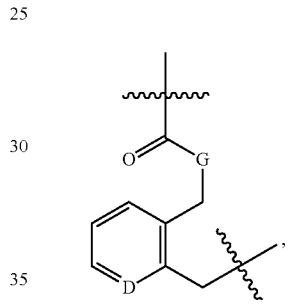

wherein:

G is —O—, —S—, or —NR';

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and R' is as defined above and described herein.

In some embodiments, L has the structure of:

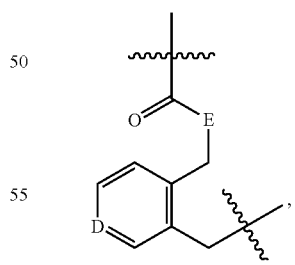

wherein:

E is —O—, —S—, —NR' or C(R')$_2$—;

D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and each R' is independently as defined above and described herein.

In some embodiments, L has the structure of:

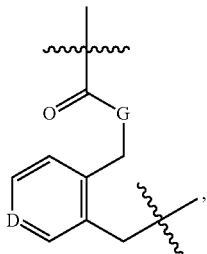

wherein:
G is —O—, —S—, or —NR';
D is =N—, =C(F)—, =C(Cl)—, =C(Br)—, =C(I)—, =C(CN)—, =C(NO$_2$)—, =C(CO$_2$—(C$_1$-C$_6$ aliphatic))-, or =C(CF$_3$)—; and
R' is as defined above and described herein.

In some embodiments, L has the structure of:

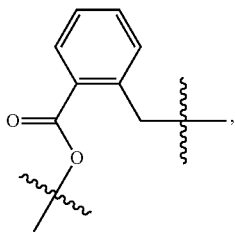 [SMILES: *Cc1ccccc1C(=O)O*]

wherein the phenyl ring is optionally substituted. In some embodiments, the phenyl ring is not substituted. In some embodiments, the phenyl ring is substituted.

In some embodiments, L has the structure of:

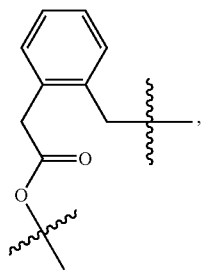 [SMILES: *Cc1ccccc1CC(=O)O*]

wherein the phenyl ring is optionally substituted. In some embodiments, the phenyl ring is not substituted. In some embodiments, the phenyl ring is substituted.

In some embodiments, L has the structure of:

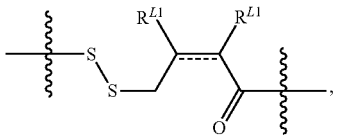

wherein:
= is a single or double bond; and
the two R$^{L1}$ are taken together with the two carbon atoms to which they are bound to form an optionally substituted aryl, C$_3$-C$_{10}$ carbocyclic, heteroaryl or heterocyclic ring.

In some embodiments, L has the structure of:

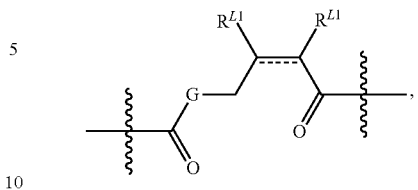

wherein:
G is —O—, —S—, or —NR';
= is a single or double bond; and the two R$^{L1}$ are taken together with the two carbon atoms to which they are bound to form an optionally substituted aryl, C$_3$-C$_{10}$ carbocyclic, heteroaryl or heterocyclic ring.

In some embodiments, E is —O—, —S—, —NR'— or —C(R')$_2$—, wherein each R' independently as defined above and described herein. In some embodiments, E is —O—, —S—, or —NR'—. In some embodiments, E is —O—, —S—, or —NH—. In some embodiments, E is —O—. In some embodiments, E is —S—. In some embodiments, E is —NH—.

In some embodiments, G is —O—, —S—, or —NR'—, wherein each R' independently as defined above and described herein. In some embodiments, G is —O—, —S—, or —NH—. In some embodiments, G is —O—. In some embodiments, G is —S—. In some embodiments, G is —NH—.

In some embodiments, L is -L$^3$-G-, wherein:
L$^3$ is an optionally substituted C$_1$-C$_5$ alkylene or alkenylene, wherein one or more methylene units are optionally and independently replaced by —O—, —S—, —N(R')—, —C(O)—, —C(S)—, —C(NR')—, —S(O)—, —S(O)$_2$—, or

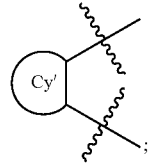

and wherein each of G, R' and Ring Cy' is independently as defined above and described herein.

In some embodiments, L is -L$^3$-S—, wherein L$^3$ is as defined above and described herein. In some embodiments, L is -L$^3$-O—, wherein L$^3$ is as defined above and described herein. In some embodiments, L is -L$^3$-N(R')—, wherein each of L$^3$ and R' is independently as defined above and described herein. In some embodiments, L is -L$^3$-NH—, wherein each of L$^3$ and R' is independently as defined above and described herein.

In some embodiments, L$^3$ is an optionally substituted C$_5$ alkylene or alkenylene, wherein one or more methylene units are optionally and independently replaced by —O—, —S—, —N(R')—, —C(O)—, —C(S)—, —C(NR')—, —S(O)—, —S(O)$_2$—, or

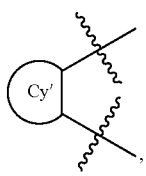 [SMILES: *CC*]

and each of R' and Ring Cy' is independently as defined above and described herein. In some embodiments, $L^3$ is an optionally substituted $C_5$ alkylene. In some embodiments, -$L^3$-G- is

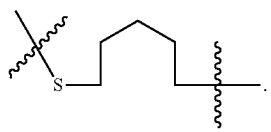 [SMILES: *CCCCCS*]

In some embodiments, $L^3$ is an optionally substituted $C_4$ alkylene or alkenylene, wherein one or more methylene units are optionally and independently replaced by —O—, —S—, —N(R')—, —C(O)—, —C(S)—, —C(NR')—, —S(O)—, —S(O)$_2$—, or

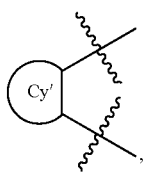 [SMILES: *CC*]

and each of R' and Cy' is independently as defined above and described herein.

In some embodiments, -$L^3$-G- is

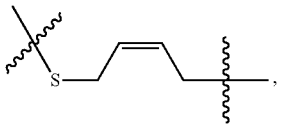

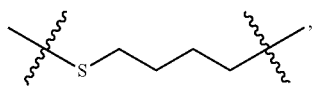

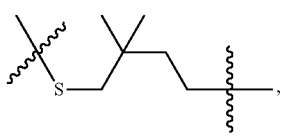

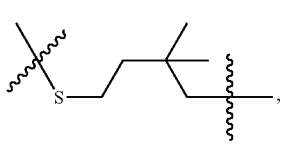

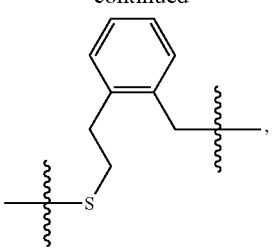,

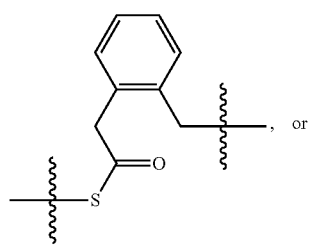, or

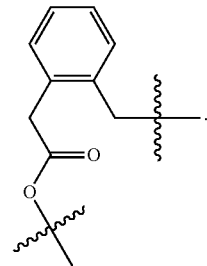.

In some embodiments, $L^3$ is an optionally substituted $C_3$ alkylene or alkenylene, wherein one or more methylene units are optionally and independently replaced by —O—, —S—, —N(R')—, —C(O)—, —C(S)—, —C(NR')—, —S(O)—, —S(O)$_2$—, or

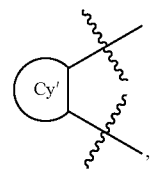 [SMILES: *CC*]

and each of R' and Cy' is independently as defined above and described herein.

In some embodiments, -$L^3$-G- is

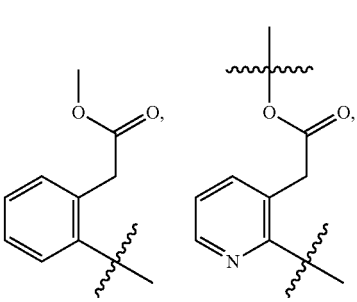

-continued

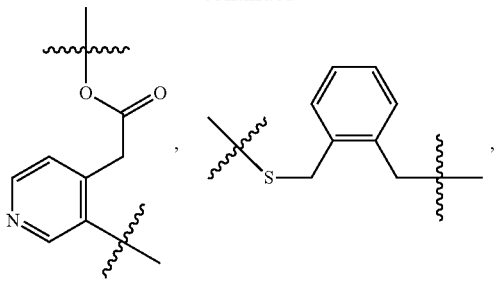

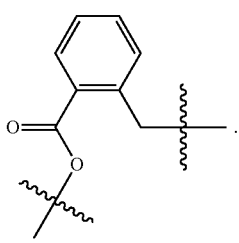

In some embodiments, L is

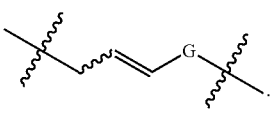

In some embodiments, L is

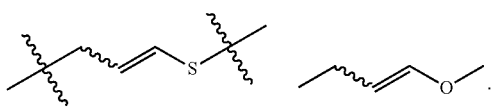

In some embodiments, L is

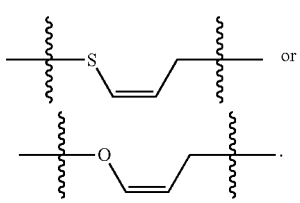

In some embodiments, $L^3$ is an optionally substituted $C_2$ alkylene or alkenylene, wherein one or more methylene units are optionally and independently replaced by —O—, —S—, —N(R')—, —C(O)—, —C(S)—, —C(NR')—, —S(O)—, —S(O)$_2$—, or

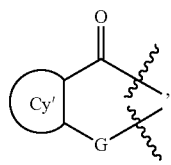

and each of R' and Cy' is independently as defined above and described herein.

In some embodiments, -$L^3$-G- is

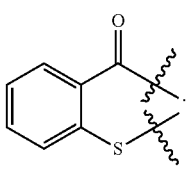 [SMILES: *Sc1ccccc1C(*)=O]

wherein each of G and Cy' is independently as defined above and described herein. In some embodiments, L is

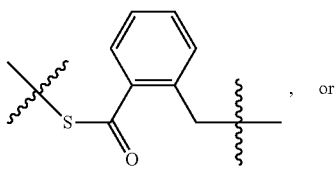

In some embodiments, L is -$L^4$-G-, wherein $L^4$ is an optionally substituted $C_1$-$C_2$ alkylene; and G is as defined above and described herein. In some embodiments, L is -$L^4$-G-, wherein $L^4$ is an optionally substituted $C_1$-$C_2$ alkylene; G is as defined above and described herein; and G is connected to $R^1$. In some embodiments, L is -$L^4$-G-, wherein $L^4$ is an optionally substituted methylene; G is as defined above and described herein; and G is connected to $R^1$. In some embodiments, L is -$L^4$-G-, wherein $L^4$ is methylene; G is as defined above and described herein; and G is connected to $R^1$. In some embodiments, L is -$L^4$-G-, wherein $L^4$ is an optionally substituted —(CH$_2$)$_2$—; G is as defined above and described herein; and G is connected to $R^1$. In some embodiments, L is -$L^4$-G-, wherein $L^4$ is —(CH$_2$)$_2$—; G is as defined above and described herein; and G is connected to In some embodiments, L is

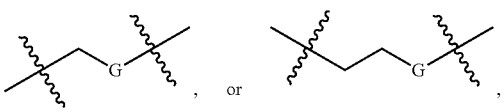

wherein G is as defined above and described herein, and G is connected to $R^1$. In some embodiments, L is

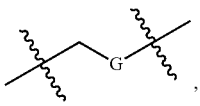

wherein G is as defined above and described herein, and G is connected to R¹. In some embodiments, L is

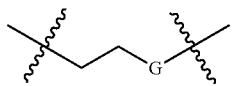

wherein G is as defined above and described herein, and G is connected to R¹. In some embodiments, L is

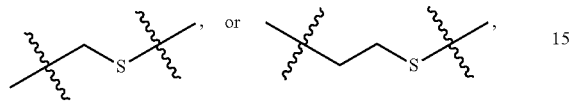, or wherein the sulfur atom is connected to R¹. In some embodiments, L is

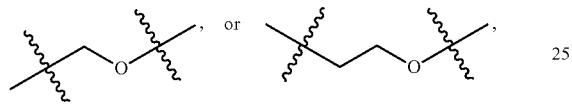, or wherein the oxygen atom is connected to R¹.

In some embodiments, L is

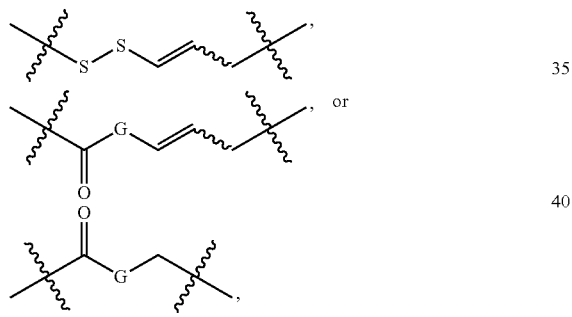, or wherein G is as defined above and described herein.

In some embodiments, L is —S—R$^{L3}$— or —S—C(O)—R$^{L3}$—, wherein R$^{L3}$ is an optionally substituted, linear or branched, $C_1$-$C_9$ alkylene, wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each of R' and -Cy- is independently as defined above and described herein. In some embodiments, L is —S—R$^{L3}$— or —S—C(O)—R$^{L3}$—, wherein R$^{L3}$ is an optionally substituted $C_1$-$C_6$ alkylene. In some embodiments, L is —S—R$^{L3}$— or —S—C(O)—R$^{L3}$—, wherein R$^{L3}$ is an optionally substituted $C_1$-$C_6$ alkenylene. In some embodiments, L is —S—R$^{L3}$— or —S—C(O)—R$^{L3}$—, wherein R$^{L3}$ is an optionally substituted $C_1$-$C_6$ alkylene wherein one or more methylene units are optionally and independently replaced by an optionally substituted $C_1$-$C_6$ alkenylene, arylene, or heteroarylene. In some embodiments, In some embodiments, R$^{L3}$ is an optionally substituted —S—($C_1$-$C_6$ alkenylene)-, —S—($C_1$-$C_6$ alkylene)-, —S—($C_1$-$C_6$ alkylene)-arylene-($C_1$-$C_6$ alkylene)-, —S—CO-arylene-($C_1$-$C_6$ alkylene)-, or —S—CO—($C_1$-$C_6$ alkylene)-arylene-($C_1$-$C_6$ alkylene)-.

In some embodiments, L is

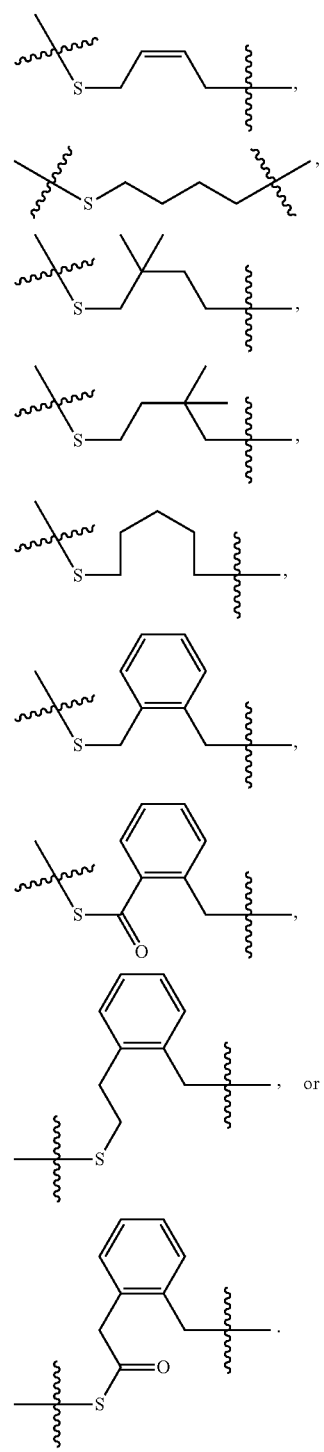, or

In some embodiments, L is

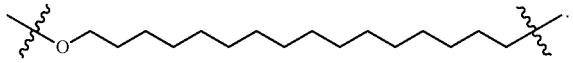 [SMILES: *CCCCCCCCCCCCCCCCO*]

In some embodiments, L is

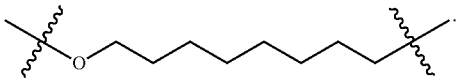 [SMILES: *CCCCCCCCO*]

In some embodiments,

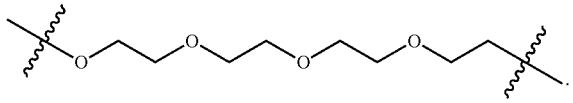 [SMILES: *CCOCCOCCOCCO*]

In some embodiments, the sulfur atom in the L embodiments described above and herein is connected to X. In some embodiments, the sulfur atom in the L embodiments described above and herein is connected to $R^1$.

In some embodiments, $R^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R)—, —S(O)—, —S(O)$_2$—, —S(O)$_2$N(R')—, —N(R)S(O)$_2$—, —SC(O)—, —C(O)S—, —OC(O)—, or —C(O)O—, wherein each variable is independently as defined above and described herein. In some embodiments, $R^1$ is halogen, R, or an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R)—, —S(O)—, —S(O)$_2$—, —S(O)$_2$N(R')—, —N(R)S(O)$_2$—, —SC(O)—, —C(O)S—, —OC(O)—, or —C(O)O—, wherein each variable is independently as defined above and described herein.

In some embodiments, $R^1$ is hydrogen. In some embodiments, $R^1$ is halogen. In some embodiments, $R^1$ is —F. In some embodiments, $R^1$ is —Cl. In some embodiments, $R^1$ is —Br. In some embodiments, $R^1$ is —I.

In some embodiments, $R^1$ is R wherein R is as defined above and described herein.

In some embodiments, $R^1$ is hydrogen. In some embodiments, $R^1$ is an optionally substituted group selected from $C_1$-$C_{50}$ aliphatic, phenyl, carbocyclyl, aryl, heteroaryl, and heterocyclyl.

In some embodiments, $R^1$ is an optionally substituted $C_1$-$C_{50}$ aliphatic. In some embodiments, $R^1$ is an optionally substituted $C_1$-$C_{10}$ aliphatic. In some embodiments, $R^1$ is an optionally substituted $C_1$-$C_6$ aliphatic. In some embodiments, $R^1$ is an optionally substituted $C_1$-$C_6$ alkyl. In some embodiments, $R^1$ is optionally substituted, linear or branched hexyl. In some embodiments, $R^1$ is optionally substituted, linear or branched pentyl. In some embodiments, le is optionally substituted, linear or branched butyl. In some embodiments, $R^1$ is optionally substituted, linear or branched propyl. In some embodiments, $R^1$ is optionally substituted ethyl. In some embodiments, $R^1$ is optionally substituted methyl.

In some embodiments, $R^1$ is optionally substituted phenyl. In some embodiments, $R^1$ is substituted phenyl. In some embodiments, $R^1$ is phenyl.

In some embodiments, $R^1$ is optionally substituted carbocyclyl. In some embodiments, $R^1$ is optionally substituted $C_3$-$C_{10}$ carbocyclyl. In some embodiments, $R^1$ is optionally substituted monocyclic carbocyclyl. In some embodiments, $R^1$ is optionally substituted cycloheptyl. In some embodiments, $R^1$ is optionally substituted cyclohexyl. In some embodiments, $R^1$ is optionally substituted cyclopentyl. In some embodiments, $R^1$ is optionally substituted cyclobutyl. In some embodiments, $R^1$ is an optionally substituted cyclopropyl. In some embodiments, $R^1$ is optionally substituted bicyclic carbocyclyl.

In some embodiments, $R^1$ is an optionally substituted $C_1$-$C_{50}$ polycyclic hydrocarbon. In some embodiments, $R^1$ is an optionally substituted $C_1$-$C_{50}$ polycyclic hydrocarbon wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R)—, —S(O)—, —S(O)$_2$—, —S(O)$_2$N(R')—, —N(R)S(O)$_2$—, —SC(O)—, —C(O)S—, —OC(O)—, or —C(O)O—, wherein each variable is independently as defined above and described herein. In some embodiments, $R^1$ is optionally substituted

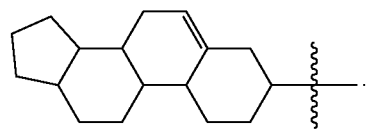 [SMILES: *C1CCC2C(=CCC3C4CCCC4CCC23)C1]

In some embodiments, $R^1$ is

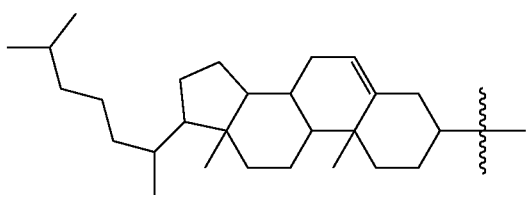

In some embodiments, $R^1$ is optionally substituted

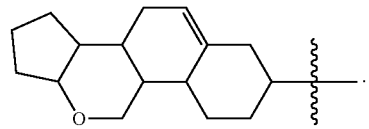 [SMILES: *C1CCC2C(=CCC3C4CCCC4OCC23)C1]

In some embodiments, $R^1$ is an optionally substituted $C_1$-$C_{50}$ aliphatic comprising one or more optionally substituted polycyclic hydrocarbon moieties. In some embodiments, $R^1$ is an optionally substituted $C_1$-$C_{50}$ aliphatic comprising one or more optionally substituted polycyclic hydrocarbon moieties, wherein one or more methylene units are optionally and independently replaced by an optionally substituted $C_1$-$C_6$ alkylene, $C_1$-$C_6$ alkenylene, —C≡C—, —C(R)$_2$—, -Cy-, —O—, —S—, —S—S—, N(R')—, —C(O)—, —C(S)—, —C(NR')—, —C(O)N(R')—, —N(R')C(O)N(R')—, —N(R')C(O)—, —N(R')C(O)O—, —OC(O)N(R)—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is an optionally substituted $C_1$-$C_{50}$ aliphatic comprising one or more optionally substituted

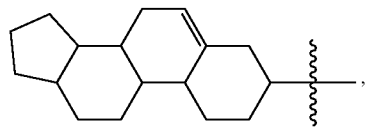,

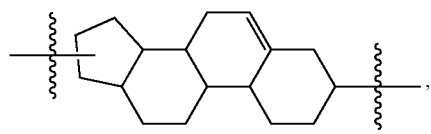,

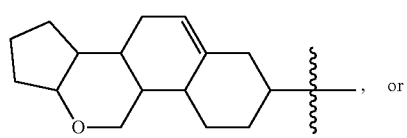, or

-continued

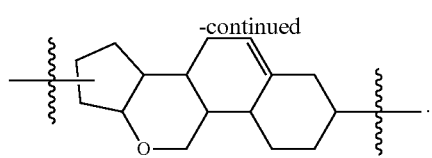

In some embodiments, $R^1$ is

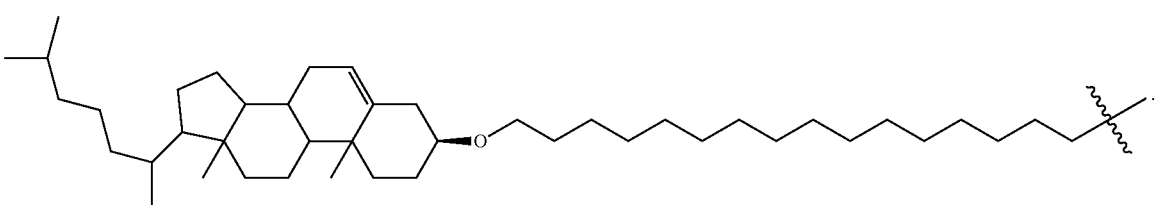 [SMILES: *CCCCCCCCCCCCCCCCO[C@H]1CCC2(C)C(=CCC3C2CCC2(C)C(C(C)CCCC(C)C)CCC32)C1] .

In some embodiments, $R^1$ is

In some embodiments, $R^1$ is

In some embodiments, $R^1$ is

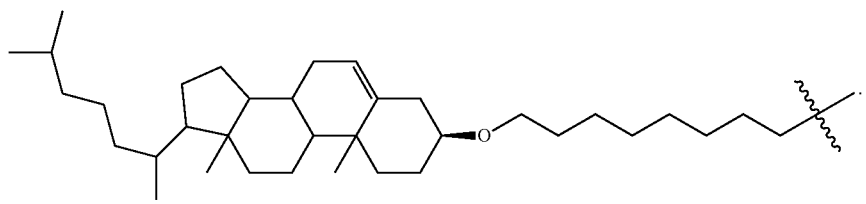 [SMILES: *CCCCCCCCO[C@H]1CCC2(C)C(=CCC3C2CCC2(C)C(C(C)CCCC(C)C)CCC32)C1]

In some embodiments, $R^1$ is

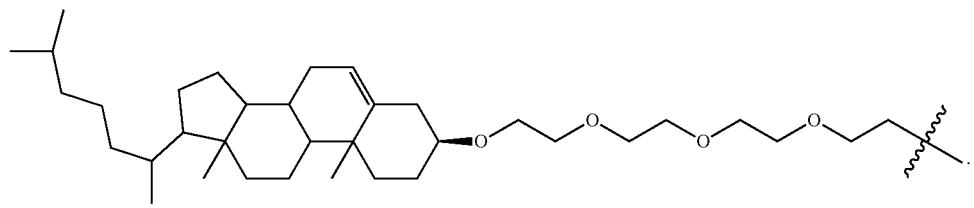 [SMILES: *CCOCCOCCOCCO[C@H]1CCC2(C)C(=CCC3C2CCC2(C)C(C(C)CCCC(C)C)CCC32)C1] .

In some embodiments, $R^1$ is an optionally substituted aryl. In some embodiments, $R^1$ is an optionally substituted bicyclic aryl ring.

In some embodiments, $R^1$ is an optionally substituted heteroaryl. In some embodiments, $R^1$ is an optionally substituted 5-6 membered monocyclic heteroaryl ring having 1-3 heteroatoms independently selected from nitrogen, sulfur, and oxygen. In some embodiments, $R^1$ is a substituted 5-6 membered monocyclic heteroaryl ring having 1-3 heteroatoms independently selected from nitrogen, oxygen, and sulfur. In some embodiments, le is an unsubstituted 5-6 membered monocyclic heteroaryl ring having 1-3 heteroatoms independently selected from nitrogen, sulfur, and oxygen.

In some embodiments, $R^1$ is an optionally substituted 5-membered monocyclic heteroaryl ring having 1-3 heteroatoms independently selected from nitrogen, sulfur, and oxygen. In some embodiments, $R^1$ is an optionally substituted 6 membered monocyclic heteroaryl ring having 1-3 heteroatoms independently selected from nitrogen, oxygen, and sulfur.

In some embodiments, $R^1$ is an optionally substituted 5-membered monocyclic heteroaryl ring having 1 heteroatom selected from nitrogen, oxygen, and sulfur. In some embodiments, $R^1$ is selected from pyrrolyl, furanyl, and thienyl.

In some embodiments, $R^1$ is an optionally substituted 5-membered heteroaryl ring having 2 heteroatoms independently selected from nitrogen, oxygen, and sulfur. In certain embodiments, $R^1$ is an optionally substituted 5-membered heteroaryl ring having 1 nitrogen atom, and an additional heteroatom selected from sulfur and oxygen. Example $R^1$ groups include optionally substituted pyrazolyl, imidazolyl, thiazolyl, isothiazolyl, oxazolyl or isoxazolyl.

In some embodiments, $R^1$ is a 6-membered heteroaryl ring having 1-3 nitrogen atoms. In other embodiments, $R^1$ is an optionally substituted 6-membered heteroaryl ring having 1-2 nitrogen atoms. In some embodiments, $R^1$ is an optionally substituted 6-membered heteroaryl ring having 2 nitrogen atoms. In certain embodiments, $R^1$ is an optionally substituted 6-membered heteroaryl ring having 1 nitrogen. Example $R^1$ groups include optionally substituted pyridinyl, pyrimidinyl, pyrazinyl, pyridazinyl, triazinyl, or tetrazinyl.

In certain embodiments, $R^1$ is an optionally substituted 8-10 membered bicyclic heteroaryl ring having 1-4 heteroatoms independently selected from nitrogen, oxygen, and sulfur. In some embodiments, $R^1$ is an optionally substituted 5,6-fused heteroaryl ring having 1-4 heteroatoms independently selected from nitrogen, oxygen, and sulfur. In other embodiments, $R^1$ is an optionally substituted 5,6-fused heteroaryl ring having 1-2 heteroatoms independently selected from nitrogen, oxygen, and sulfur. In certain embodiments, $R^1$ is an optionally substituted 5,6-fused heteroaryl ring having 1 heteroatom independently selected from nitrogen, oxygen, and sulfur. In some embodiments, $R^1$ is an optionally substituted indolyl. In some embodiments, $R^1$ is an optionally substituted azabicyclo[3.2.1]octanyl. In certain embodiments, $R^1$ is an optionally substituted 5,6-fused heteroaryl ring having 2 heteroatoms independently selected from nitrogen, oxygen, and sulfur. In some embodiments, $R^1$ is an optionally substituted azaindolyl. In some embodiments, $R^1$ is an optionally substituted benzimidazolyl. In some embodiments, $R^1$ is an optionally substituted benzothiazolyl. In some embodiments, $R^1$ is an optionally substituted benzoxazolyl. In some embodiments, $R^1$ is an optionally substituted indazolyl. In certain embodiments, $R^1$ is an optionally substituted 5,6-fused heteroaryl ring having 3 heteroatoms independently selected from nitrogen, oxygen, and sulfur.

In certain embodiments, $R^1$ is an optionally substituted 6,6-fused heteroaryl ring having 1-4 heteroatoms independently selected from nitrogen, oxygen, and sulfur. In some embodiments, $R^1$ is an optionally substituted 6,6-fused heteroaryl ring having 1-2 heteroatoms independently selected from nitrogen, oxygen, and sulfur. In other embodiments, $R^1$ is an optionally substituted 6,6-fused heteroaryl ring having 1 heteroatom independently selected from nitrogen, oxygen, and sulfur. In some embodiments, $R^1$ is an optionally substituted quinolinyl. In some embodiments, $R^1$ is an optionally substituted isoquinolinyl. According to one aspect, $R^1$ is an optionally substituted 6,6-fused heteroaryl ring having 2 heteroatoms independently selected from nitrogen, oxygen, and sulfur. In some embodiments, $R^1$ is a quinazoline or a quinoxaline.

In some embodiments, $R^1$ is an optionally substituted heterocyclyl. In some embodiments, $R^1$ is an optionally substituted 3-7 membered saturated or partially unsaturated heterocyclic ring having 1-2 heteroatoms independently selected from nitrogen, oxygen, and sulfur. In some embodiments, $R^1$ is a substituted 3-7 membered saturated or partially unsaturated heterocyclic ring having 1-2 heteroatoms independently selected from nitrogen, oxygen, and sulfur. In some embodiments, $R^1$ is an unsubstituted 3-7 membered saturated or partially unsaturated heterocyclic ring having 1-2 heteroatoms independently selected from nitrogen, oxygen, and sulfur.

In some embodiments, $R^1$ is an optionally substituted heterocyclyl. In some embodiments, $R^1$ is an optionally substituted 6 membered saturated or partially unsaturated heterocyclic ring having 1-2 heteroatoms independently selected from nitrogen, oxygen, and sulfur. In some embodiments, $R^1$ is an optionally substituted 6 membered partially unsaturated heterocyclic ring having 2 heteroatoms independently selected from nitrogen, oxygen, and sulfur. In some embodiments, $R^1$ is an optionally substituted 6 membered partially unsaturated heterocyclic ring having 2 oxygen atoms.

In certain embodiments, $R^1$ is a 3-7 membered saturated or partially unsaturated heterocyclic ring having 1-2 heteroatoms independently selected from nitrogen, oxygen, and sulfur. In certain embodiments, $R^1$ is oxiranyl, oxetanyl, tetrahydrofuranyl, tetrahydropyranyl, oxepaneyl, aziridineyl, azetidineyl, pyrrolidinyl, piperidinyl, azepanyl, thiiranyl, thietanyl, tetrahydrothiophenyl, tetrahydrothiopyranyl, thiepanyl, dioxolanyl, oxathiolanyl, oxazolidinyl, imidazolidinyl, thiazolidinyl, dithiolanyl, dioxanyl, morpholinyl, oxathianyl, piperazinyl, thiomorpholinyl, dithianyl, dioxepanyl, oxazepanyl, oxathiepanyl, dithiepanyl, diazepanyl, dihydrofuranonyl, tetrahydropyranonyl, oxepanonyl, pyrolidinonyl, piperidinonyl, azepanonyl, dihydrothiophenonyl, tetrahydrothiopyranonyl, thiepanonyl, oxazolidinonyl, oxazinanonyl, oxazepanonyl, dioxolanonyl, dioxanonyl, dioxepanonyl, oxathiolinonyl, oxathianonyl, oxathiepanonyl, thiazolidinonyl, thiazinanonyl, thiazepanonyl, imidazolidinonyl, tetrahydropyrimidinonyl, diazepanonyl, imidazolidinedionyl, oxazolidinedionyl, thiazolidinedionyl, dioxolanedionyl, oxathiolanedionyl, piperazinedionyl, morpholinedionyl, thiomorpholinedionyl, tetrahydropyranyl, tetrahydrofuranyl, morpholinyl, thiomorpholinyl, piperidinyl, piperazinyl, pyrrolidinyl, tetrahydrothiophenyl, or tetrahydrothiopyranyl. In some embodiments, $R^1$ is an optionally substituted 5-membered saturated or partially unsaturated heterocyclic ring having 1-2 heteroatoms independently selected from nitrogen, oxygen, and sulfur.

In certain embodiments, $R^1$ is an optionally substituted 5-6 membered partially unsaturated monocyclic ring having 1-2 heteroatoms independently selected from nitrogen, oxygen, and sulfur. In certain embodiments, $R^1$ is an optionally substituted tetrahydropyridinyl, dihydrothiazolyl, dihydrooxazolyl, or oxazolinyl group.

In some embodiments, $R^1$ is an optionally substituted 8-10 membered bicyclic saturated or partially unsaturated heterocyclic ring having 1-4 heteroatoms independently selected from nitrogen, oxygen, and sulfur. In some embodiments, $R^1$ is an optionally substituted indolinyl. In some embodiments, $R^1$ is an optionally substituted isoindolinyl. In some embodiments, $R^1$ is an optionally substituted 1, 2, 3, 4-tetrahydroquinoline. In some embodiments, $R^1$ is an optionally substituted 1, 2, 3, 4-tetrahydroisoquinoline.

In some embodiments, $R^1$ is an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is an optionally substituted $C_1$-$C_{10}$ aliphatic wherein one or more methylene units are optionally and independently replaced by an optionally -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R)—, —S(O)—, —S(O)$_2$—, —S(O)$_2$N(R')—, —N(R')S(O)$_2$—, —OC(O)—, or —C(O)O—, wherein each R' is independently as defined above and described herein. In some embodiments, $R^1$ is an optionally substituted $C_1$-$C_{10}$ aliphatic wherein one or more methylene units are optionally and independently replaced by an optionally -Cy-, —O—, —S—, —S—S—, —N(R')—, —C(O)—, —OC(O)—, or —C(O)O—, wherein each R' is independently as defined above and described herein.

In some embodiments, $R^1$ is

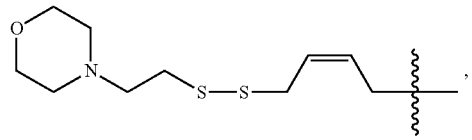

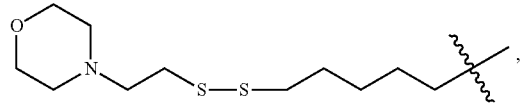

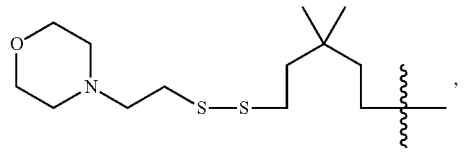

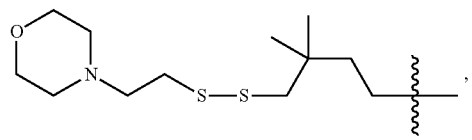

-continued

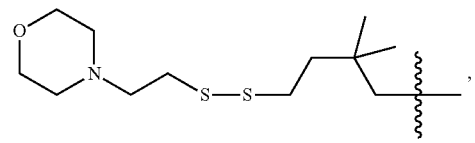

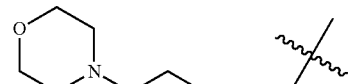

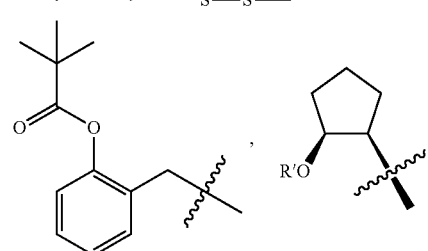

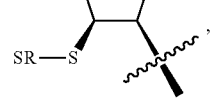

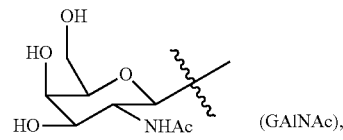

(GalNAc),

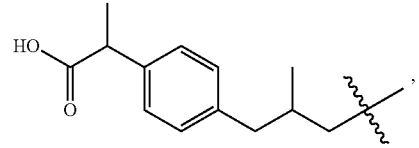

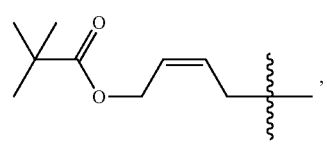

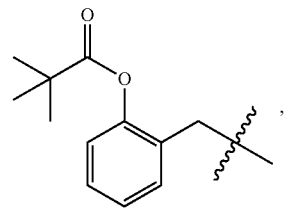

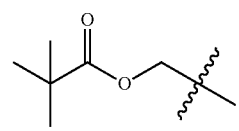

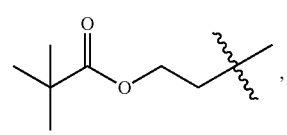

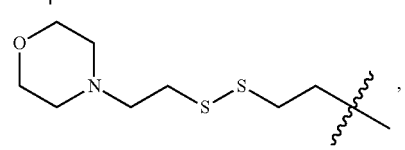

193
-continued
194
-continued
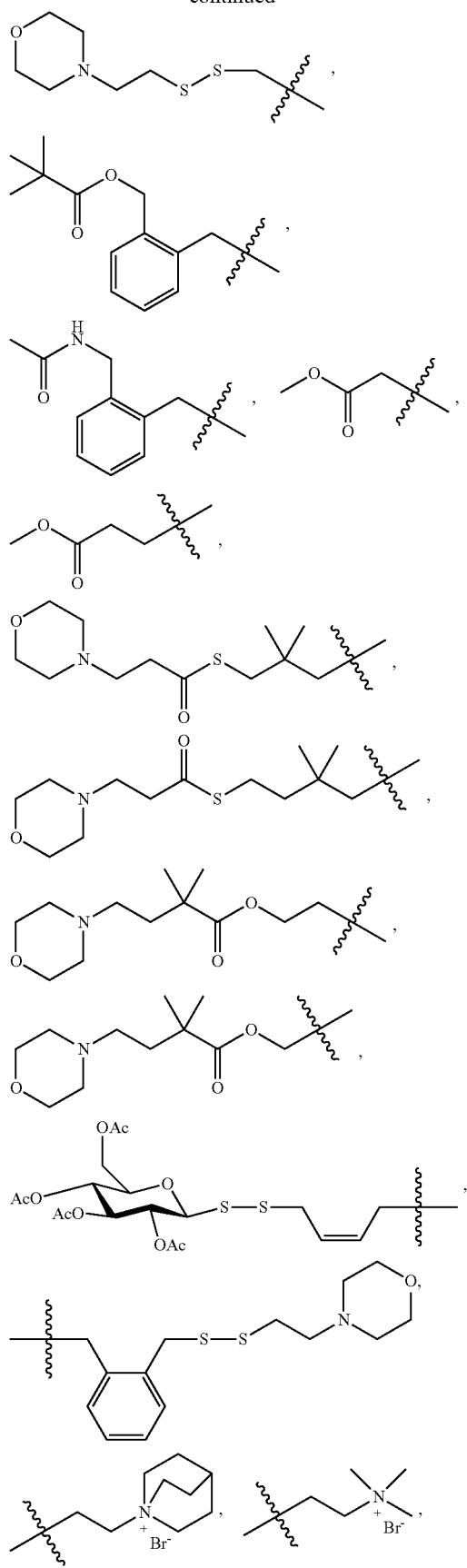
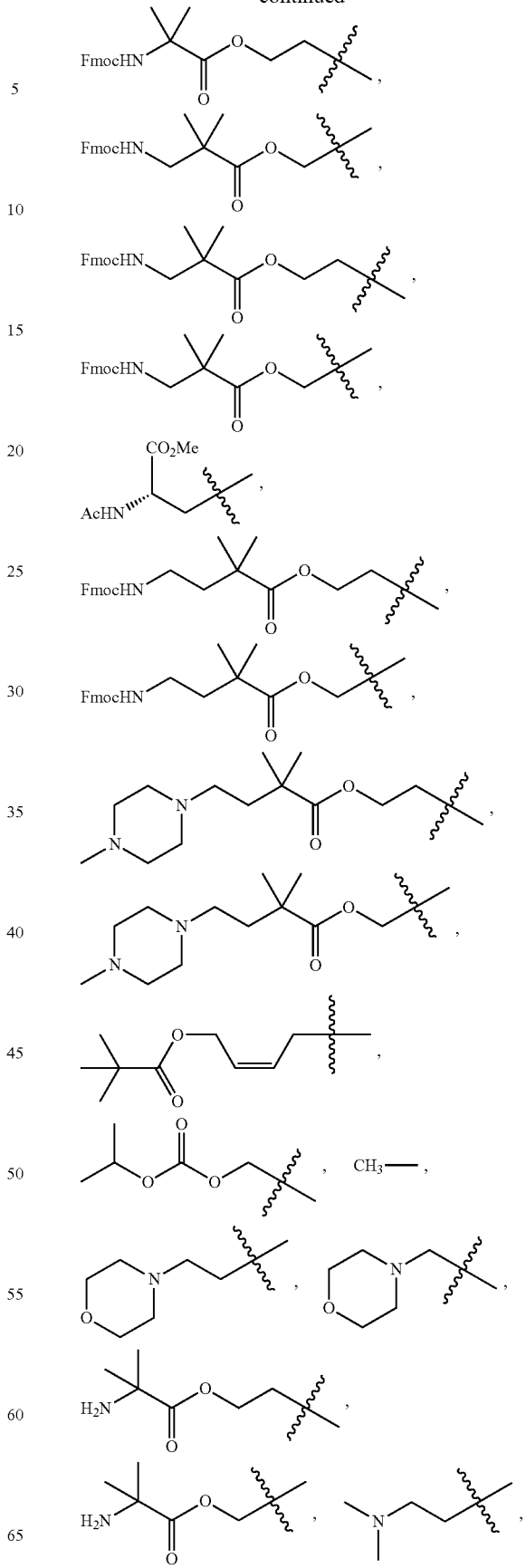

-continued

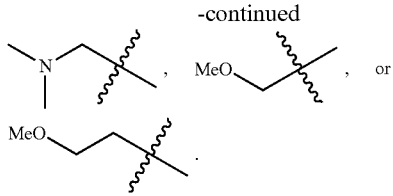

In some embodiments, R¹ is CH₃—,

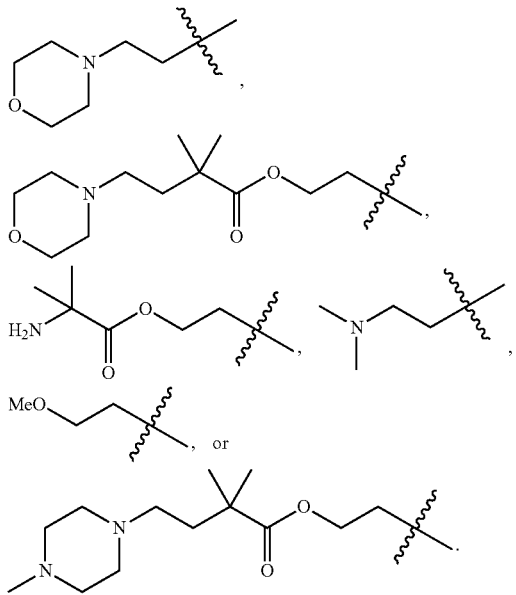

In some embodiments, R¹ comprises a terminal optionally substituted —(CH₂)₂— moiety which is connected to L. Examples of such R¹ groups are depicted below:

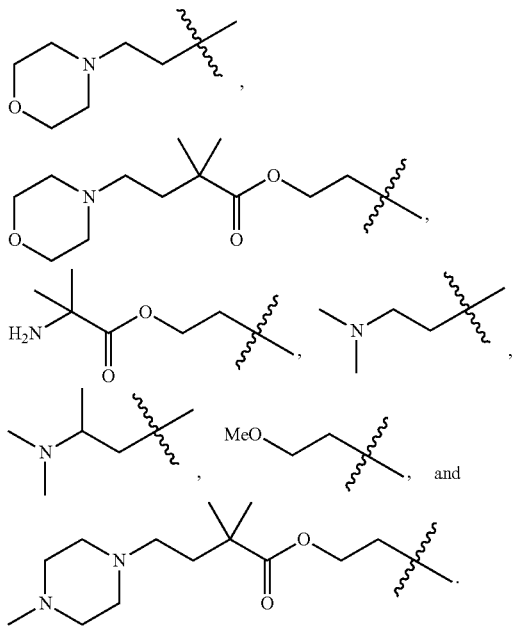

In some embodiments, R¹ comprises a terminal optionally substituted —(CH₂)— moiety which is connected to L. Example such R¹ groups are depicted below:

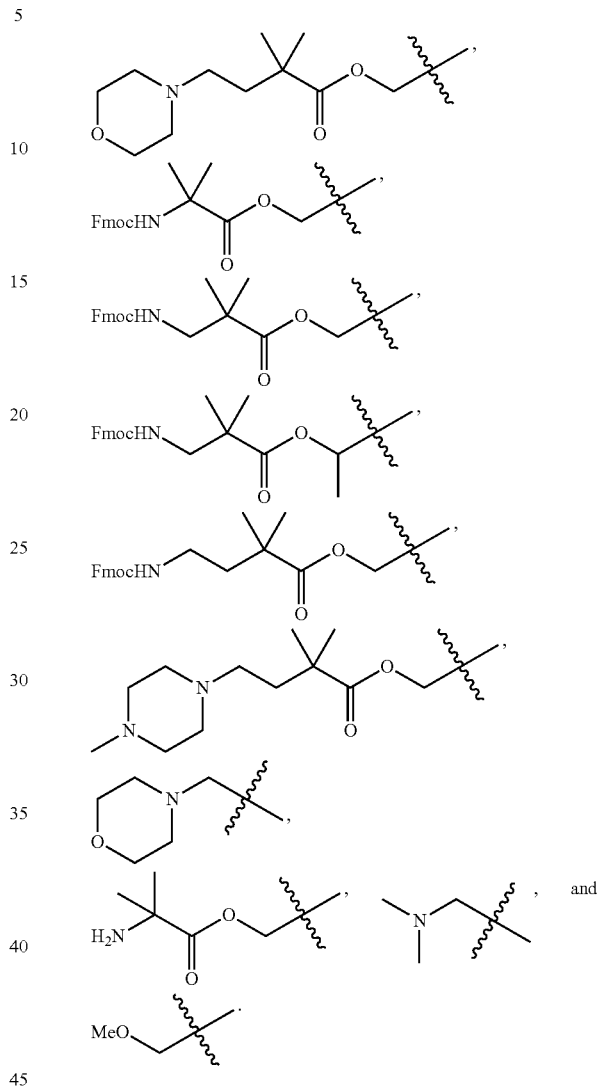

In some embodiments, R¹ is —S—$R^{L2}$, wherein $R^{L2}$ is an optionally substituted $C_1$-$C_9$ aliphatic wherein one or more methylene units are optionally and independently replaced by an optionally substituted $C_1$-$C_6$ alkylene, $C_1$-$C_6$ alkenylene, —C≡C—, —C(R')₂, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R)—, —S(O)—, —S(O)₂—, —S(O)₂N(R')—, —N(R)S(O)₂—, —SC(O)—, —C(O)S—, —OC(O)—, or —C(O)O—, and each of R' and -Cy- is independently as defined above and described herein. In some embodiments, R¹ is —S—$R^{L2}$, wherein the sulfur atom is connected with the sulfur atom in L group.

In some embodiments, R¹ is —C(O)—$R^{L2}$, wherein $R^{L2}$ is an optionally substituted $C_1$-$C_9$ aliphatic wherein one or more methylene units are optionally and independently replaced by an optionally substituted $C_1$-$C_6$ alkylene, $C_1$-$C_6$ alkenylene, —C≡C—, —C(R')₂, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)₂—, —S(O)₂N(R')—, —N(R')S(O)₂—, —SC(O)—, —C(O)S—, —OC(O)—, or —C(O)O—, and each of R' and -Cy- is independently as defined above and described herein. In some embodiments, R¹ is —C(O)—R$^{L2}$, wherein the carbonyl group is connected with G in L group. In some embodiments, R¹ is —C(O)—R$^{L2}$, wherein the carbonyl group is connected with the sulfur atom in L group.

In some embodiments, R$^{L2}$ is optionally substituted $C_1$-$C_9$ aliphatic. In some embodiments, R$^{L2}$ is optionally substituted $C_1$-$C_9$ alkyl. In some embodiments, R$^{L2}$ is optionally substituted $C_1$-$C_9$ alkenyl. In some embodiments, R$^{L2}$ is optionally substituted $C_1$-$C_9$ alkynyl. In some embodiments, R$^{L2}$ is an optionally substituted $C_1$-$C_9$ aliphatic wherein one or more methylene units are optionally and independently replaced by -Cy- or —C(O)—. In some embodiments, R$^{L2}$ is an optionally substituted $C_1$-$C_9$ aliphatic wherein one or more methylene units are optionally and independently replaced by -Cy-. In some embodiments, R$^{L2}$ is an optionally substituted $C_1$-$C_9$ aliphatic wherein one or more methylene units are optionally and independently replaced by an optionally substituted heterocyclene. In some embodiments, R$^{L2}$ is an optionally substituted $C_1$-$C_9$ aliphatic wherein one or more methylene units are optionally and independently replaced by an optionally substituted arylene. In some embodiments, R$^{L2}$ is an optionally substituted $C_1$-$C_9$ aliphatic wherein one or more methylene units are optionally and independently replaced by an optionally substituted heteroarylene. In some embodiments, R$^{L2}$ is an optionally substituted $C_1$-$C_9$ aliphatic wherein one or more methylene units are optionally and independently replaced by an optionally substituted $C_3$-$C_{10}$ carbocyclylene. In some embodiments, R$^{L2}$ is an optionally substituted $C_1$-$C_9$ aliphatic wherein two methylene units are optionally and independently replaced by -Cy- or —C(O)—. In some embodiments, R$^{L2}$ is an optionally substituted $C_1$-$C_9$ aliphatic wherein two methylene units are optionally and independently replaced by -Cy- or —C(O)—. Example R$^{L2}$ groups are depicted below:

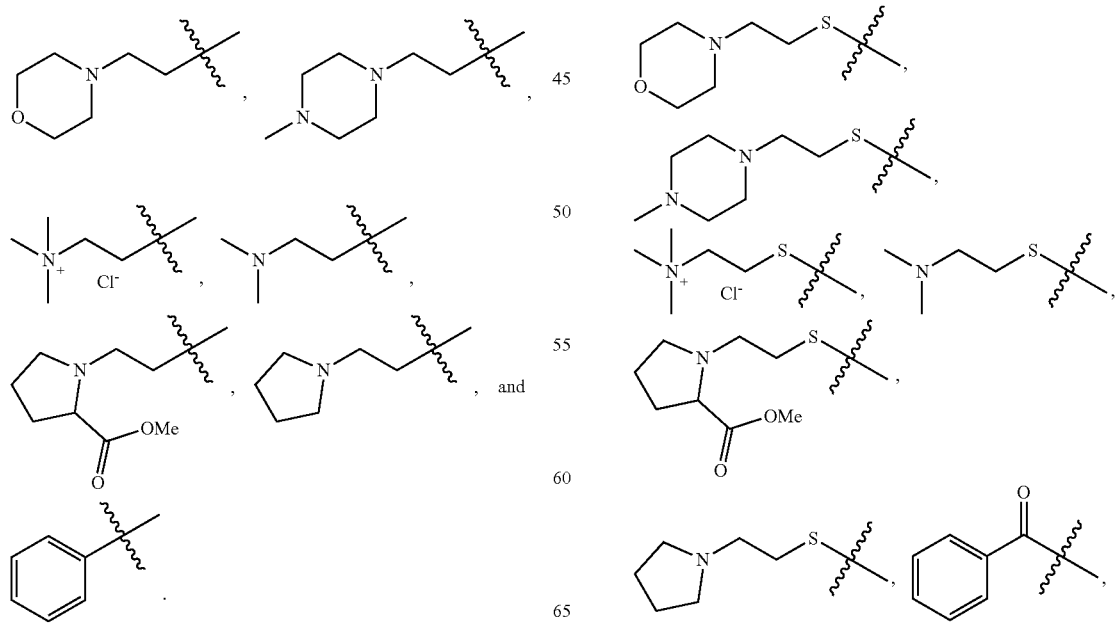

In some embodiments, R¹ is hydrogen, or an optionally substituted group selected from

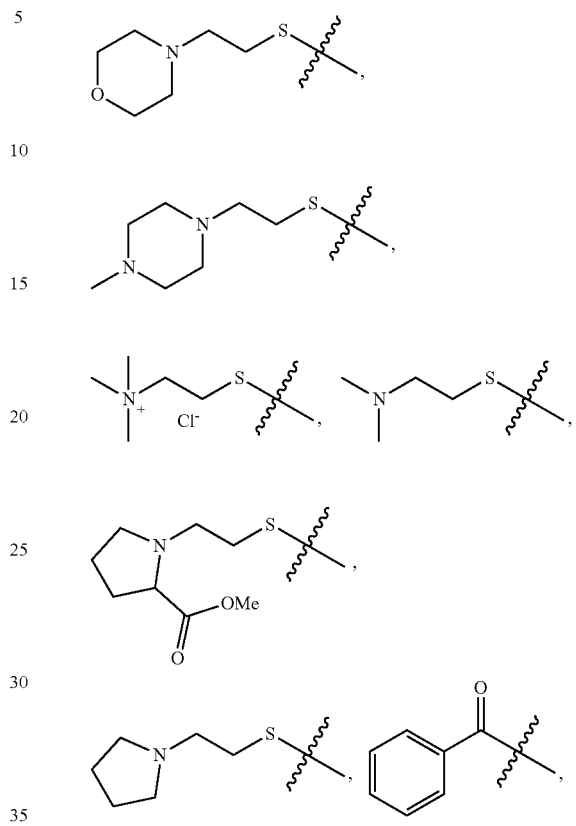

—S—($C_1$-$C_{10}$ aliphatic), $C_1$-$C_{10}$ aliphatic, aryl, $C_1$-$C_6$ heteroalkyl, heteroaryl and heterocyclyl. In some embodiments, R¹ is or —S—($C_1$-$C_{10}$ aliphatic). In some embodiments, $R^1$ is

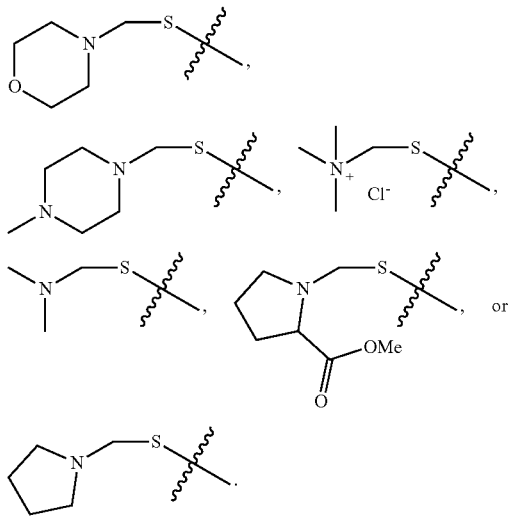

In some embodiments, $R^1$ is an optionally substituted group selected from —S—($C_1$-$C_6$ aliphatic), $C_1$-$C_{10}$ aliphatic, $C_1$-$C_6$ heteroaliphatic, aryl, heterocyclyl and heteroaryl.

In some embodiments, $R^1$ is

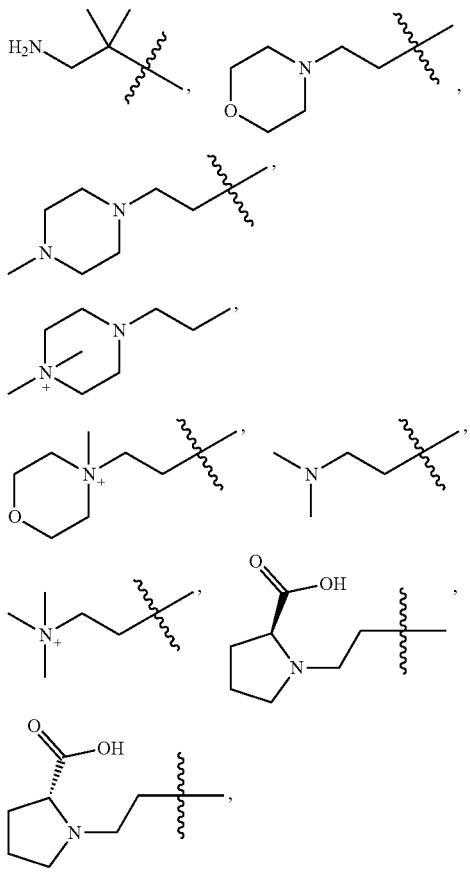

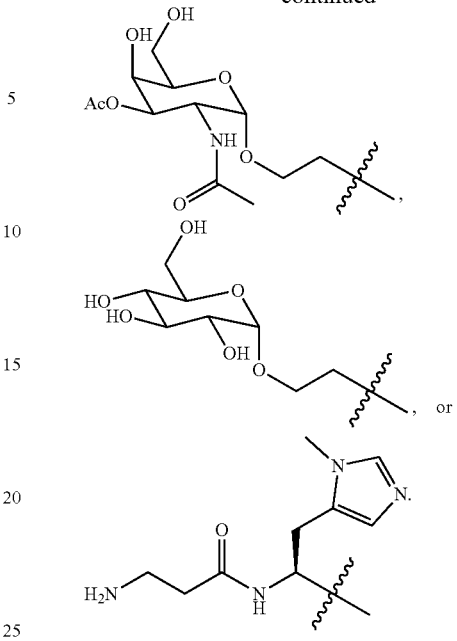

In some embodiments, the sulfur atom in the $R^1$ embodiments described above and herein is connected with the sulfur atom, G, E, or —C(O)— moiety in the L embodiments described above and herein. In some embodiments, the —C(O)— moiety in the $R^1$ embodiments described above and herein is connected with the sulfur atom, G, E, or —C(O)— moiety in the L embodiments described above and herein.

In some embodiments, -L-$R^1$ is any combination of the L embodiments and $R^1$ embodiments described above and herein.

In some embodiments, -L-$R^1$ is -$L^3$-G-$R^1$ wherein each variable is independently as defined above and described herein.

In some embodiments, -L-$R^1$ is -$L^4$-G-$R^1$ wherein each variable is independently as defined above and described herein.

In some embodiments, -L-$R^1$ is -$L^3$-G-S—$R^{L2}$, wherein each variable is independently as defined above and described herein.

In some embodiments, -L-$R^1$ is -$L^3$-G-C(O)—$R^{L2}$, wherein each variable is independently as defined above and described herein.

In some embodiments, -L-$R^1$ is

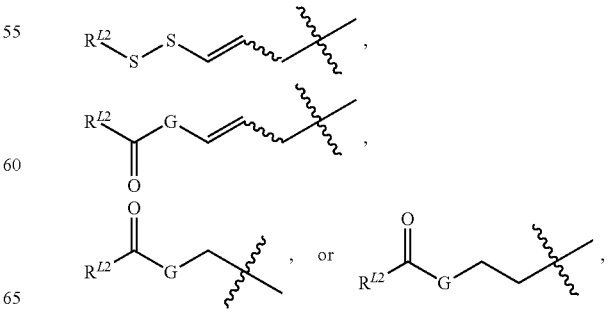

wherein $R^{L2}$ is an optionally substituted $C_1$-$C_9$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R)—, —N(R')S(O)$_2$—, —SC(O)—, —C(O)S—, —OC(O)—, or —C(O)O—, and each G is independently as defined above and described herein.

In some embodiments, -L-R$^1$ is —R$^{L3}$—S—S—R$^{L2}$, wherein each variable is independently as defined above and described herein. In some embodiments, -L-R$^1$ is —R$^{L3}$—C(O)—S—S—R$^{L2}$, wherein each variable is independently as defined above and described herein.

In some embodiments, -L-R$^1$ has the structure of:

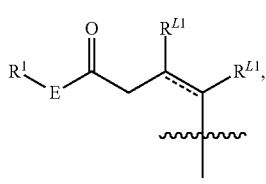

wherein each variable is independently as defined above and described herein.

In some embodiments, -L-R$^1$ has the structure of:

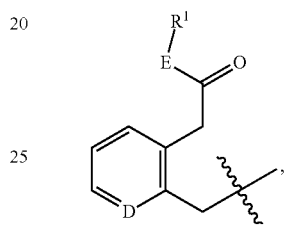

wherein each variable is independently as defined above and described herein.

In some embodiments, -L-R$^1$ has the structure of:

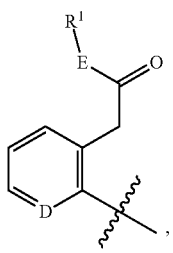

wherein each variable is independently as defined above and described herein.

In some embodiments, -L-R$^1$ has the structure of:

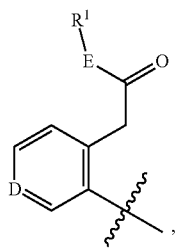

wherein each variable is independently as defined above and described herein.

In some embodiments, -L-R$^1$ has the structure of:

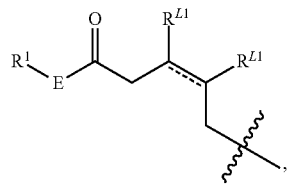

wherein each variable is independently as defined above and described herein.

In some embodiments, -L-R$^1$ has the structure of:

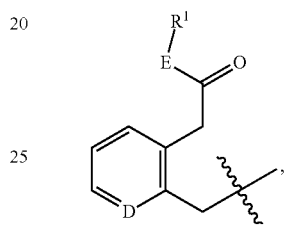

wherein each variable is independently as defined above and described herein.

In some embodiments, -L-R$^1$ has the structure of:

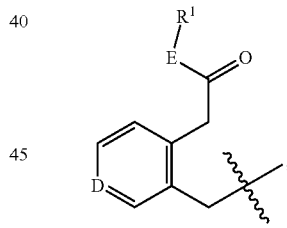

wherein each variable is independently as defined above and described herein.

In some embodiments, -L-R$^1$ has the structure of:

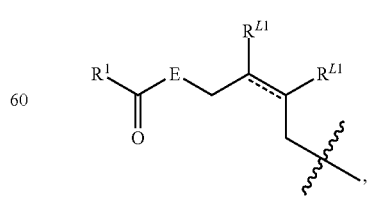

wherein each variable is independently as defined above and described herein.

In some embodiments, -L-R¹ has the structure of:

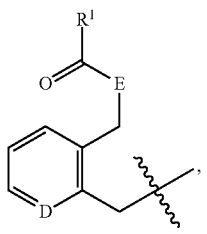

wherein each variable is independently as defined above and described herein.

In some embodiments, -L-R¹ has the structure of:

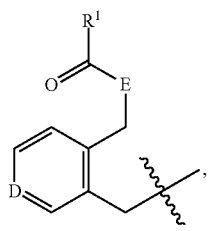

wherein each variable is independently as defined above and described herein.

In some embodiments, -L-R¹ has the structure of:

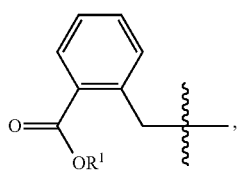

wherein each variable is independently as defined above and described herein.

In some embodiments, -L-R¹ has the structure of:

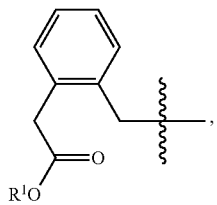

wherein each variable is independently as defined above and described herein.

In some embodiments, -L-R¹ has the structure of:

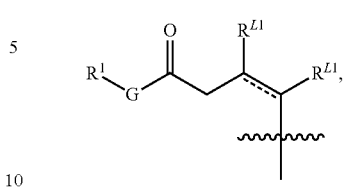

wherein each variable is independently as defined above and described herein.

In some embodiments, -L-R¹ has the structure of:


wherein each variable is independently as defined above and described herein.

In some embodiments, -L-R¹ has the structure of:


wherein each variable is independently as defined above and described herein.

In some embodiments, -L-R¹ has the structure of:

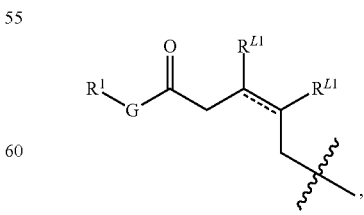

wherein each variable is independently as defined above and described herein.

In some embodiments, -L-R$^1$ has the structure of:

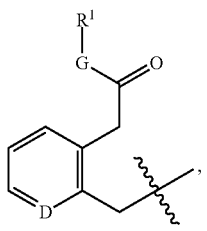

wherein each variable is independently as defined above and described herein.

In some embodiments, -L-R$^1$ has the structure of:

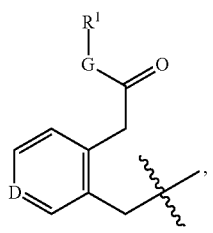

wherein each variable is independently as defined above and described herein.

In some embodiments, -L-R$^1$ has the structure of:

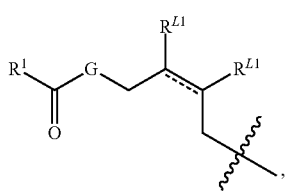

wherein each variable is independently as defined above and described herein.

In some embodiments, -L-R$^1$ has the structure of:

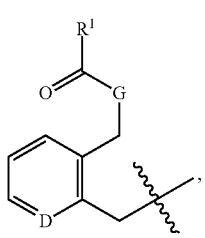

wherein each variable is independently as defined above and described herein.

In some embodiments, -L-R$^1$ has the structure of:

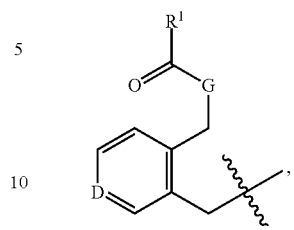

wherein each variable is independently as defined above and described herein.

In some embodiments, -L-R$^1$ has the structure of:

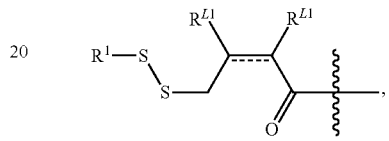

wherein each variable is independently as defined above and described herein.

In some embodiments, L has the structure of:

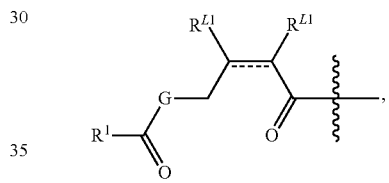

wherein each variable is independently as defined above and described herein.

In some embodiments, —X-L-R$^1$ has the structure of:

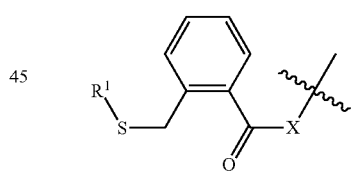

wherein:
the phenyl ring is optionally substituted, and
each of R$^1$ and X is independently as defined above and described herein.

In some embodiments, -L-R$^1$ is

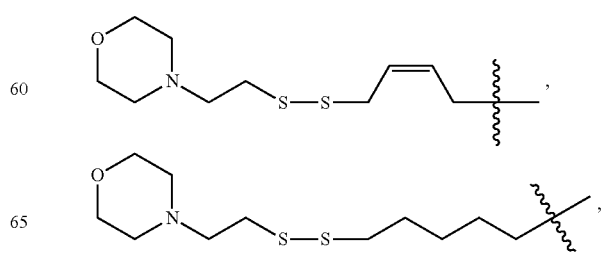

207
-continued
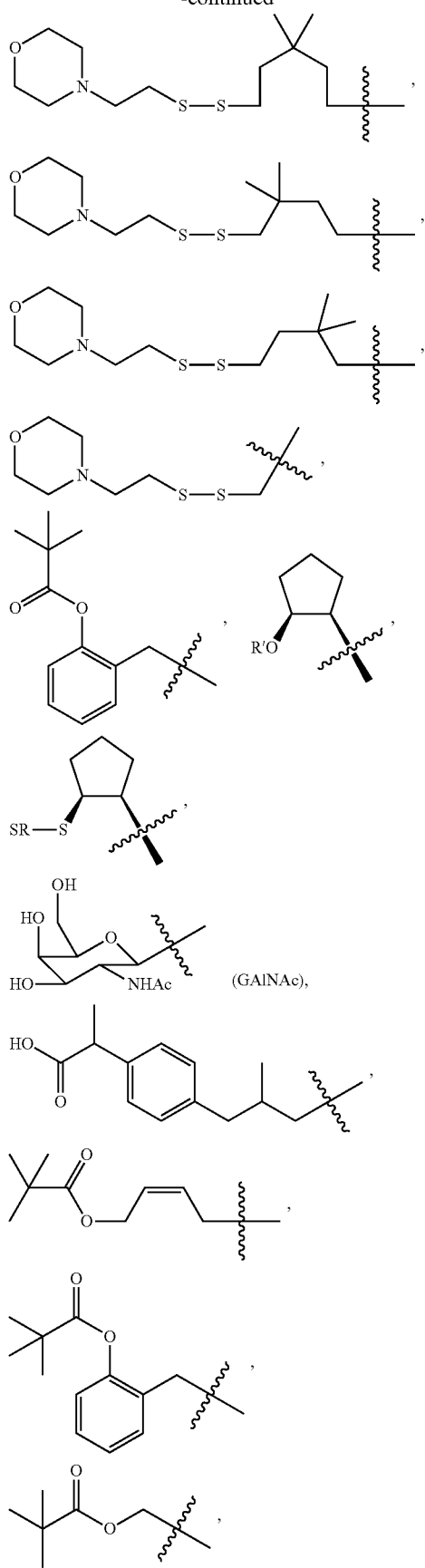
208
-continued
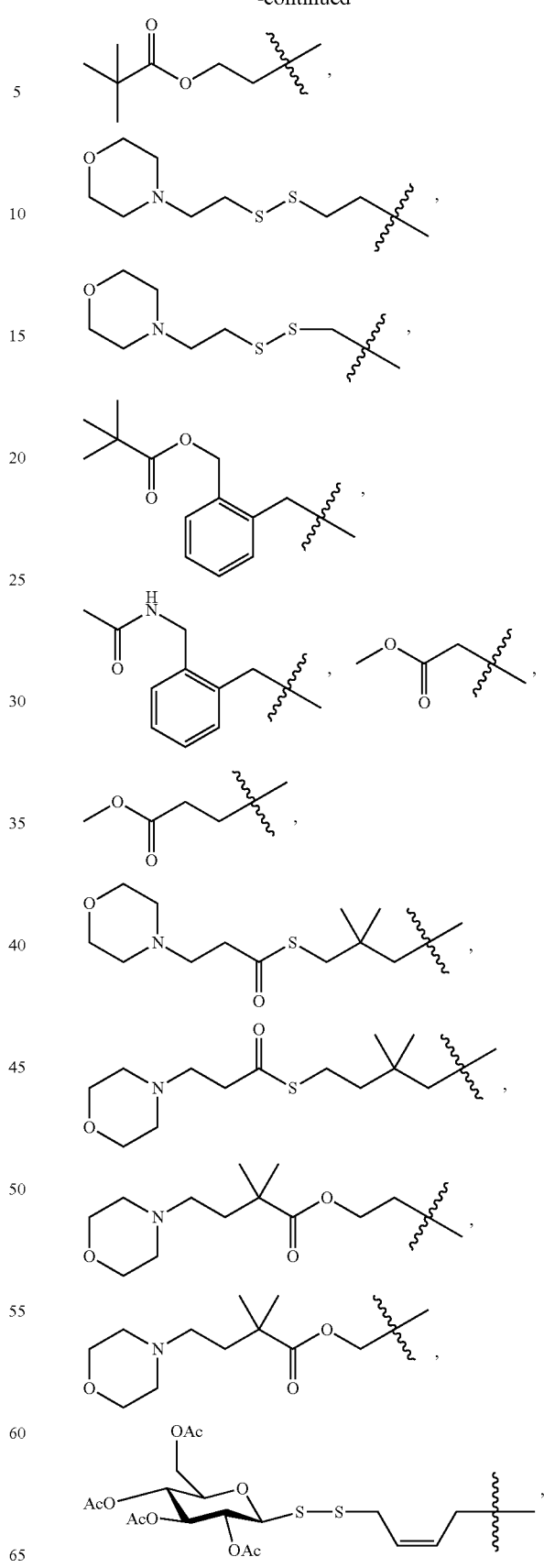

-continued
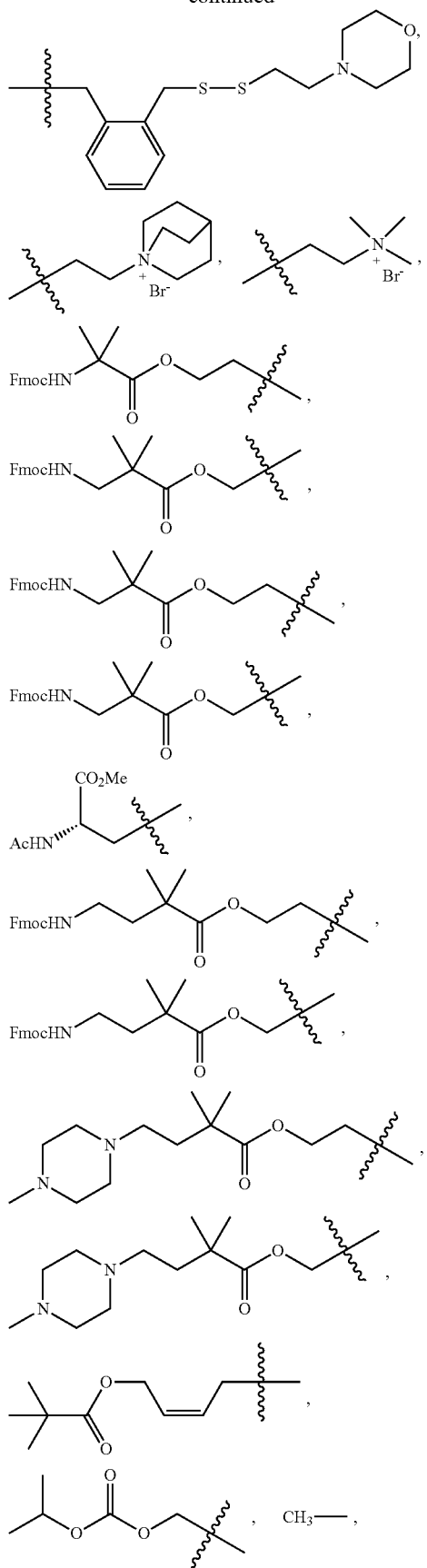
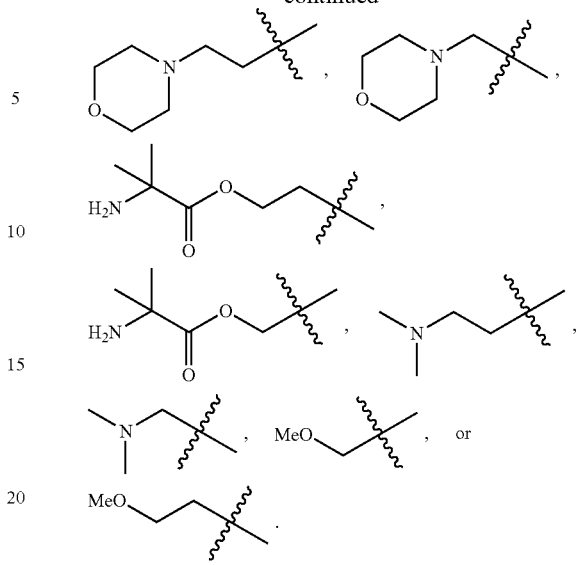
In some embodiments, -L-R¹ is:
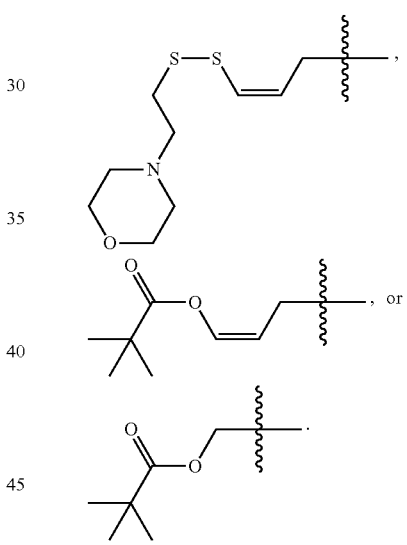
In some embodiments, -L-R¹ is CH₃—,
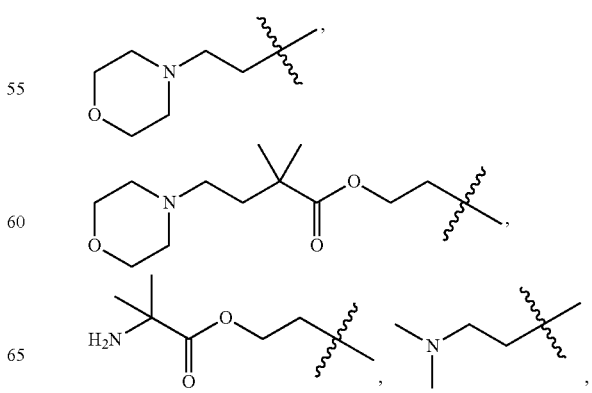

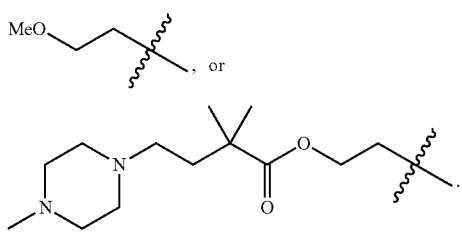

In some embodiments, -L-R¹ is

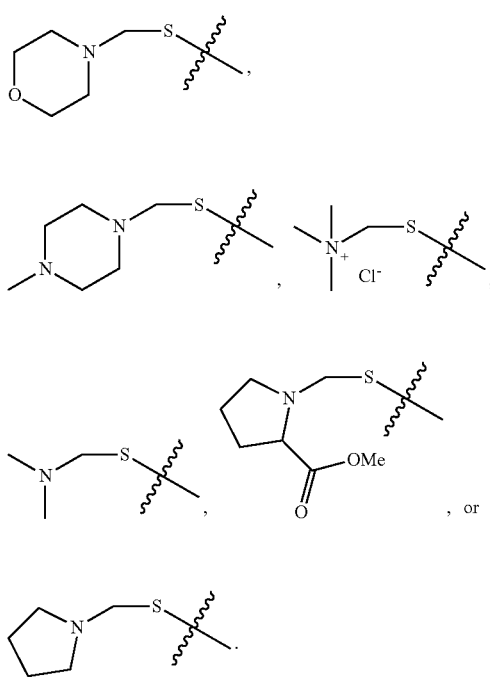

In some embodiments, -L-R¹ comprises a terminal optionally substituted —(CH₂)₂— moiety which is connected to X. In some embodiments, -L-R¹ comprises a terminal —(CH₂)₂— moiety which is connected to X. Examples of such -L-R¹ moieties are depicted below:

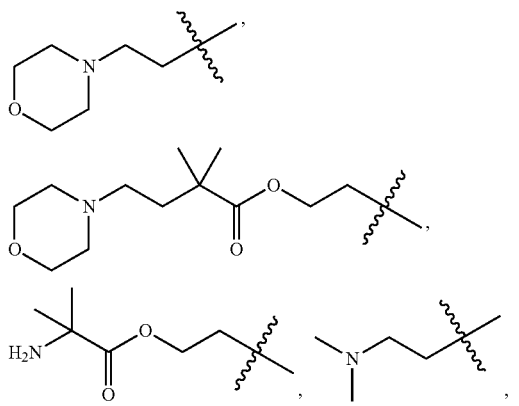

In some embodiments, -L-R¹ comprises a terminal optionally substituted —(CH₂)— moiety which is connected to X. In some embodiments, -L-R¹ comprises a terminal —(CH₂)— moiety which is connected to X. Examples of such -L-R¹ moieties are depicted below:

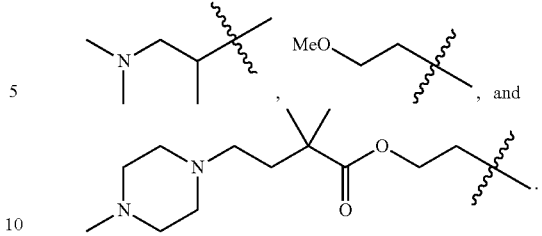

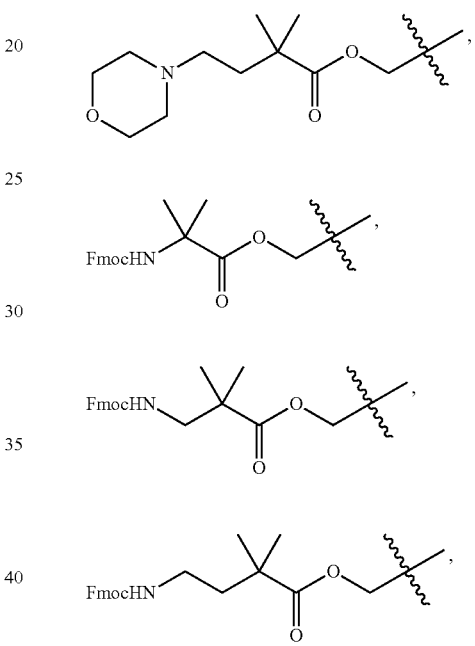

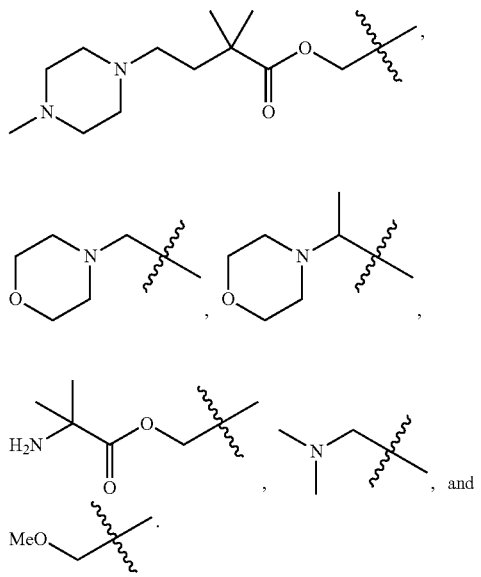

In some embodiments, -L-R¹ is
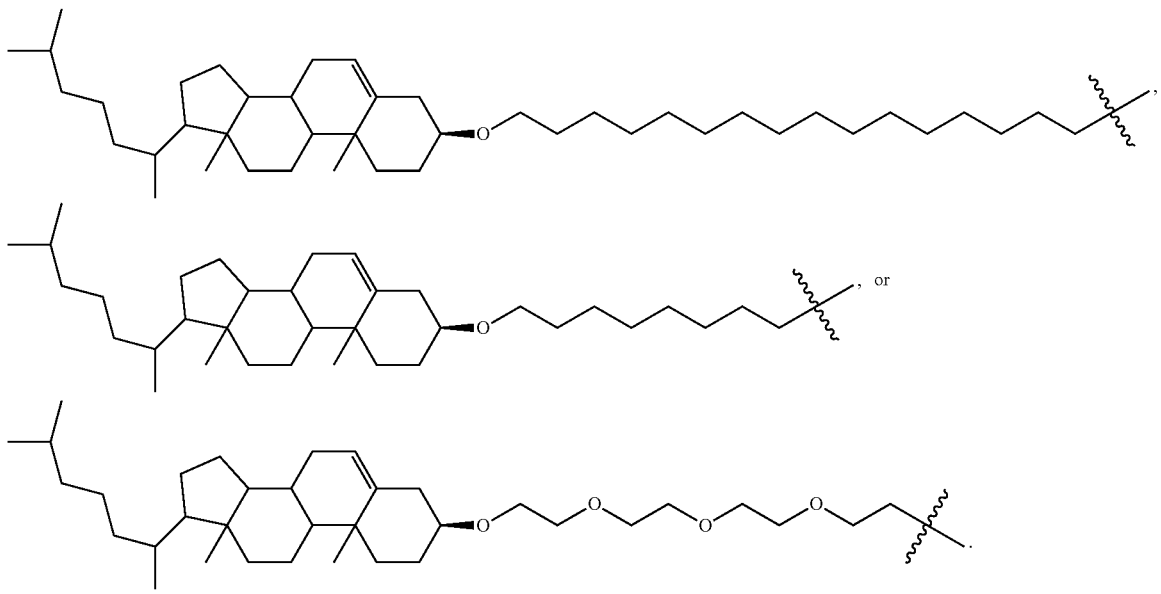
In some embodiments, -L-R¹ is CH₃—,
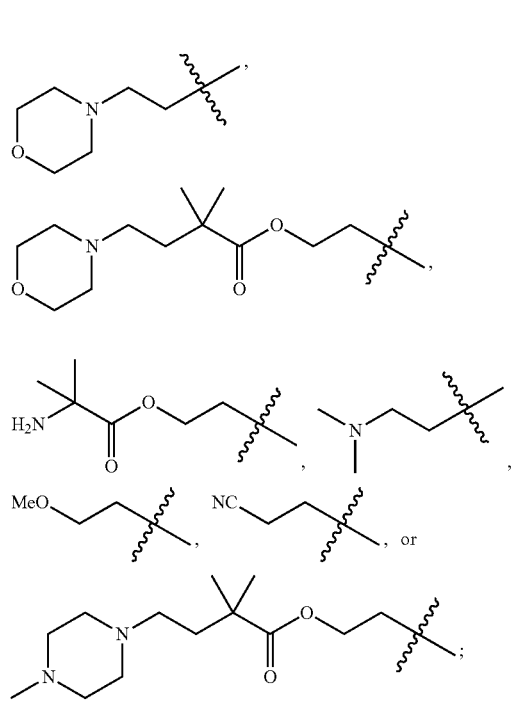
and X is —S—.
In some embodiments, -L-R¹ is CH₃—,
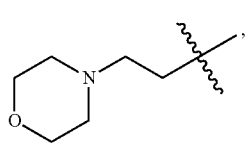
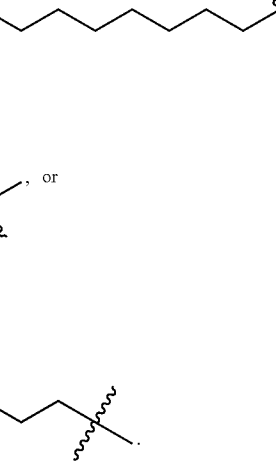
X is —S—, W is O, Y is —O—, and Z is —O—.
In some embodiments, R¹ is
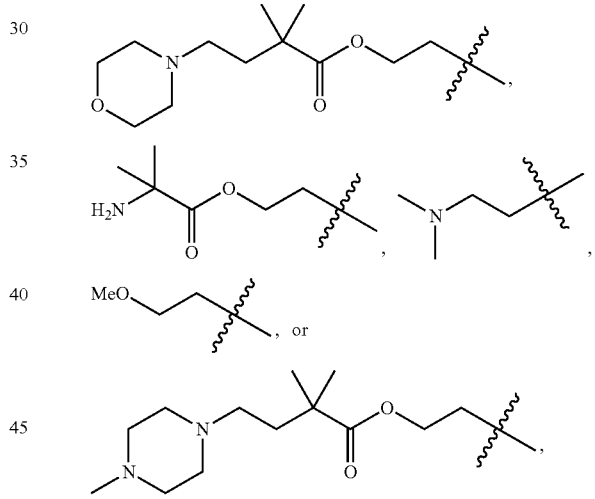
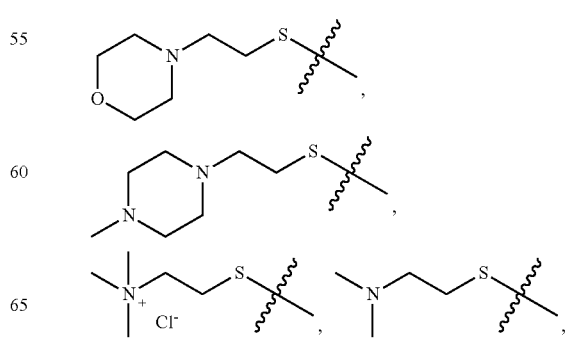

-continued
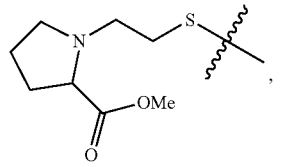
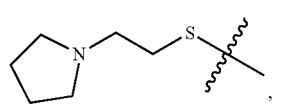, 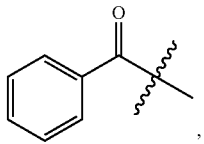,
In some embodiments, R¹ is
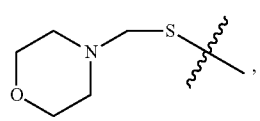,
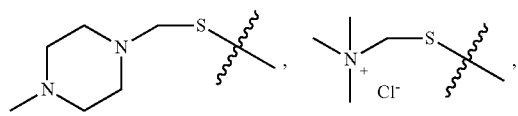
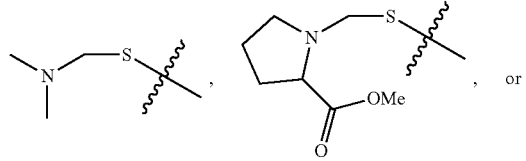 or
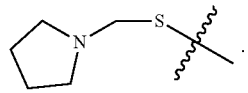.
In some embodiments, X is —O— or —S—, and R¹ is
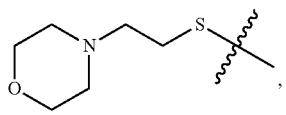,
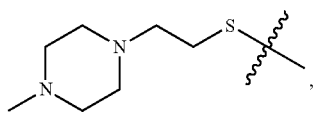,
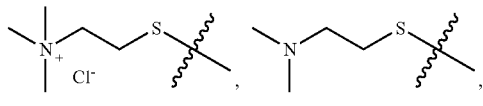,
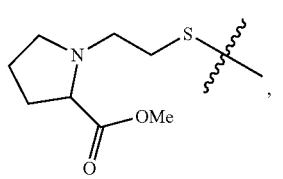,
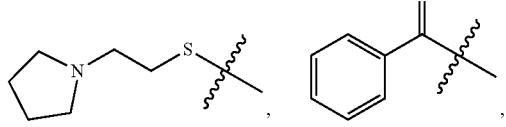,
or —S—($C_1$-$C_{10}$ aliphatic).
In some embodiments, X is —O— or —S—, and R¹ is
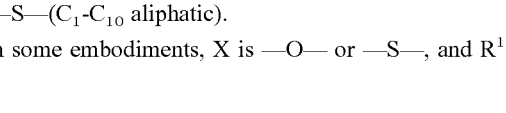,
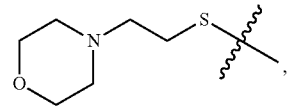, 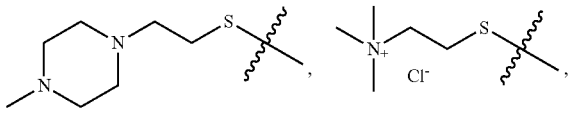,
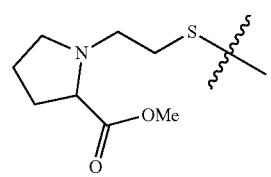, 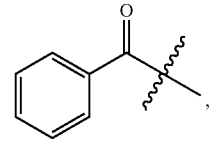,
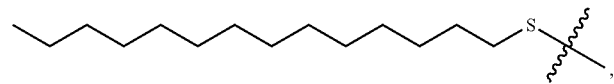,
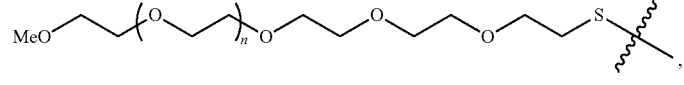,
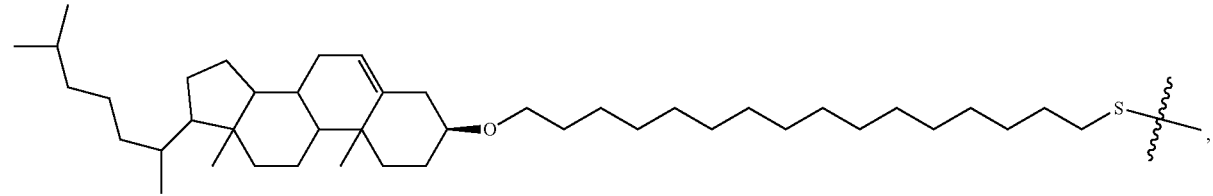,

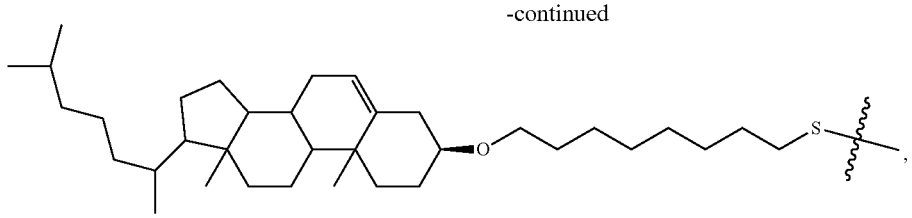
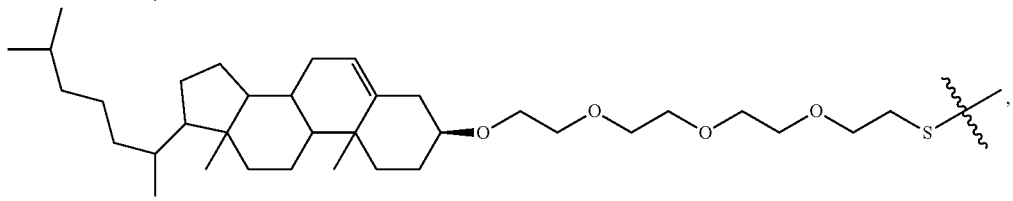
—S—(C$_1$-C$_{10}$ aliphatic) or —S—(C$_1$-C$_{50}$ aliphatic).
In some embodiments, L is a covalent bond and -L-R$^1$ is R$^1$.
In some embodiments, -L-R$^1$ is not hydrogen.
In some embodiments, —X-L-R$^1$ is R$^1$ is
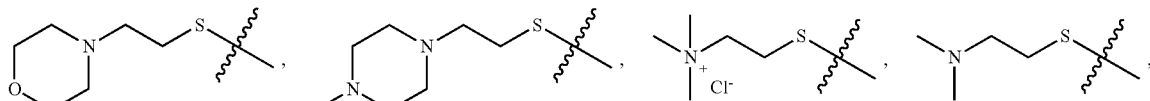
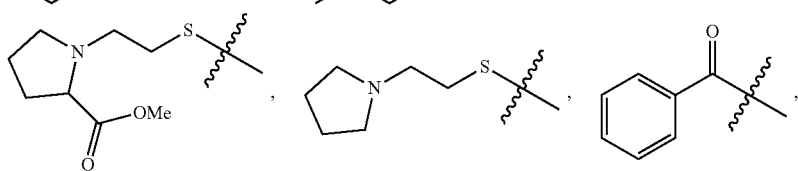
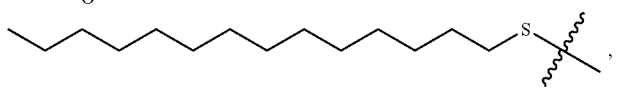
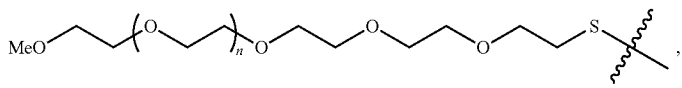
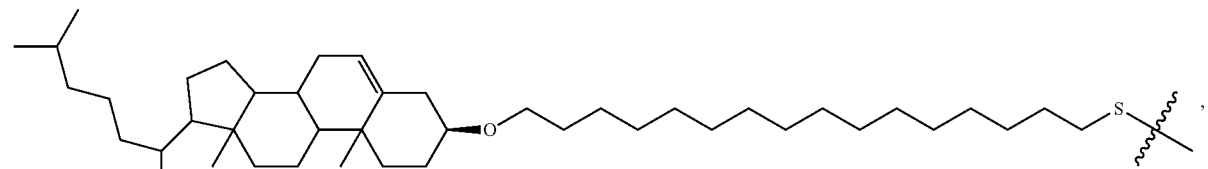
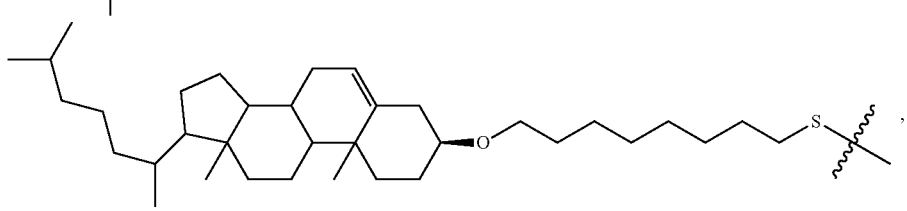
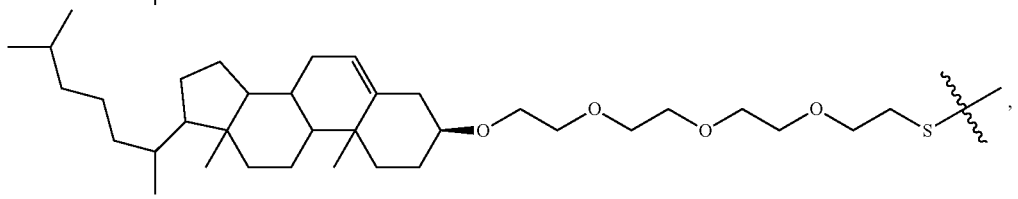
—S—(C$_1$-C$_{10}$ aliphatic) or —S—(C$_1$-C$_{50}$ aliphatic).

In some embodiments, —X-L-R¹ has the structure of

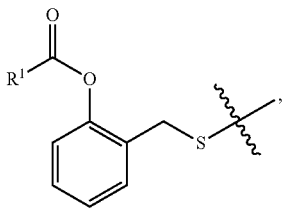

wherein the

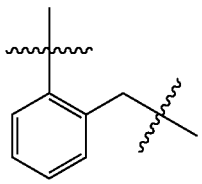

moiety is optionally substituted. In some embodiments, —X-L-R¹ is

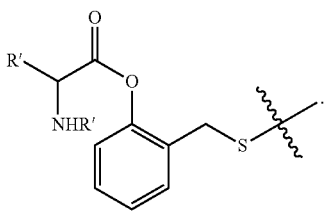

In some embodiments, —X-L-R¹ is

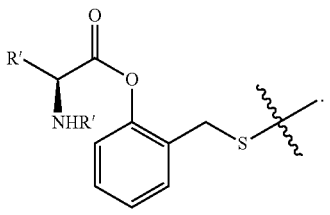

In some embodiments, —X-L-R¹ is

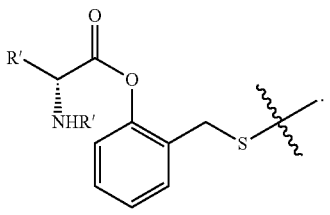

In some embodiments, —X-L-R¹ has the structure of

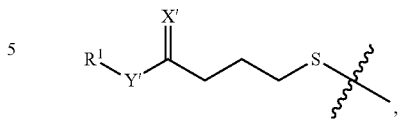

wherein X' is O or S, Y' is —O—, —S— or —NR'—, and the

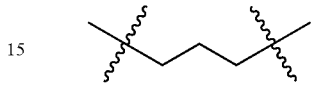

moiety is optionally substituted. In some embodiments, Y' is —O—, —S— or —NH—. In some embodiments,

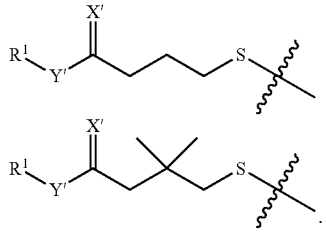

In some embodiments,

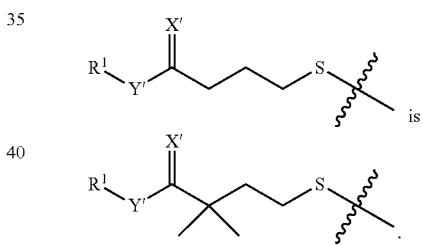

is some embodiments,

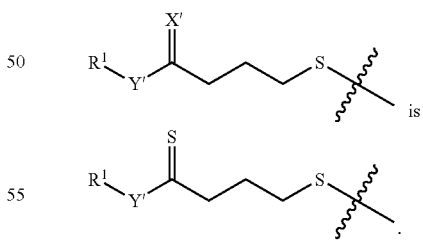

is

In some embodiments, —X-L-R¹ has the structure of

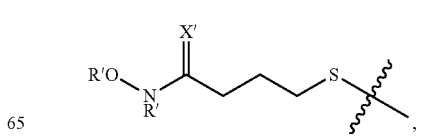

wherein X' is O or S, and the

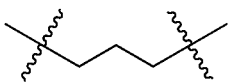 [SMILES: *CCC*]

moiety is optionally substituted. In some embodiments,

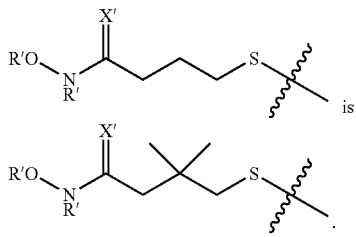

In some embodiments, —X-L-R$^1$ is

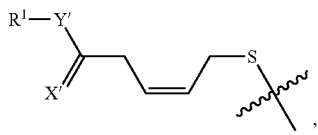

wherein the

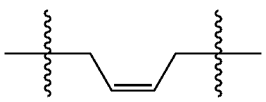

is optionally substituted. In some embodiments, —X-L-R$^1$ is

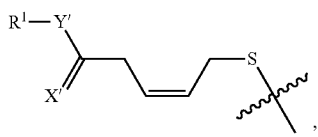

wherein the

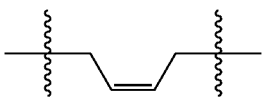

is substituted. In some embodiments, —X-L-R$^1$ is

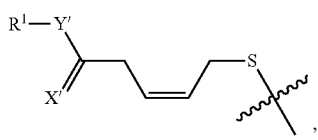

wherein the

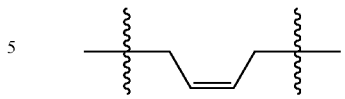

is unsubstituted.

In some embodiments, —X-L-R$^1$ is R$^1$—C(O)—S-L$^x$-S—, wherein L$^x$ is an optionally substituted group selected from

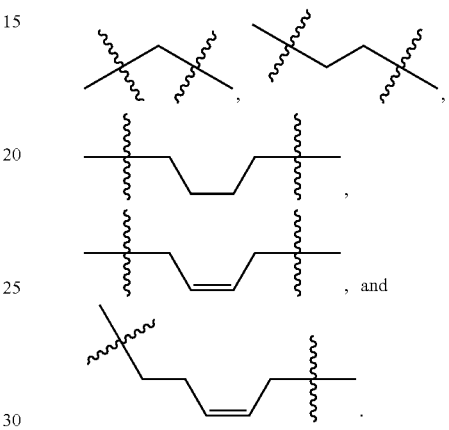

In some embodiments, L$^x$ is

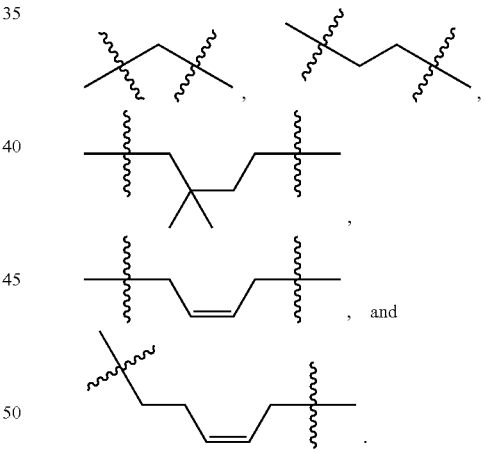

In some embodiments, —X-L-R$^1$ is (CH$_3$)$_3$C—S—S-L$^x$-S—. In some embodiments, —X-L-R$^1$ is R$^1$—C(=X')—Y'—C(R)$_2$—S-L$^x$-S—. In some embodiments, —X-L-R$^1$ is R—C(=X')—Y'—CH$_2$—S-L$^x$-S—. In some embodiments, —X-L-R$^1$ is

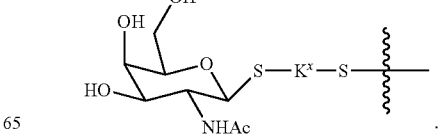

As will be appreciated by a person skilled in the art, many of the —X-L-R$^1$ groups described herein are cleavable and can be converted to —X$^-$ after administration to a subject. In some embodiments, —X-L-R$^1$ is cleavable. In some embodiments, —X-L-R$^1$ is and is converted to —S$^-$ after administration to a subject. In some embodiments, the conversion is promoted by an enzyme of a subject. As appreciated by a person skilled in the art, methods of determining whether the —S-L-R$^1$ group is converted to —S$^-$ after administration is widely known and practiced in the art, including those used for studying drug metabolism and pharmacokinetics.

In some embodiments, the internucleotidic linkage having the structure of Formula I is

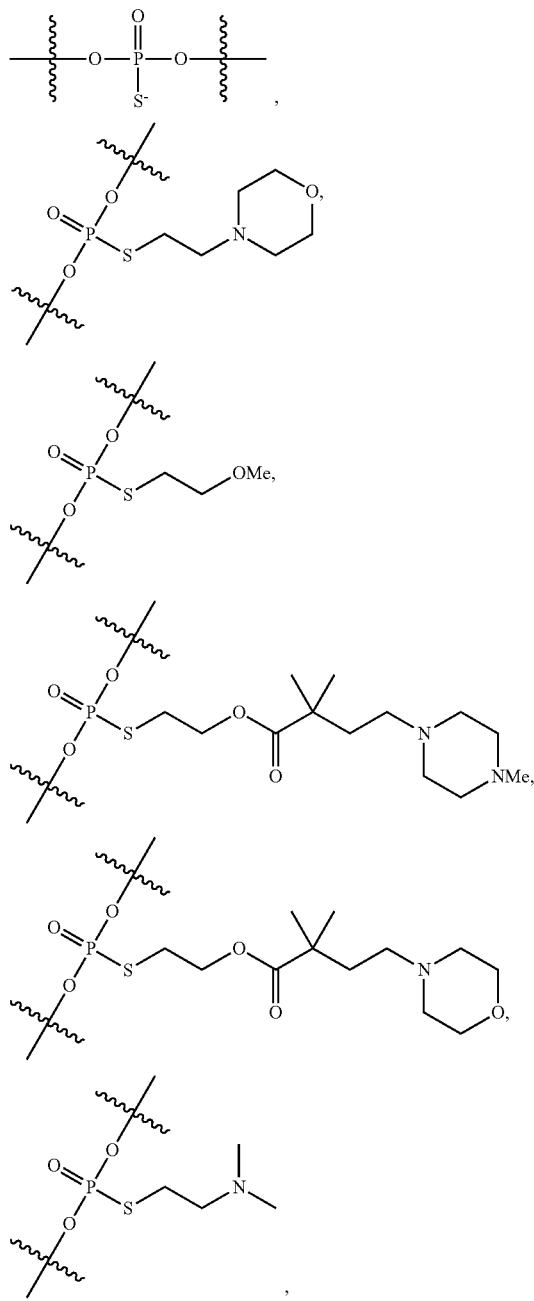

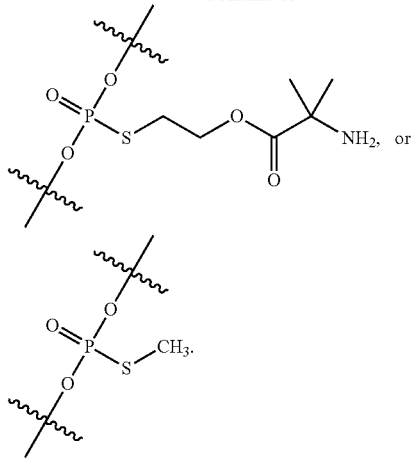

In some embodiments, the internucleotidic linkage of Formula I has the structure of Formula I-a:

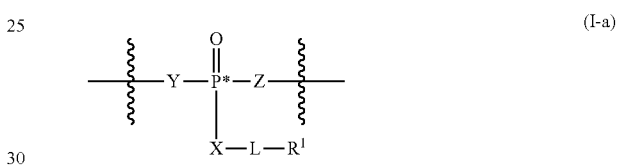
(I-a)

wherein each variable is independently as defined above and described herein, as in Formula I.

In some embodiments, the internucleotidic linkage of Formula I has the structure of Formula I-b:

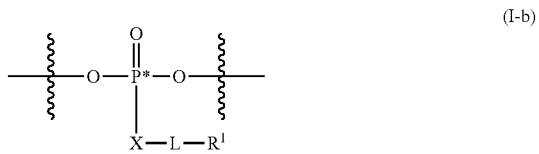
(I-b)

wherein each variable is independently as defined above and described herein, as in Formula I.

In some embodiments, the internucleotidic linkage of Formula I is an phosphorothioate triester linkage having the structure of Formula I-c:

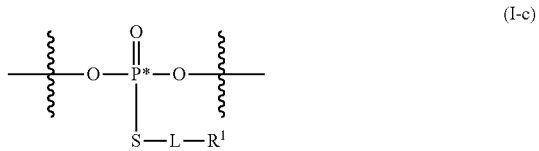
(I-c)

wherein:
P* is an asymmetric phosphorus atom and is either Rp or Sp;
L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

$R^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡—, —C(R')$_2$, -Cy-, —O—, —S—, —S—S—, N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;

each R' is independently —R, —C(O)R, —CO$_2$R, or —SO$_2$R, or:
  two R' on the same nitrogen are taken together with their intervening atoms to form an optionally substituted heterocyclic or heteroaryl ring, or
  two R' on the same carbon are taken together with their intervening atoms to form an optionally substituted aryl, carbocyclic, heterocyclic, or heteroaryl ring;

-Cy- is an optionally substituted bivalent ring selected from phenylene, carbocyclylene, arylene, heteroarylene, and heterocyclylene;

each R is independently hydrogen, or an optionally substituted group selected from $C_1$-$C_6$ aliphatic, phenyl, carbocyclyl, aryl, heteroaryl, and heterocyclyl;

each

independently represents a connection to a nucleoside; and $R^1$ is not —H when L is a covalent bond.

In some embodiments, the internucleotidic linkage having the structure of Formula I is

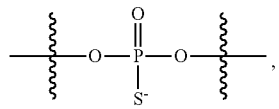

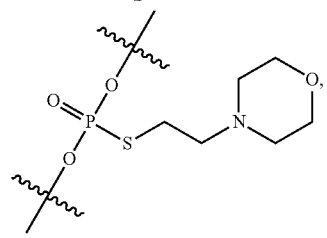

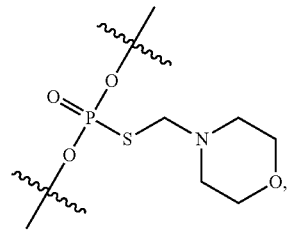

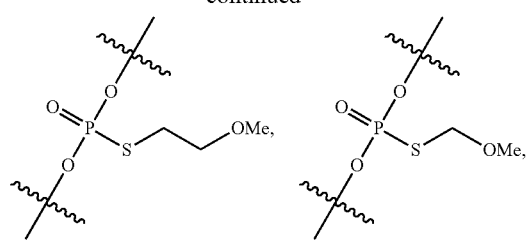

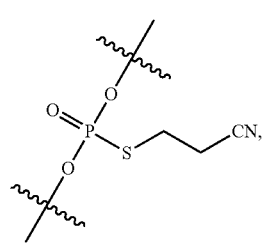

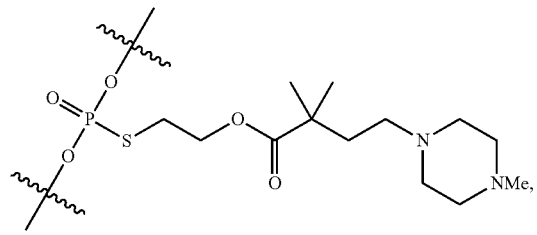

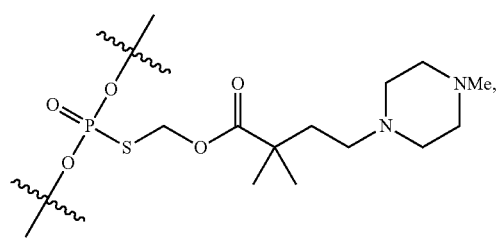

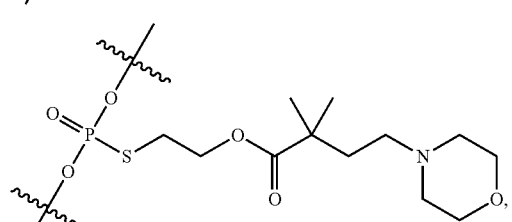

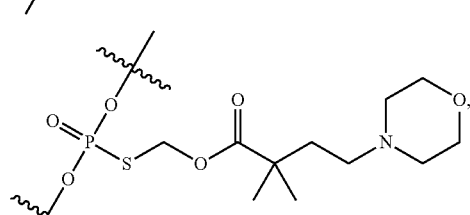

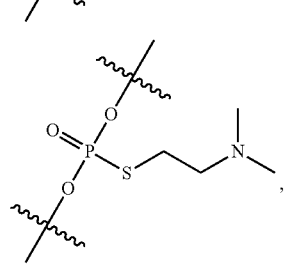

227
-continued
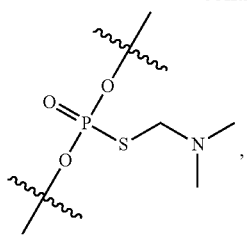
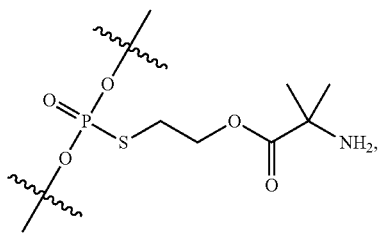
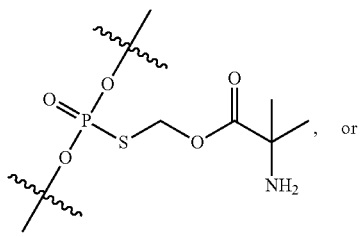, or
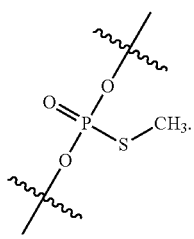
In some embodiments, the internucleotidic linkage having the structure of Formula I-c
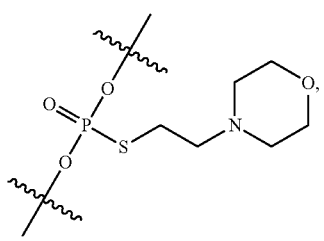
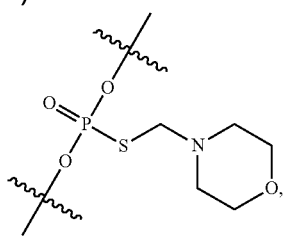
228
-continued
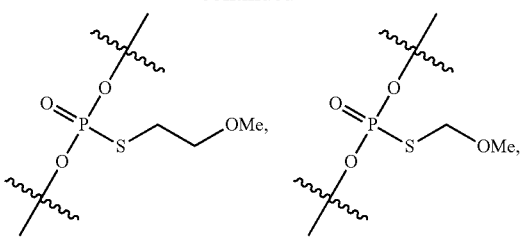
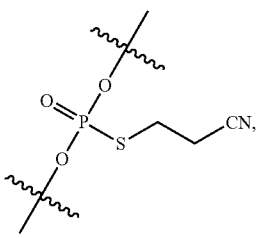
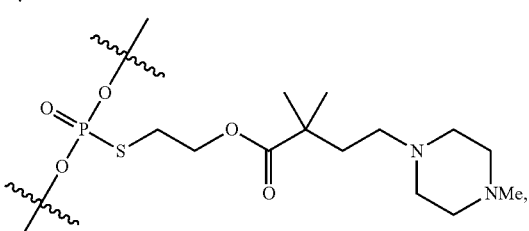
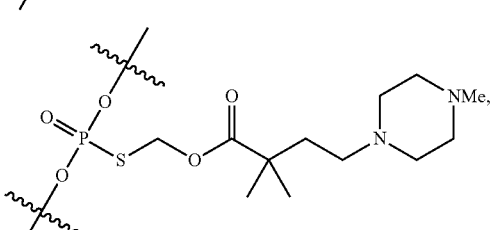
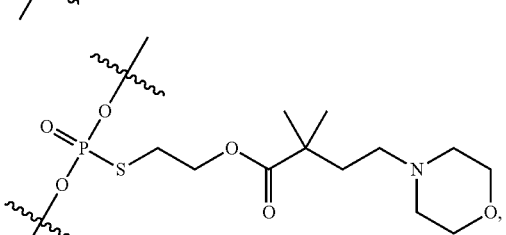
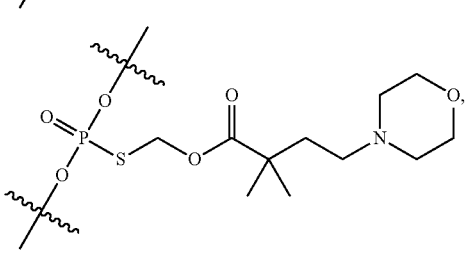
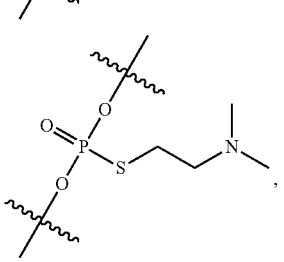

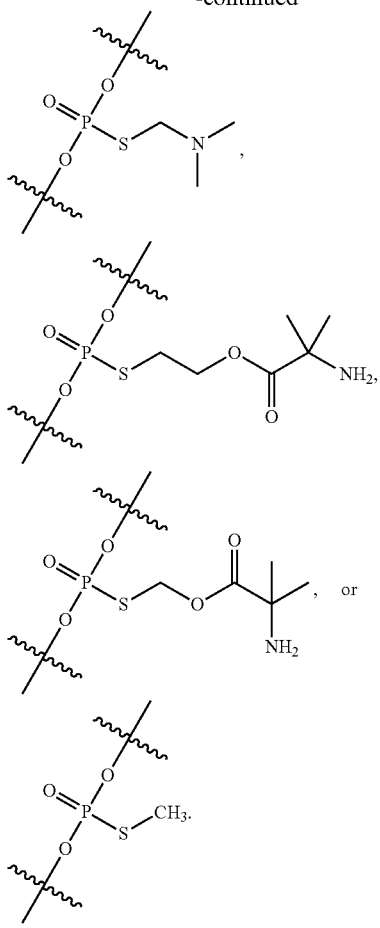

In some embodiments, the present disclosure provides a chirally controlled oligonucleotide comprising one or more phosphate diester linkages, and one or more modified internucleotide linkages having the formula of I-a, I-b, or I-c.

In some embodiments, a modified internucleotidic linkage has the structure of I. In some embodiments, a modified internucleotidic linkage has the structure of I-a. In some embodiments, a modified internucleotidic linkage has the structure of I-b. In some embodiments, a modified internucleotidic linkage has the structure of I-c.

In some embodiments, a modified internucleotidic linkage is phosphorothioate. Examples of internucleotidic linkages having the structure of Formula I are widely known in the art. In some embodiments, a modified internucleotidic linkage is selected from those described in, for example: US 20110294124, US 20120316224, US 20140194610, US 20150211006, US 20150197540, WO 2015107425, PCT/US2016/043542, and PCT/US2016/043598, each of which is incorporated herein by reference. In some embodiments, a modified internucleotidic linkage is a vinylphosphonate. Whittaker et al. 2008 Tetrahedron Letters 49: 6984-6987.

Non-limiting examples of internucleotidic linkages also include those described in the art, including, but not limited to, those described in any of: Gryaznov, S.; Chen, J.-K. J. Am. Chem. Soc. 1994, 116, 3143, Jones et al. J. Org. Chem. 1993, 58, 2983, Koshkin et al. 1998 Tetrahedron 54: 3607-3630, Lauritsen et al. 2002 Chem. Comm. 5: 530-531, Lauritsen et al. 2003 Bioo. Med. Chem. Lett. 13: 253-256, Mesmaeker et al. Angew. Chem., Int. Ed. Engl. 1994, 33, 226, Petersen et al. 2003 TRENDS Biotech. 21: 74-81, Schultz et al. 1996 Nucleic Acids Res. 24: 2966, Ts'o et al. Ann. N. Y. Acad. Sci. 1988, 507, 220, and Vasseur et al. J. Am. Chem. Soc. 1992, 114, 4006.

Oligonucleotides of the provided technologies can be of various lengths. In some embodiments, provided oligonucleotides comprise 5, 6, 7, 8, 9, 10, 11, 12, 13, 14, 15, 16, 17, 18, 19, 20, 21, 22, 23, 24, 25, 26, 27, 28, 29, 30, 40, 50 or more bases. In some embodiments, provided oligonucleotides comprise 10, 11, 12, 13, 14, 15, 16, 17, 18, 19, 20, 21, 22, 23, 24, 25, 26, 27, 28, 29, 30, 40, 50 or more bases. In some embodiments, provided oligonucleotides comprise 15, 16, 17, 18, 19, 20, 21, 22, 23, 24, 25, 26, 27, 28, 29, 30, 40, 50 or more bases. In some embodiments, provided oligonucleotides comprise 15 or more bases. In some embodiments, provided oligonucleotides comprise 16 or more bases. In some embodiments, provided oligonucleotides comprise 17 or more bases. In some embodiments, provided oligonucleotides comprise 18 or more bases. In some embodiments, provided oligonucleotides comprise 19 or more bases. In some embodiments, provided oligonucleotides comprise 20 or more bases. In some embodiments, provided oligonucleotides comprise 21 or more bases. In some embodiments, provided oligonucleotides comprise 22 or more bases. In some embodiments, provided oligonucleotides comprise 23 or more bases. In some embodiments, provided oligonucleotides comprise 24 or more bases. In some embodiments, provided oligonucleotides comprise 25 or more bases. In some embodiments, provided oligonucleotides comprise 26 or more bases. In some embodiments, provided oligonucleotides comprise 27 or more bases. In some embodiments, provided oligonucleotides comprise 28 or more bases. In some embodiments, provided oligonucleotides comprise 29 or more bases. In some embodiments, provided oligonucleotides comprise 30 or more bases. In some embodiments, provided oligonucleotides comprise 40 or more bases. In some embodiments, provided oligonucleotides comprise 50 or more bases. In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are 15mers. In some embodiments, provided oligonucleotides are 16mers. In some embodiments, provided oligonucleotides are 17mers. In some embodiments, provided oligonucleotides are 18mers. In some embodiments, provided oligonucleotides are 19mers. In some embodiments, provided oligonucleotides are 20mers. In some embodiments, provided oligonucleotides are 21 mers. In some embodiments, provided oligonucleotides are 22mers. In some embodiments, provided oligonucleotides are 23mers. In some embodiments, provided oligonucleotides are 24mers. In some embodiments, provided oligonucleotides are 25mers. In some embodiments, provided oligonucleotides are 26mers. In some embodiments, provided oligonucleotides are 27mers.

In some embodiments, provided oligonucleotides are 28mers. In some embodiments, provided oligonucleotides are 29mers. In some embodiments, provided oligonucleotides are 30mers.

In some embodiments, the present disclosure provides a chirally controlled oligonucleotide comprising at least one phosphate diester internucleotidic linkage and at least one phosphorothioate triester linkage having the structure of Formula I-c. In some embodiments, the present disclosure provides a chirally controlled oligonucleotide comprising at least one phosphate diester internucleotidic linkage and at least two phosphorothioate triester linkages having the structure of Formula I-c. In some embodiments, the present disclosure provides a chirally controlled oligonucleotide comprising at least one phosphate diester internucleotidic linkage and at least three phosphorothioate triester linkages having the structure of Formula I-c. In some embodiments, the present disclosure provides a chirally controlled oligonucleotide comprising at least one phosphate diester internucleotidic linkage and at least four phosphorothioate triester linkages having the structure of Formula I-c. In some embodiments, the present disclosure provides a chirally controlled oligonucleotide comprising at least one phosphate diester internucleotidic linkage and at least five phosphorothioate triester linkages having the structure of Formula I-c.

In some embodiments, the present disclosure provides a chirally controlled oligonucleotide comprising a sequence found in any oligonucleotide disclosed herein. In some embodiments, the present disclosure provides a chirally controlled oligonucleotide comprising a sequence found in any oligonucleotide disclosed herein, wherein one or more U is replaced with T. In some embodiments, the present disclosure provides a chirally controlled oligonucleotide comprising a sequence found in any oligonucleotide disclosed herein, wherein the said sequence has over 50% identity with the sequence of any oligonucleotide disclosed herein.

In some embodiments, the present disclosure provides a chirally controlled oligonucleotide comprising a sequence found in any oligonucleotide disclosed herein, wherein the said sequence has over 60% identity with the sequence of any oligonucleotide disclosed herein. In some embodiments, the present disclosure provides a chirally controlled oligonucleotide comprising a sequence found in any oligonucleotide disclosed herein, wherein the said sequence has over 70% identity with the sequence of any oligonucleotide disclosed herein. In some embodiments, the present disclosure provides a chirally controlled oligonucleotide comprising a sequence found in any oligonucleotide disclosed herein, wherein the said sequence has over 80% identity with the sequence of any oligonucleotide disclosed herein. In some embodiments, the present disclosure provides a chirally controlled oligonucleotide comprising a sequence found in any oligonucleotide disclosed herein, wherein the said sequence has over 90% identity with the sequence of any oligonucleotide disclosed herein. In some embodiments, the present disclosure provides a chirally controlled oligonucleotide comprising a sequence found in any oligonucleotide disclosed herein, wherein the said sequence has over 95% identity with the sequence of any oligonucleotide disclosed herein.

In some embodiments, the present disclosure provides a chirally controlled oligonucleotide comprising the sequence of any oligonucleotide disclosed herein. In some embodiments, the present disclosure provides a chirally controlled oligonucleotide having the sequence of any oligonucleotide disclosed herein. In some embodiments, the present disclosure provides a chirally controlled oligonucleotide comprising a sequence found in any oligonucleotide disclosed herein, wherein the oligonucleotides have a pattern of backbone linkages, pattern of backbone chiral centers, and/or pattern of backbone phosphorus modifications described herein.

In some embodiments, the present disclosure provides a chirally controlled oligonucleotide comprising a sequence found in any oligonucleotide disclosed herein. In some embodiments, the present disclosure provides a chirally controlled oligonucleotide comprising a sequence found in any oligonucleotide disclosed herein, wherein one or more T is substituted with U. In some embodiments, the present disclosure provides a chirally controlled oligonucleotide comprising a sequence found in any oligonucleotide disclosed herein, wherein the said sequence has over 50% identity with the sequence of any oligonucleotide disclosed herein. In some embodiments, the present disclosure provides a chirally controlled oligonucleotide comprising a sequence found in any oligonucleotide disclosed herein, wherein the said sequence has over 60% identity with the sequence of any oligonucleotide disclosed herein. In some embodiments, the present disclosure provides a chirally controlled oligonucleotide comprising a sequence found in any oligonucleotide disclosed herein, wherein the said sequence has over 70% identity with the sequence of any oligonucleotide disclosed herein. In some embodiments, the present disclosure provides a chirally controlled oligonucleotide comprising a sequence found in any oligonucleotide disclosed herein, wherein the said sequence has over 80% identity with the sequence of any oligonucleotide disclosed herein. In some embodiments, the present disclosure provides a chirally controlled oligonucleotide comprising a sequence found in any oligonucleotide disclosed herein, wherein the said sequence has over 90% identity with the sequence of any oligonucleotide disclosed herein. In some embodiments, the present disclosure provides a chirally controlled oligonucleotide comprising a sequence found in any oligonucleotide disclosed herein, wherein the said sequence has over 95% identity with the sequence of any oligonucleotide disclosed herein. In some embodiments, the present disclosure provides a chirally controlled oligonucleotide comprising the sequence of any oligonucleotide disclosed herein. In some embodiments, the present disclosure provides a chirally controlled oligonucleotide having the sequence of any oligonucleotide disclosed herein.

In some embodiments, the present disclosure provides a chirally controlled oligonucleotide comprising a sequence found in any oligonucleotide disclosed herein, wherein at least one internucleotidic linkage has a chiral linkage phosphorus. In some embodiments, the present disclosure provides a chirally controlled oligonucleotide comprising a sequence found in any oligonucleotide disclosed herein, wherein at least one internucleotidic linkage has the structure of Formula I. In some embodiments, the present disclosure provides a chirally controlled oligonucleotide comprising a sequence found in any oligonucleotide disclosed herein, wherein each internucleotidic linkage has the structure of Formula I. In some embodiments, the present disclosure provides a chirally controlled oligonucleotide comprising a sequence found in any oligonucleotide disclosed herein, wherein at least one internucleotidic linkage has the structure of Formula I-c. In some embodiments, the present disclosure provides a chirally controlled oligonucleotide comprising a sequence found in any oligonucleotide disclosed herein, wherein each internucleotidic linkage has the structure of Formula I-c. In some embodiments, the present disclosure provides a chirally controlled oligonucleotide comprising a sequence found in any oligonucleotide disclosed herein, wherein at least one internucleotidic linkage is

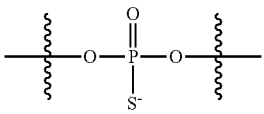

In some embodiments, the present disclosure provides a chirally controlled oligonucleotide comprising a sequence found in any oligonucleotide disclosed herein, wherein each internucleotidic linkage is

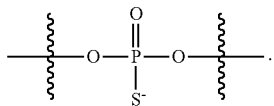

In some embodiments, the present disclosure provides a chirally controlled oligonucleotide comprising a sequence found in any oligonucleotide disclosed herein, wherein at least one internucleotidic linkage is

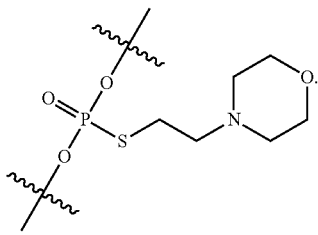

In some embodiments, the present disclosure provides a chirally controlled oligonucleotide comprising a sequence found in any oligonucleotide disclosed herein, wherein each internucleotidic linkage is

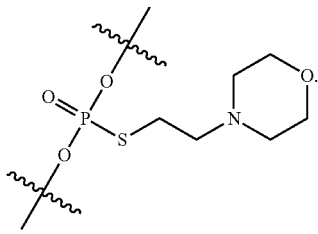

In some embodiments, the present disclosure provides a chirally controlled oligonucleotide comprising the sequence of any oligonucleotide disclosed herein, wherein at least one internucleotidic linkage has a chiral linkage phosphorus. In some embodiments, the present disclosure provides a chirally controlled oligonucleotide comprising the sequence of any oligonucleotide disclosed herein, wherein at least one internucleotidic linkage has the structure of Formula I. In some embodiments, the present disclosure provides a chirally controlled oligonucleotide comprising the sequence of any oligonucleotide disclosed herein, wherein each internucleotidic linkage has the structure of Formula I. In some embodiments, the present disclosure provides a chirally controlled oligonucleotide comprising the sequence of any oligonucleotide disclosed herein, wherein at least one internucleotidic linkage has the structure of Formula I-c. In some embodiments, the present disclosure provides a chirally controlled oligonucleotide comprising the sequence of any oligonucleotide disclosed herein, wherein each internucleotidic linkage has the structure of Formula I-c.

In some embodiments, the present disclosure provides a chirally controlled oligonucleotide comprising the sequence of any oligonucleotide disclosed herein, wherein at least one internucleotidic linkage is

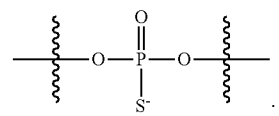

In some embodiments, the present disclosure provides a chirally controlled oligonucleotide comprising the sequence of any oligonucleotide disclosed herein, wherein each internucleotidic linkage is

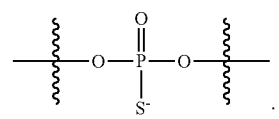

In some embodiments, the present disclosure provides a chirally controlled oligonucleotide comprising the sequence of any oligonucleotide disclosed herein, wherein at least one internucleotidic linkage is

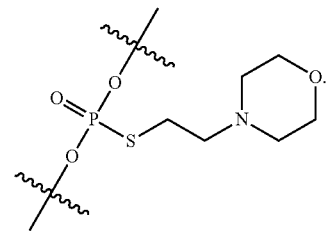

In some embodiments, the present disclosure provides a chirally controlled oligonucleotide comprising the sequence of any oligonucleotide disclosed herein, wherein each internucleotidic linkage is

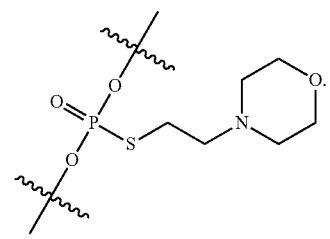

In some embodiments, the present disclosure provides a chirally controlled oligonucleotide having the sequence of any oligonucleotide disclosed herein, wherein at least one internucleotidic linkage has a chiral linkage phosphorus. In some embodiments, the present disclosure provides a chirally controlled oligonucleotide having the sequence of any oligonucleotide disclosed herein, wherein at least one internucleotidic linkage has the structure of Formula I. In some embodiments, the present disclosure provides a chirally controlled oligonucleotide having the sequence of any oligonucleotide disclosed herein, wherein each internucleotidic linkage has the structure of Formula I. In some embodiments, the present disclosure provides a chirally controlled oligonucleotide having the sequence of any oligonucleotide disclosed herein, wherein at least one internucleotidic linkage has the structure of Formula I-c. In some embodiments, the present disclosure provides a chirally controlled oligonucleotide having the sequence of any oligonucleotide disclosed herein, wherein each internucleotidic linkage has the structure of Formula I-c.

In some embodiments, the present disclosure provides a chirally controlled oligonucleotide having the sequence of any oligonucleotide disclosed herein, wherein at least one internucleotidic linkage is

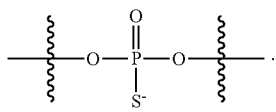

In some embodiments, the present disclosure provides a chirally controlled oligonucleotide having the sequence of any oligonucleotide disclosed herein, wherein each internucleotidic linkage is

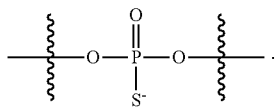

In some embodiments, the present disclosure provides a chirally controlled oligonucleotide having the sequence of any oligonucleotide disclosed herein, wherein at least one internucleotidic linkage is

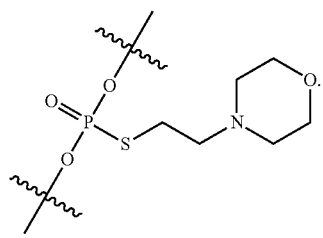

In some embodiments, the present disclosure provides a chirally controlled oligonucleotide having the sequence of any oligonucleotide disclosed herein, wherein each internucleotidic linkage is

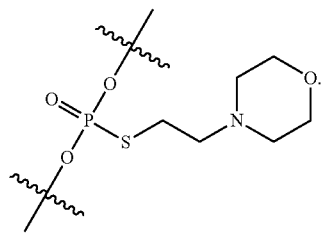

In some embodiments, the present disclosure provides a chirally controlled oligonucleotide having the sequence of any oligonucleotide disclosed herein, wherein at least one linkage phosphorus is Rp. It is understood by a person of ordinary skill in the art that in certain embodiments wherein the chirally controlled oligonucleotide comprises an RNA sequence, each T is independently and optionally replaced with U. In some embodiments, the present disclosure provides a chirally controlled oligonucleotide having the sequence of any oligonucleotide disclosed herein, wherein each linkage phosphorus is Rp. In some embodiments, the present disclosure provides a chirally controlled oligonucleotide having the sequence of any oligonucleotide disclosed herein, wherein at least one linkage phosphorus is Sp. In some embodiments, the present disclosure provides a chirally controlled oligonucleotide having the sequence of any oligonucleotide disclosed herein, wherein each linkage phosphorus is Sp. In some embodiments, the present disclosure provides a chirally controlled oligonucleotide having the sequence of any oligonucleotide disclosed herein, wherein the oligonucleotide is a blockmer. In some embodiments, the present disclosure provides a chirally controlled oligonucleotide having the sequence of any oligonucleotide disclosed herein, wherein the oligonucleotide is a stereoblockmer. In some embodiments, the present disclosure provides a chirally controlled oligonucleotide having the sequence of any oligonucleotide disclosed herein, wherein the oligonucleotide is a P-modification blockmer. In some embodiments, the present disclosure provides a chirally controlled oligonucleotide having the sequence of any oligonucleotide disclosed herein, wherein the oligonucleotide is a linkage blockmer. In some embodiments, the present disclosure provides a chirally controlled oligonucleotide having the sequence of any oligonucleotide disclosed herein, wherein the oligonucleotide is an altmer. In some embodiments, the present disclosure provides a chirally controlled oligonucleotide having the sequence of any oligonucleotide disclosed herein, wherein the oligonucleotide is a stereoaltmer. In some embodiments, the present disclosure provides a chirally controlled oligonucleotide having the sequence of any oligonucleotide disclosed herein, wherein the oligonucleotide is a P-modification altmer. In some embodiments, the present disclosure provides a chirally controlled oligonucleotide having the sequence of any oligonucleotide disclosed herein, wherein the oligonucleotide is a linkage altmer. In some embodiments, the present disclosure provides a chirally controlled oligonucleotide having the sequence of any oligonucleotide disclosed herein, wherein the oligonucleotide is a unimer. In some embodiments, the present disclosure provides a chirally controlled oligonucleotide having the sequence of any oligonucleotide disclosed herein, wherein the oligonucleotide is a stereounimer. In some embodiments, the present disclosure provides a chirally controlled oligonucleotide having the sequence of any oligonucleotide disclosed herein, wherein the oligonucleotide is a P-modification unimer. In some embodiments, the present disclosure provides a chirally controlled oligonucleotide having the sequence of any oligonucleotide disclosed herein, wherein the oligonucleotide is a linkage unimer. In some embodiments, the present disclosure provides a chirally controlled oligonucleotide having the sequence of any oligonucleotide disclosed herein, wherein the oligonucleotide is a gapmer. In some embodiments, the present disclosure provides a chirally controlled oligonucleotide having the sequence of any oligonucleotide disclosed herein, wherein the oligonucleotide is a skipmer.

In some embodiments, the present disclosure provides a chirally controlled oligonucleotide having the sequence of any oligonucleotide disclosed herein, wherein each cytosine is optionally and independently replaced by 5-methylcytosine. In some embodiments, the present disclosure provides a chirally controlled oligonucleotide having the sequence of any oligonucleotide disclosed herein, wherein at least one cytosine is optionally and independently replaced by 5-methylcytosine. In some embodiments, the present disclosure provides a chirally controlled oligonucleotide having the sequence of any oligonucleotide disclosed herein, wherein each cytosine is optionally and independently replaced by 5-methylcytosine.

In some embodiments, a chirally controlled oligonucleotide is designed such that one or more nucleotides comprise a phosphorus modification prone to "autorelease" under certain conditions. That is, under certain conditions, a particular phosphorus modification is designed such that it self-cleaves from the oligonucleotide to provide, e.g., a phosphate diester such as those found in naturally occurring DNA and RNA. In some embodiments, such a phosphorus modification has a structure of wherein each of L and $R^1$ is independently as defined above and described herein. In some embodiments, an autorelease group comprises a morpholino group. In some embodiments, an autorelease group is characterized by the ability to deliver an agent to the internucleotidic phosphorus linker, which agent facilitates further modification of the phosphorus atom such as, e.g., desulfurization. In some embodiments, the agent is water and the further modification is hydrolysis to form a phosphate diester as is found in naturally occurring DNA and RNA.

In some embodiments, a chirally controlled oligonucleotide is designed such that the resulting pharmaceutical properties are improved through one or more particular modifications at phosphorus. It is well documented in the art that certain oligonucleotides are rapidly degraded by nucleases and exhibit poor cellular uptake through the cytoplasmic cell membrane (Poijarvi-Virta et al., Curr. Med. Chem. (2006), 13(28); 3441-65; Wagner et al., Med. Res. Rev. (2000), 20(6):417-51; Peyrottes et al., Mini Rev. Med. Chem. (2004), 4(4):395-408; Gosselin et al., (1996), 43(1): 196-208; Bologna et al., (2002), Antisense & Nucleic Acid Drug Development 12:33-41). For instance, Vives et al., (Nucleic Acids Research (1999), 27(20):4071-76) found that tert-butyl SATE pro-oligonucleotides displayed markedly increased cellular penetration compared to the parent oligonucleotide.

In some embodiments, a modification at a linkage phosphorus is characterized by its ability to be transformed to a phosphate diester, such as those present in naturally occurring DNA and RNA, by one or more esterases, nucleases, and/or cytochrome P450 enzymes, including but not limited to: CYP1A1, CYP1A2, CYP1B1 (Family: CYP1); CYP2A6, CYP2A7, CYP2A13, CYP2B6, CYP2C8, CYP2C9, CYP2C18, CYP2C19, CYP2D6, CYP2E1, CYP2F1, CYP2J2, CYP2R1, CYP2S1, CYP2U1, CYP2W1 (CYP2); CYP3A4, CYP3A5, CYP3A7, CYP3A43 (CYP3); CYP4A11, CYP4A22, CYP4B1, CYP4F2, CYP4F3, CYP4F8, CYP4F11, CYP4F12, CYP4F22, CYP4V2, CYP4X1, CYP4Z1 (CYP4); CYP5A1 (CYP5); CYP7A1, CYP7B1 (CYP7); CYP8A1 (prostacyclin synthase), CYP8B1 (bile acid biosynthesis) (CYP8); CYP11A1, CYP11B1, CYP11B2 (CYP11); CYP17A1 (CYP17); CYP19A1 (CYP19); CYP20A1 (CYP2O); CYP21A2 (CYP21); CYP24A1 (CYP24); CYP26A1, CYP2XXX1, CYP26C1 (CYP26); CYP27A1 (bile acid biosynthesis), CYP27B1 (vitamin D31-alpha hydroxylase, activates vitamin D3), CYP27C1 (unknown function) (CYP27); CYP39A1 (CYP39); CYP46A1 (CYP46); or CYP51A1 (lanosterol 14-alpha demethylase) (CYP51).

In some embodiments, a modification at phosphorus results in a P-modification moiety characterized in that it acts as a pro-drug, e.g., the P-modification moiety facilitates delivery of an oligonucleotide to a desired location prior to removal. For instance, in some embodiments, a P-modification moiety results from PEGylation at the linkage phosphorus. One of skill in the relevant arts will appreciate that various PEG chain lengths are useful and that the selection of chain length will be determined in part by the result that is sought to be achieved by PEGylation. For instance, in some embodiments, PEGylation is effected in order to reduce RES uptake and extend in vivo circulation lifetime of an oligonucleotide.

In some embodiments, a PEGylation reagent for use in accordance with the present disclosure is of a molecular weight of about 300 g/mol to about 100,000 g/mol. In some embodiments, a PEGylation reagent is of a molecular weight of about 300 g/mol to about 10,000 g/mol. In some embodiments, a PEGylation reagent is of a molecular weight of about 300 g/mol to about 5,000 g/mol. In some embodiments, a PEGylation reagent is of a molecular weight of about 500 g/mol. In some embodiments, a PEGylation reagent of a molecular weight of about 1000 g/mol. In some embodiments, a PEGylation reagent is of a molecular weight of about 3000 g/mol. In some embodiments, a PEGylation reagent is of a molecular weight of about 5000 g/mol.

In certain embodiments, a PEGylation reagent is PEG500. In certain embodiments, a PEGylation reagent is PEG1000. In certain embodiments, a PEGylation reagent is PEG3000. In certain embodiments, a PEGylation reagent is PEG5000.

In some embodiments, a P-modification moiety is characterized in that it acts as a PK enhancer, e.g., lipids, PEGylated lipids, etc.

In some embodiments, a P-modification moiety is characterized in that it acts as an agent which promotes cell entry and/or endosomal escape, such as a membrane-disruptive lipid or peptide.

In some embodiments, a P-modification moiety is characterized in that it acts as a targeting agent. In some embodiments, a P-modification moiety is or comprises a targeting agent. The phrase "targeting agent," as used herein, is an entity that is associates with a payload of interest (e.g., with an oligonucleotide or oligonucleotide composition) and also interacts with a target site of interest so that the payload of interest is targeted to the target site of interest when associated with the targeting agent to a materially greater extent than is observed under otherwise comparable conditions when the payload of interest is not associated with the targeting agent. A targeting agent may be, or comprise, any of a variety of chemical moieties, including, for example, small molecule moieties, nucleic acids, polypeptides, carbohydrates, etc. Targeting agents are described further by Adarsh et al., "Organelle Specific Targeted Drug Delivery—A Review," International Journal of Research in Pharmaceutical and Biomedical Sciences, 2011, p. 895.

Examples of such targeting agents include, but are not limited to, proteins (e.g. Transferrin), oligopeptides (e.g., cyclic and acylic RGD-containing oligopedptides), antibodies (monoclonal and polyclonal antibodies, e.g. IgG, IgA, IgM, IgD, IgE antibodies), sugars/carbohydrates (e.g., monosaccharides and/or oligosaccharides (mannose, mannose-6-phosphate, galactose, and the like)), vitamins (e.g., folate), or other small biomolecules. In some embodiments, a targeting moiety is a steroid molecule (e.g., bile acids including cholic acid, deoxycholic acid, dehydrocholic acid; cortisone; digoxigenin; testosterone; cholesterol; cationic steroids such as cortisone having a trimethylaminomethyl hydrazide group attached via a double bond at the 3-position of the cortisone ring, etc.). In some embodiments, a targeting moiety is a lipophilic molecule (e.g., alicyclic hydrocarbons, saturated and unsaturated fatty acids, waxes, terpenes, and polyalicyclic hydrocarbons such as adamantine and buckminsterfullerenes). In some embodiments, a lipophilic molecule is a terpenoid such as vitamin A, retinoic acid, retinal, or dehydroretinal. In some embodiments, a targeting moiety is a peptide.

In some embodiments, a P-modification moiety is a targeting agent of formula --X-L-le wherein each of X, L, and $R^1$ are as defined in Formula I, disclosed herein.

In some embodiments, a P-modification moiety is characterized in that it facilitates cell specific delivery.

In some embodiments, a P-modification moiety is characterized in that it falls into one or more of the above-described categories. For instance, in some embodiments, a P-modification moiety acts as a PK enhancer and a targeting ligand. In some embodiments, a P-modification moiety acts as a pro-drug and an endosomal escape agent. One of skill in the relevant arts would recognize that numerous other such combinations are possible and are contemplated by the present disclosure.

In some embodiments, a carbocyclyl, aryl, heteroaryl, or heterocyclyl group, or a bivalent or polyvalent group thereof, is a $C_3$-$C_{30}$ carbocyclyl, aryl, heteroaryl, or heterocyclyl group, or a bivalent and/or polyvalent group thereof.

Bases (Nucleobases)

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides comprise any nucleobase described herein or known in the art.

In some embodiments, a nucleobase present in a provided oligonucleotide is a natural nucleobase or a modified nucleobase derived from a natural nucleobase. Examples include, but are not limited to, uracil, thymine, adenine, cytosine, and guanine having their respective amino groups protected by acyl protecting groups, 2-fluorouracil, 2-fluorocytosine, 5-bromouracil, 5-iodouracil, 2,6-diaminopurine, azacytosine, pyrimidine analogs such as pseudoisocytosine and pseudouracil and other modified nucleobases such as 8-substituted purines, xanthine, or hypoxanthine (the latter two being the natural degradation products). Example modified nucleobases are disclosed in Chiu and Rana, *RNA,* 2003, 9, 1034-1048, Limbach et al. *Nucleic Acids Research,* 1994, 22, 2183-2196 and Revankar and Rao, *Comprehensive Natural Products Chemistry*, vol. 7, 313. In some embodiments, a modified nucleobase is substituted uracil, thymine, adenine, cytosine, or guanine. In some embodiments, a modified nucleobase is a functional replacement, e.g., in terms of hydrogen bonding and/or base pairing, of uracil, thymine, adenine, cytosine, or guanine. In some embodiments, a nucleobase is optionally substituted uracil, thymine, adenine, cytosine, 5-methylcytosine, or guanine. In some embodiments, a nucleobase is uracil, thymine, adenine, cytosine, 5-methylcytosine, or guanine.

In some embodiments, a modified base is optionally substituted adenine, cytosine, guanine, thymine, or uracil. In some embodiments, a modified nucleobase is independently adenine, cytosine, guanine, thymine or uracil, modified by one or more modifications by which:

(1) a nucleobase is modified by one or more optionally substituted groups independently selected from acyl, halogen, amino, azide, alkyl, alkenyl, alkynyl, aryl, heteroalkyl, heteroalkenyl, heteroalkynyl, heterocyclyl, heteroaryl, carboxyl, hydroxyl, biotin, avidin, streptavidin, substituted silyl, and combinations thereof;

(2) one or more atoms of a nucleobase are independently replaced with a different atom selected from carbon, nitrogen and sulfur;

(3) one or more double bonds in a nucleobase are independently hydrogenated; or (4) one or more aryl or heteroaryl rings are independently inserted into a nucleobase.

Compounds represented by the following general formulae are also contemplated as modified nucleobases:

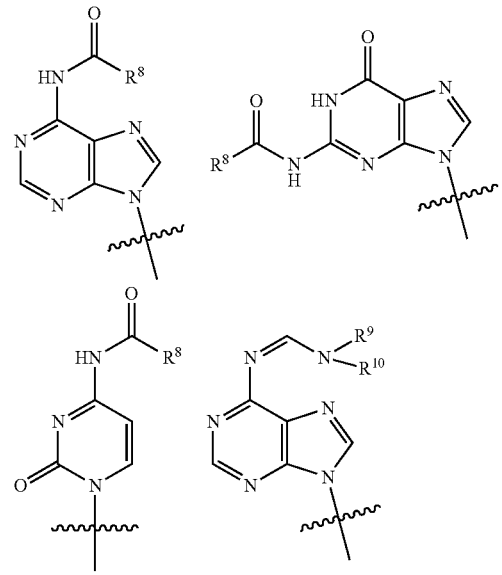

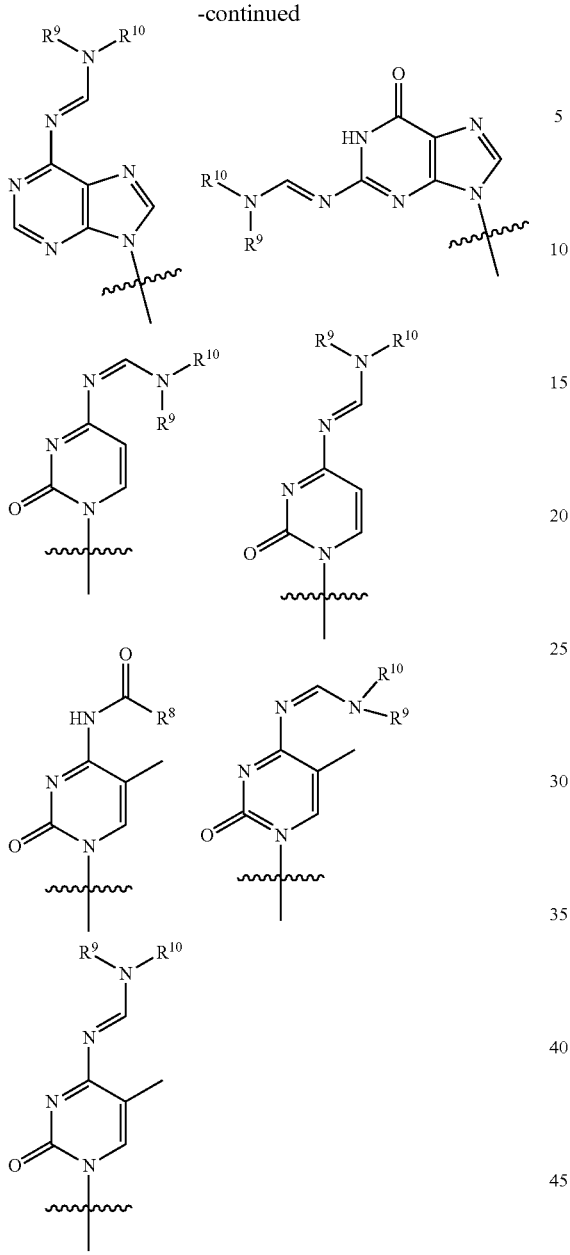

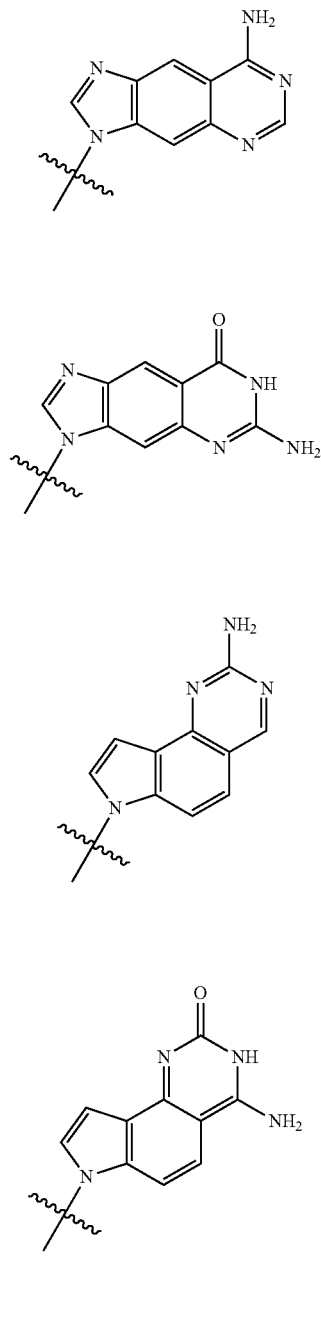

wherein $R^8$ is an optionally substituted, linear or branched group selected from aliphatic, aryl, aralkyl, aryloxylalkyl, carbocyclyl, heterocyclyl and heteroaryl group having 1 to 15 carbon atoms, including, by way of example only, a methyl, isopropyl, phenyl, benzyl, or phenoxymethyl group; and each of $R^9$ and $R^{10}$ is independently an optionally substituted group selected from linear or branched aliphatic, carbocyclyl, aryl, heterocyclyl and heteroaryl.

Modified nucleobases also include expanded-size nucleobases in which one or more aryl rings, such as phenyl rings, have been added. Nucleic base replacements described in the Glen Research catalog (www.glenresearch.com); Krueger A T et al, *Acc. Chem. Res.*, 2007, 40, 141-150; Kool, E T, *Acc. Chem. Res.*, 2002, 35, 936-943; Benner S. A., et al., *Nat. Rev. Genet.*, 2005, 6, 553-543; Romesberg, F. E., et al., *Curr. Opin. Chem. Biol.*, 2003, 7, 723-733; Hirao, I., *Curr. Opin. Chem. Biol.*, 2006, 10, 622-627, are contemplated as useful for the synthesis of the nucleic acids described herein. Some examples of these expanded-size nucleobases are shown below:

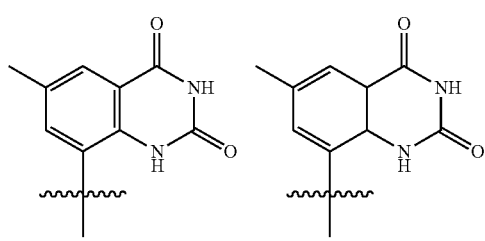

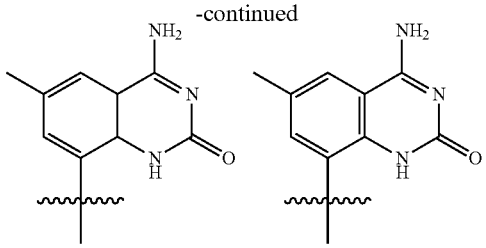

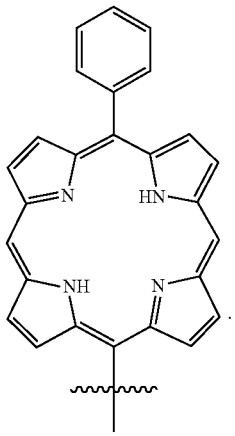 [SMILES: *c1c2nc(cc3ccc([nH]3)c(-c3ccccc3)c3nc(cc4ccc1[nH]4)C=C3)C=C2]

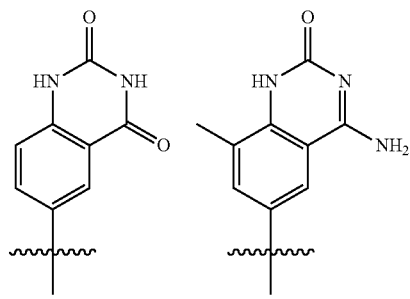

In some embodiments, modified nucleobases are of any one of the following structures, optionally substituted:

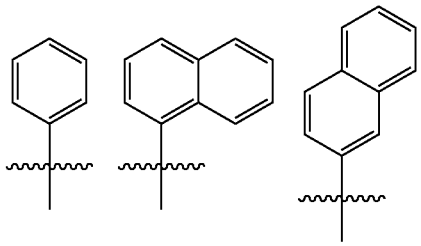

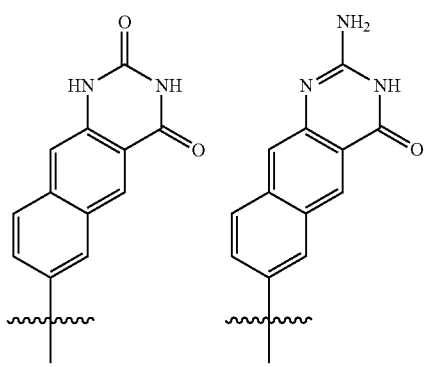

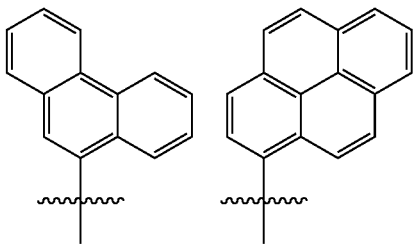

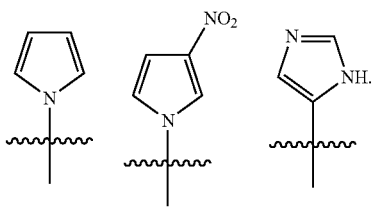

Herein, modified nucleobases also encompass structures that are not considered nucleobases but are other moieties such as, but not limited to, corrin- or porphyrin-derived rings. Porphyrin-derived base replacements have been described in Morales-Rojas, H and Kool, E T, *Org. Lett.*, 2002, 4, 4377-4380. Shown below is an example of a porphyrin-derived ring which can be used as a base replacement:

In some embodiments, a modified nucleobase is fluorescent. Examples of such fluorescent modified nucleobases include phenanthrene, pyrene, stillbene, isoxanthine, isozanthopterin, terphenyl, terthiophene, benzoterthiophene, coumarin, lumazine, tethered stillbene, benzo-uracil, and naphtho-uracil, as shown below:

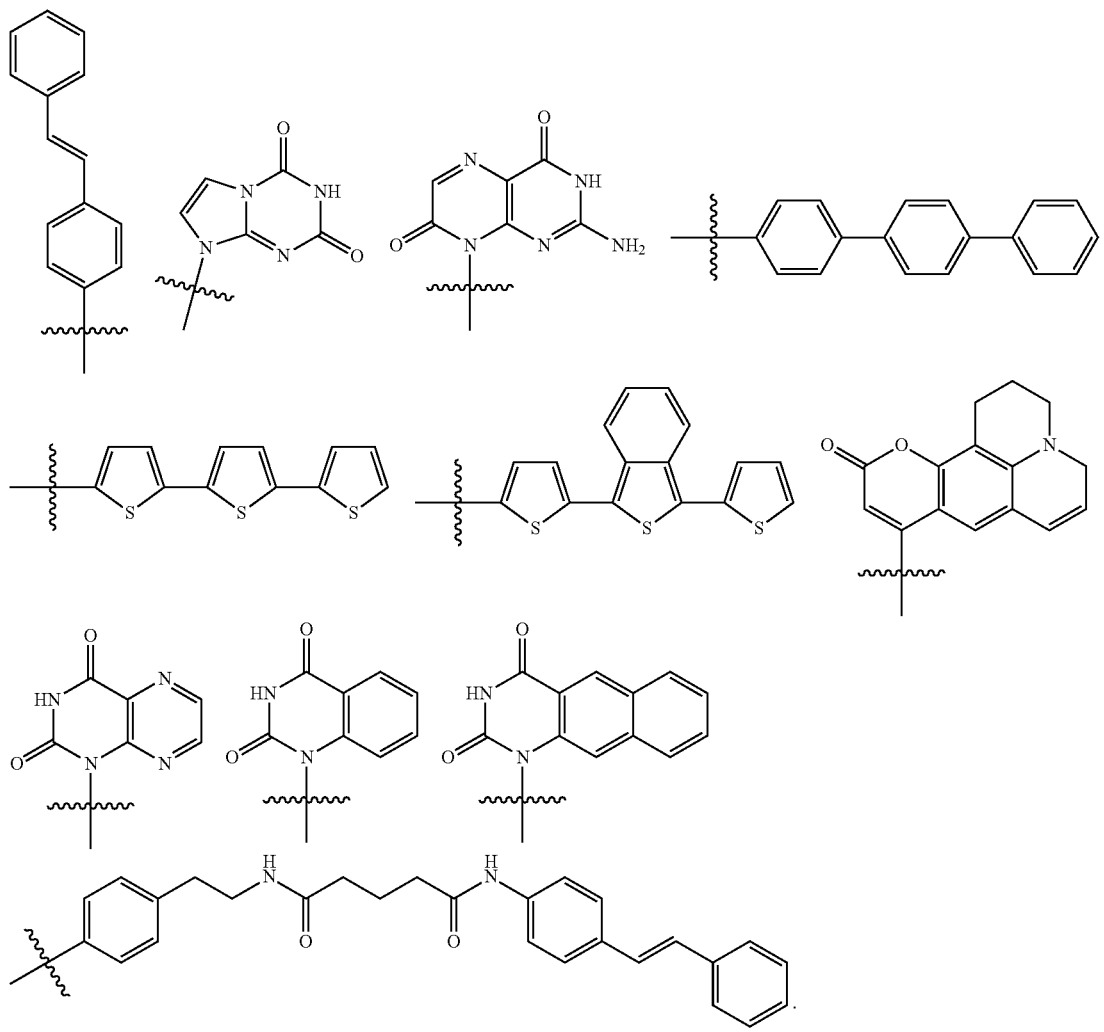

In some embodiments, a nucleobase or modified nucleobase is selected from: C5-propyne T, C5-propyne C, C5-Thiazole, Phenoxazine, 2-Thio-thymine, 5-Triazolylphenyl-thymine, Diaminopurine, and $N^2$-Aminopropylguanine.

In some embodiments, a modified nucleobase is selected from: 5-substituted pyrimidines, 6- azapyrimidines, alkyl or alkynyl substituted pyrimidines, alkyl substituted purines, and N-2, N-6 and 0-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (—C≡C—CH$_3$) uracil, 5-propynylcytosine, 6-azouracil, 6-azocytosine, 6-azothymine, 5-ribosyluracil (pseudouracil), 4- thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2- one (G-clamp). Modified nucleobases may also include those in which the purine or pyrimidine base is replaced with other heterocycles, for example, 7-deaza-adenine, 7-deazaguanosine, 2-aminopyridine and 2-pyridone. Further nucleobases include those disclosed in U.S. Pat. No. 3,687,808, those disclosed in The Concise Encyclopedia Of Polymer Science And Engineering, Kroschwitz, J. I., Ed., John Wiley & Sons, 1990, 858-859; Englisch et al., Angewandte Chemie, International Edition, 1991, 30, 613; Sanghvi, Y. S., Chapter 15, Antisense Research and Applications, Crooke, S. T. and Lebleu, B., Eds., CRC Press, 1993, 273-288; and those disclosed in Chapters 6 and 15, Antisense Drug Technology, Crooke S. T., Ed., CRC Press, 2008, 163-166 and 442-443.

Example United States patents that teach the preparation of certain of the above noted modified nucleobases as well as other modified nucleobases include without limitation, US2003/0158403, U.S. Pat. Nos. 3,687,808; 4,845,205; 5,130,302; 5,134,066; 5,175,273; 5,367,066; 5,432,272; 5,434,257; 5,457,187; 5,459,255; 5,484,908; 5,502,177; 5,525,711; 5,552,540; 5,587,469; 5,594, 121; 5,596,091; 5,614,617; 5,645,985; 5,681,941; 5,750,692; 5,763,588; 5,830,653; and 6,005,096.

In some embodiments, a modified nucleobase is unsubstituted. In some embodiments, a modified nucleobase is substituted. In some embodiments, a modified nucleobase is substituted such that it contains, e.g., heteroatoms, alkyl groups, or linking moieties connected to fluorescent moieties, biotin or avidin moieties, or other protein or peptides. In some embodiments, a modified nucleobase is a "universal base" that is not a nucleobase in the most classical sense, but that functions similarly to a nucleobase. One representative example of such a universal base is 3-nitropyrrole.

In some embodiments, other nucleosides can also be used in the process disclosed herein and include nucleosides that incorporate modified nucleobases, or nucleobases covalently bound to modified sugars. Some examples of nucleosides that incorporate modified nucleobases include 4-acetylcytidine; 5-(carboxyhydroxylmethyl)uridine; 2"-O-methylcytidine; 5-carboxymethylaminomethyl-2-thiouridine; 5-carboxymethylaminomethyluridine; dihydrouridine; 2"-O-methylpseudouridine; beta,D-galactosylqueosine; 2"-O-methylguanosine; $N^6$-isopentenyladenosine; 1-methyladenosine; 1-methylpseudouridine; 1-methylguanosine; 1-methylinosine; 2,2-dimethylguanosine; 2-methyladenosine; 2-methylguanosine; -methylguanosine; 3-methyl-cytidine; 5-methylcytidine; 5-hydroxymethylcytidine; 5-formylcytosine; 5-carboxylcytosine; $N^6$-methyladenosine; 7-methylguanosine; 5-methylaminoethyluridine; 5-methoxyaminomethyl-2-thiouridine; beta,D-mannosylqueosine; 5-methoxycarbonylmethyluridine; 5-methoxyuridine; 2-methylthio-$N^6$-isopentenyladenosine; N-((9-beta,D-ribofuranosyl-2-methylthiopurine-6-yl)carbamoyl)threonine; N-((9-beta,D-ribofuranosylpurine-6-yl))-N-methylcarbamoyl)threonine; uridine-5-oxyacetic acid methyl ester; uridine-5-oxyacetic acid (v); pseudouridine; queosine; 2-thiocytidine; 5-methyl-2-thiouridine; 2-thiouridine; 4-thiouridine; 5-methyluridine; 2"-O-methyl-5-methyluridine; and 2"-O-methyluridine.

In some embodiments, nucleosides include 6-modified bicyclic nucleosides that have either (R) or (S)-chirality at the 6-position and include the analogs described in U.S. Pat. No. 7,399,845. In other embodiments, nucleosides include 5"-modified bicyclic nucleosides that have either (R) or (S)-chirality at the 5-position and include the analogs described in US Patent Application Publication No. 20070287831.

In some embodiments, a nucleobase or modified nucleobase comprises one or more biomolecule binding moieties such as e.g., antibodies, antibody fragments, biotin, avidin, streptavidin, receptor ligands, or chelating moieties. In other embodiments, a nucleobase or modified nucleobase is 5-bromouracil, 5-iodouracil, or 2,6-diaminopurine. In some embodiments, a nucleobase or modified nucleobase is modified by substitution with a fluorescent or biomolecule binding moiety. In some embodiments, the substituent on a nucleobase or modified nucleobase is a fluorescent moiety. In some embodiments, the substituent on a nucleobase or modified nucleobase is biotin or avidin.

Representative U.S. patents that teach the preparation of certain of the above noted modified nucleobases as well as other modified nucleobases include, but are not limited to, the above noted U.S. Pat. No. 3,687,808, as well as U.S. Pat. Nos. 4,845,205; 5,130,30; 5,134,066; 5,175,273; 5,367,066; 5,432,272; 5,457,187; 5,457,191; 5,459,255; 5,484,908; 5,502,177; 5,525,711; 5,552,540; 5,587,469; 5,594,121; 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the modified nucleobases, sugars, and internucleotidic linkages of each of which are incorporated by reference.

In some embodiments, a base is optionally substituted A, T, C, G or U, wherein one or more —$NH_2$ are independently and optionally replaced with —$C(-L-R^1)_3$, one or more —NH— are independently and optionally replaced with —$C(-L-R^1)_2$—, one or more =N— are independently and optionally replaced with —$C(-L-R^1)$—, one or more =CH— are independently and optionally replaced with =N—, and one or more =O are independently and optionally replaced with =S, =$N(-L-R^1)$, or =$C(-L-R^1)_2$, wherein two or more -L-$R^1$ are optionally taken together with their intervening atoms to form a 3-30 membered bicyclic or polycyclic ring having 0-10 heteroatom ring atoms. In some embodiments, a modified base is optionally substituted A, T, C, G or U, wherein one or more —$NH_2$ are independently and optionally replaced with —$C(-L-R^1)_3$, one or more —NH— are independently and optionally replaced with —$C(-L-R^1)_2$—, one or more =N— are independently and optionally replaced with —$C(-L-R^1)$—, one or more =CH— are independently and optionally replaced with =N—, and one or more =O are independently and optionally replaced with =S, =$N(-L-R^1)$, or =$C(-L-R^1)_2$, wherein two or more -L-$R^1$ are optionally taken together with their intervening atoms to form a 3-30 membered bicyclic or polycyclic ring having 0-10 heteroatom ring atoms, wherein the modified base is different than the natural A, T, C, G and U. In some embodiments, a base is optionally substituted A, T, C, G or U. In some embodiments, a modified base is substituted A, T, C, G or U, wherein the modified base is different than the natural A, T, C, G and U.

In some embodiments, a nucleoside is any described in any of: Gryaznov, S; Chen, J.-K. J. Am. Chem. Soc. 1994, 116, 3143; Hendrix et al. 1997 Chem. Eur. J. 3: 110; Hyrup et al. 1996 Bioorg. Med. Chem. 4: 5; Jepsen et al. 2004 Oligo. 14: 130-146; Jones et al. J. Org. Chem. 1993, 58, 2983; Koizumi et al. 2003 Nuc. Acids Res. 12: 3267-3273; Koshkin et al. 1998 Tetrahedron 54: 3607-3630; Kumar et al. 1998 Bioo. Med. Chem. Let. 8: 2219-2222; Lauritsen et al. 2002 Chem. Comm. 5: 530-531; Lauritsen et al. 2003 Bioo. Med. Chem. Lett. 13: 253-256; Mesmaeker et al. Angew. Chem., Int. Ed. Engl. 1994, 33, 226; Morita et al. 2001 Nucl. Acids Res. Supp. 1: 241-242; Morita et al. 2002 Bioo. Med. Chem. Lett. 12: 73-76; Morita et al. 2003 Bioo. Med. Chem. Lett. 2211-2226; Nielsen et al. 1997 Chem. Soc. Rev. 73; Nielsen et al. 1997 J. Chem. Soc. Perkins Transl. 1: 3423-3433; Obika et al. 1997 Tetrahedron Lett. 38 (50): 8735-8; Obika et al. 1998 Tetrahedron Lett. 39: 5401-5404; Pallan et al. 2012 Chem. Comm. 48: 8195-8197; Petersen et al. 2003 TRENDS Biotech. 21: 74-81; Rajwanshi et al. 1999 Chem. Commun. 1395-1396; Schultz et al. 1996 Nucleic Acids Res. 24: 2966; Seth et al. 2009 J. Med. Chem. 52: 10-13; Seth et al. 2010 J. Med. Chem. 53: 8309-8318; Seth et al. 2010 J. Org. Chem. 75: 1569-1581; Seth et al. 2012 Bioo. Med. Chem. Lett. 22: 296-299; Seth et al. 2012 Mol. Ther-Nuc. Acids. 1, e47; Seth, Punit P; Siwkowski, Andrew; Allerson, Charles R; Vasquez, Guillermo; Lee, Sam; Prakash, Thazha P; Kinberger, Garth; Migawa, Michael T; Gaus, Hans; Bhat, Balkrishen; et al. From Nucleic Acids Symposium Series (2008), 52(1), 553-554; Singh et al. 1998 Chem. Comm. 1247-1248; Singh et al. 1998 J. Org. Chem. 63: 10035-39; Singh et al. 1998 J. Org. Chem. 63: 6078-6079; Sorensen 2003 Chem. Comm. 2130-2131; Ts'o et al. Ann. N. Y. Acad. Sci. 1988, 507, 220; Van Aerschot et al. 1995 Angew. Chem. Int. Ed. Engl. 34:

1338; Vasseur et al. J. Am. Chem. Soc. 1992, 114, 4006; WO 20070900071; WO 20070900071; or WO 2016/079181.

Example nucleobases are also described in US 20110294124, US 20120316224, US 20140194610, US 20150211006, US 20150197540, WO 2015107425, PCT/US2016/043542, and PCT/US2016/043598, each of which is incorporated herein by reference. Various additional nucleobases are described in the art and can be utilized in accordance with the present disclosure.

Sugars

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides comprise any sugar described herein or known in the art.

In some embodiments, provided oligonucleotides capable of directing single-stranded RNA interference comprise one or more modified sugar moieties beside the natural sugar moieties.

The most common naturally occurring nucleotides are comprised of ribose sugars linked to the nucleobases adenosine (A), cytosine (C), guanine (G), and thymine (T) or uracil (U). Also contemplated are modified nucleotides wherein a phosphate group or linkage phosphorus in the nucleotides can be linked to various positions of a sugar or modified sugar. As non-limiting examples, the phosphate group or linkage phosphorus can be linked to the 2",3", 4" or 5" hydroxyl moiety of a sugar or modified sugar. Nucleotides that incorporate modified nucleobases as described herein are also contemplated in this context. In some embodiments, nucleotides or modified nucleotides comprising an unprotected —OH moiety are used in accordance with methods of the present disclosure.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any base (nucleobase), modified base or base analog described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any base described herein or known in the art in combination with any other structural element or modification described herein, including but not limited to, base sequence or portion thereof, sugar; internucleotidic linkage; stereochemistry or pattern thereof; additional chemical moiety, including but not limited to, a targeting moiety, lipid moiety, a GalNAc moiety, etc.; 5'-end structure; 5'-end region; 5' nucleotide moiety; seed region; post-seed region; 3'-end region; 3'-terminal dinucleotide; 3'-end cap; GC content; long GC stretch; pattern of modifications of sugars, bases or internucleotidic linkages; format or any structural element thereof, and/or any other structural element or modification described herein; and in some embodiments, the present disclosure pertains to multimers of any such oligonucleotides.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any sugar.

In some embodiments, a sugar has a structure of:

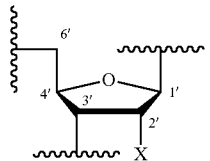

X = H, OH, F, OMe or MOE

Modified sugars can be incorporated into a provided oligonucleotide. In some embodiments, a modified sugar contains one or more substituents at the 2" position including one of the following: —F; —$CF_3$, —CN, —N3, —NO, —$NO_2$, —OR', —SR', or —N(R')$_2$, wherein each R' is independently as defined above and described herein; —O—($C_1$-$C_{10}$ alkyl), —S—($C_1$-$C_{10}$ alkyl), —NH—($C_1$-$C_{10}$ alkyl), or —N($C_1$-$C_{10}$ alkyl)$_2$; —O—($C_2$-$C_{10}$ alkenyl), —S—($C_2$-$C_{10}$ alkenyl), —NH—($C_2$-$C_{10}$ alkenyl), or —N($C_2$-$C_{10}$ alkenyl)$_2$; —O—($C_2$-$C_{10}$ alkynyl), —S—($C_2$-$C_{10}$ alkynyl), —NH—($C_2$-$C_{10}$ alkynyl), or —N($C_2$-$C_{10}$ alkynyl)$_2$; or —O—($C_1$-$C_{10}$ alkylene)-O—($C_1$-$C_{10}$ alkyl), —O—($C_1$-$C_{10}$ alkylene)-NH—($C_1$-$C_{10}$ alkyl) or —O—($C_1$-$C_{10}$ alkylene)-NH($C_1$-$C_{10}$ alkyl)$_2$, —NH—($C_1$-$C_{10}$ alkylene)-O—($C_1$-$C_{10}$ alkyl), or —N($C_1$-$C_{10}$ alkyl)-($C_1$-$C_{10}$ alkylene)-O—($C_1$-$C_{10}$ alkyl), wherein the alkyl, alkylene, alkenyl and alkynyl may be substituted or unsubstituted. Examples of substituents include, and are not limited to, —O($CH_2$)$_n$O$CH_3$, and —O($CH_2$)$_n$$NH_2$, wherein n is from 1 to about 10, MOE, DMAOE, DMAEOE. Also contemplated herein are modified sugars described in WO 2001/088198; and Martin et al., *Helv. Chim. Acta,* 1995, 78, 486-504. In some embodiments, a modified sugar comprises one or more groups selected from a substituted silyl group, an RNA cleaving group, a reporter group, a fluorescent label, an intercalator, a group for improving the pharmacokinetic properties of a nucleic acid, a group for improving the pharmacodynamic properties of a nucleic acid, or other substituents having similar properties. In some embodiments, modifications are made at one or more of the the 2', 3', 4', 5', or 6' positions of the sugar or modified sugar, including the 3' position of the sugar on the 3'-terminal nucleotide or in the 5' position of the 5'-terminal nucleotide.

In some embodiments, a 2'-modification is 2'-F.

In some embodiments, the 2'-OH of a ribose is replaced with a substituent including one of the following: —H, —F; —$CF_3$, —CN, —$N_3$, —NO, —$NO_2$, —OR', —SR', or —N(R')$_2$, wherein each R' is independently as defined above and described herein; —O—($C_1$-$C_{10}$ alkyl), —S—($C_1$-$C_{10}$ alkyl), —NH—($C_1$-$C_{10}$ alkyl), or —N($C_1$-$C_{10}$ alkyl)$_2$; —O—($C_2$-$C_{10}$ alkenyl), —S—($C_2$-$C_{10}$ alkenyl), —NH—

($C_2$-$C_{10}$ alkenyl), or —N($C_2$-$C_{10}$ alkenyl)$_2$; —O—($C_2$-$C_{10}$ alkynyl), —S—($C_2$-$C_{10}$ alkynyl), —NH—($C_2$-$C_{10}$ alkynyl), or —N($C_2$-$C_{10}$ alkynyl)$_2$; or —O—($C_1$-$C_{10}$ alkylene)-O—($C_1$-$C_{10}$ alkyl), —O—($C_1$-$C_{10}$ alkylene)-NH—($C_1$-$C_{10}$ alkyl) or —O—($C_1$-$C_{10}$ alkylene)-NH($C_1$-$C_{10}$ alkyl)$_2$, —NH—($C_1$-$C_{10}$ alkylene)-O—($C_1$-$C_{10}$ alkyl), or —N($C_1$-$C_{10}$ alkyl)-($C_1$-$C_{10}$ alkylene)-O—($C_1$-$C_{10}$ alkyl), wherein the alkyl, alkylene, alkenyl and alkynyl may be substituted or unsubstituted. In some embodiments, the 2'—OH is replaced with —H (deoxyribose). In some embodiments, the 2'—OH is replaced with —F. In some embodiments, the 2'—OH is replaced with —OR'. In some embodiments, the 2'—OH is replaced with —OMe. In some embodiments, the 2'—OH is replaced with —OCH$_2$CH$_2$OMe.

Modified sugars also include locked nucleic acids (LNAs). In some embodiments, two substituents on sugar carbon atoms are taken together to form a bivalent moiety. In some embodiments, two substituents are on two different sugar carbon atoms. In some embodiments, a formed bivalent moiety has the structure of -L- as defined herein. In some embodiments, -L- is —O—CH$_2$—, wherein —CH$_2$— is optionally substituted. In some embodiments, -L- is —O—CH$_2$—. In some embodiments, -L- is —O—CH(Et)-. In some embodiments, -L- is between C2 and C4 of a sugar moiety. In some embodiments, a locked nucleic acid has the structure indicated below. A locked nucleic acid of the structure below is indicated, wherein Ba represents a nucleobase or modified nucleobase as described herein, and wherein $R^{2s}$ is —OCH$_2$C4'—. In some embodiments, a modified nucleoside has a structure of:

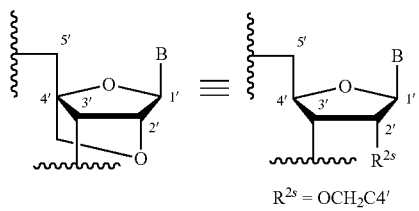

$R^{2s}$ = OCH$_2$C4'

Wherein B is a base.

In some embodiments, a modified sugar is an ENA such as those described in, e.g., Seth et al., J Am Chem Soc. 2010 Oct. 27; 132(42): 14942-14950. In some embodiments, a modified sugar is any of those found in an XNA (xenonucleic acid), for instance, arabinose, anhydrohexitol, threose, 2'fluoroarabinose, or cyclohexene.

Modified sugars include cyclobutyl or cyclopentyl moieties in place of the pentofuranosyl sugar. Representative United States patents that teach the preparation of such modified sugar structures include, but are not limited to, U.S. Pat. Nos. 4,981,957; 5,118,800; 5,319,080; and 5,359,044. Some modified sugars that are contemplated include sugars in which the oxygen atom within the ribose ring is replaced by nitrogen, sulfur, selenium, or carbon. In some embodiments, a modified sugar is a modified ribose wherein the oxygen atom within the ribose ring is replaced with nitrogen, and wherein the nitrogen is optionally substituted with an alkyl group (e.g., methyl, ethyl, isopropyl, etc).

Non-limiting examples of modified sugars include glycerol, which form glycerol nucleic acid (GNA). One example of a GNA is shown below and is described in Zhang, R et al., J. Am. Chem. Soc., 2008, 130, 5846-5847; Zhang L, et al., J. Am. Chem. Soc., 2005, 127, 4174-4175 and Tsai C H et al., PNAS, 2007, 14598-14603. In some embodiments, a nucleoside has a structure of:

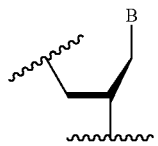

Wherein B is a base.

A flexible nucleic acid (FNA) based on the mixed acetal aminal of formyl glycerol, is described in Joyce G F et al., PNAS, 1987, 84, 4398-4402 and Heuberger B D and Switzer C, J. Am. Chem. Soc., 2008, 130, 412-413. In some embodiments, a nucleoside has a structure of:

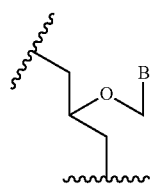

Wherein B is a base.

Additional non-limiting examples of modified sugars and/or modified nucleosides and/or modified nucleotides include hexopyranosyl (6' to 4'), pentopyranosyl (4' to 2'), pentopyranosyl (4' to 3'), 5'-deoxy-5'-C-malonyl, squaryldiamide, and tetrofuranosyl (3' to 2') sugars. In some embodiments, a modified nucleoside comprises a hexopyranosyl (6' to 4') sugar and has the structure of any one in the following formulae:

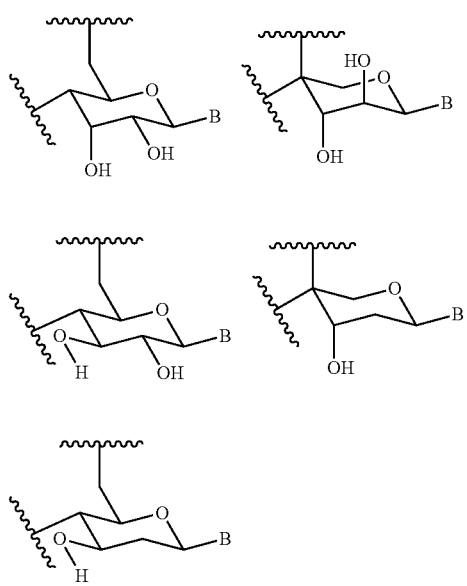

wherein $X^s$ corresponds to the P-modification group "—XLR$^1$" described herein wherein XLR$^1$ is equivalent to X-L-R$^1$ and X, L, and R$^1$ are as defined in Formula I, disclosed herein, and B is a base.

In some embodiments, a modified nucleotide comprises a pentopyranosyl (4' to 2') sugar and has a structure of any one in the following formulae:

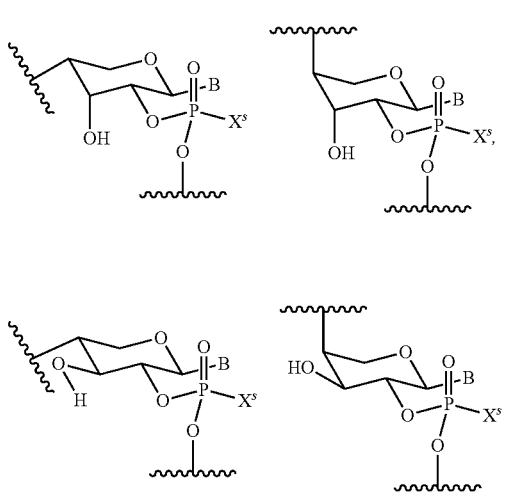

wherein $X^s$ corresponds to the P-modification group "—$XLR^1$" described herein, wherein $XLR^1$ is equivalent to X-L-$R^1$ and X, L, and $R^1$ are as defined in Formula I, disclosed herein, and B is a base.

In some embodiments, a modified nucleotide comprises a pentopyranosyl (4' to 3') sugar and is of any one in the following formulae:

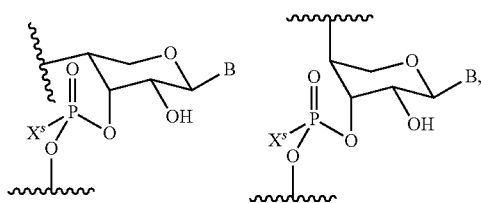

wherein $X^s$ corresponds to the P-modification group "—$XLR^1$" described herein, wherein $XLR^1$ is equivalent to X-L-$R^1$ and X, L, and $R^1$ are as defined in Formula I, disclosed herein, and B is a base.

In some embodiments, a modified nucleotide comprises a tetrofuranosyl (3' to 2') sugar and is of either in the following formulae:

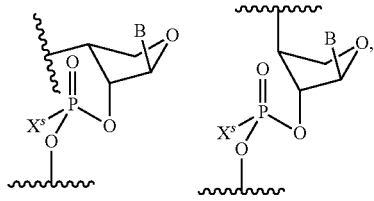

wherein $X^s$ corresponds to the P-modification group "—$XLR^1$" described herein, wherein $XLR^1$ is equivalent to X-L-$R^1$ and X, L, and $R^1$ are as defined in Formula I, disclosed herein, and B is a base.

In some embodiments, a modified nucleotide comprises a modified sugar and is of any one in the following formulae:

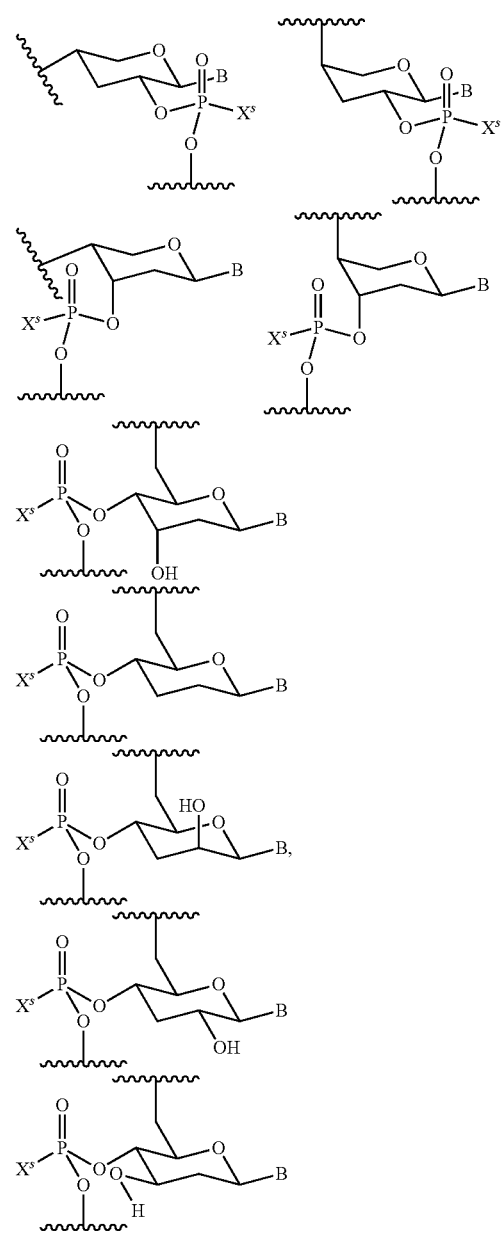

wherein $X^s$ corresponds to the P-modification group "—$XLR^1$" described herein, wherein $XLR^1$ is equivalent to X-L-$R^1$ and X, L, and $R^1$ are as defined in Formula I, disclosed herein, and B is a base.

In some embodiments, one or more hydroxyl group in a sugar moiety is optionally and independently replaced with halogen, R'—N(R')$_2$, —OR', or —SR', wherein each R' is independently as defined above and described herein.

In some embodiments, a modified nucleotide is as illustrated below, wherein $X^s$ corresponds to the P-modification group "—$XLR^1$" described herein, wherein $XLR^1$ is equivalent to X-L-$R^1$ and X, L, and $R^1$ are as defined in Formula I, disclosed herein, B is a base, and X' is selected from —S—, —Se—, —$CH_2$—, —NMe-, —NEt- and —NiPr—

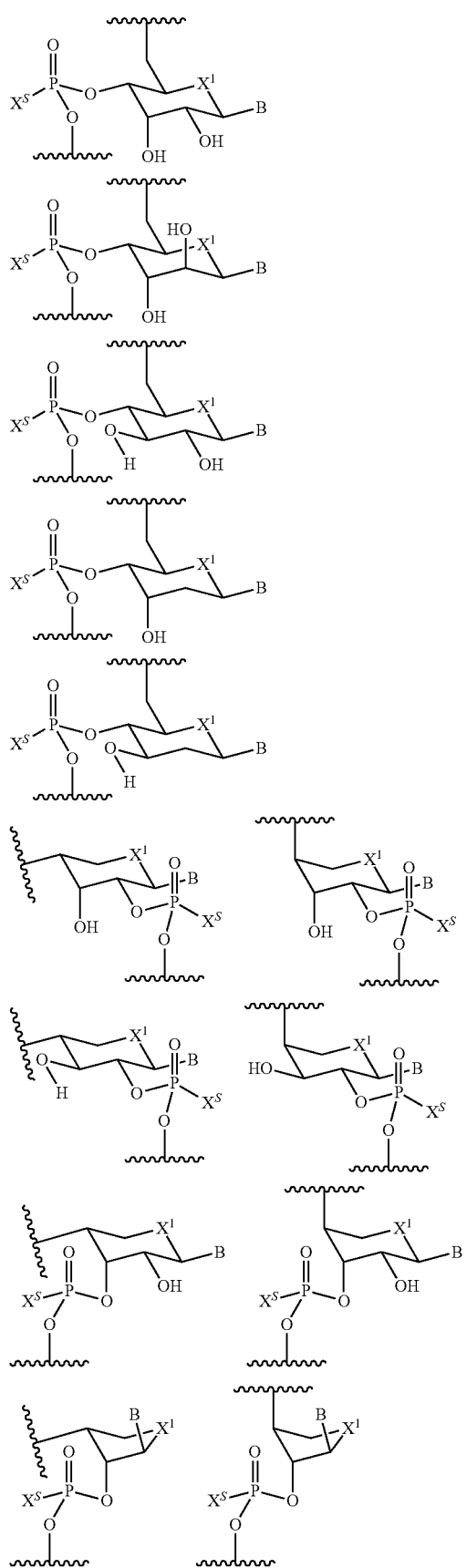
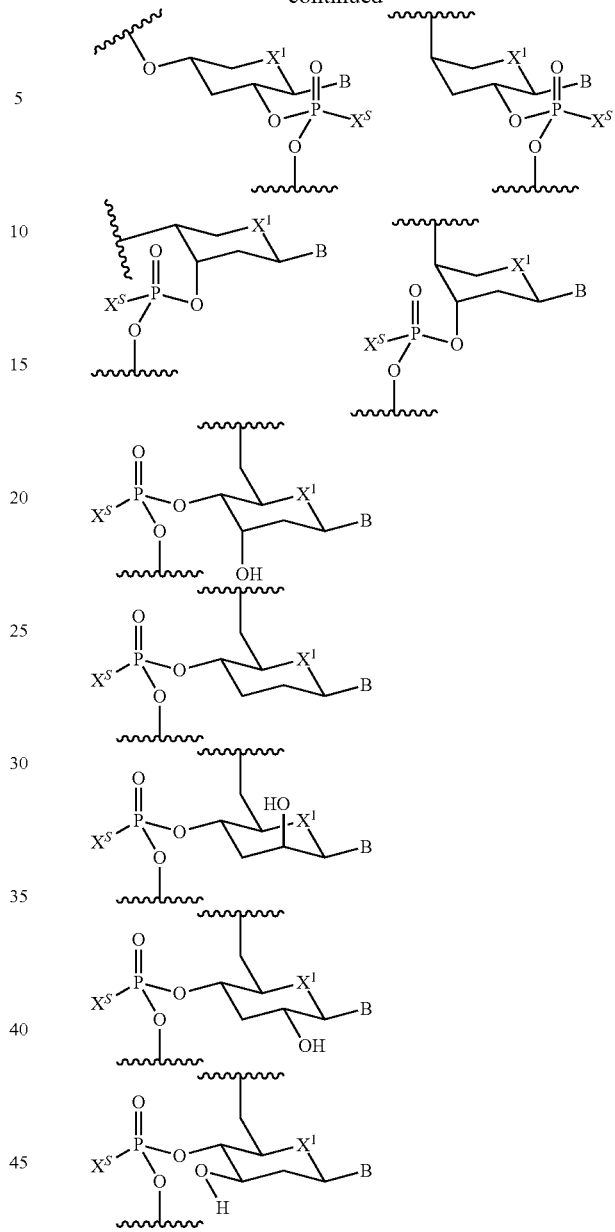

In some embodiments, at least 1%, 2%, 3%, 4%, 5%, V/O, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38% 39% 40%, 41%, 42%, 43%, 44%, 45%, 46%, 47%, 48%, 49%, 50% or more (e.g., 55%, 60%, 65%, 70%, 75%, 80%, 85%, 90%, 95% or more), inclusive, of the sugars in a single-stranded RNAi agent are modified. In some embodiments, only purine residues are modified (e.g., about 1%, 2%, 3%, 4%, 5%, 6%, 7%, 8%, 9%, 10%, 11%, 12%, 13%, 14%, 15%, 16%, 17%, 18%, 19%, 209/O, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50% or more [e.g., 55%, 60%, 65%, 70%, 75%, 80%, 85%, 90%, 95% or more] of the purine residues are modified). In some embodiments, only pyrimidine residues are modified (e.g., about 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50% or more [e.g., 55%, 60%, 65%, 70%, 75%, 80%, 85%, 90%, 95% or more] of the pyridimine residues are modified). In some embodiments, both purine and pyrimidine residues are modified.

Modified sugars can be prepared by methods known in the art, including, but not limited to: A. Eschenmoser, Science (1999), 284:2118; M. Bohringer et al, Helv. Chim. Acta (1992), 75:1416-1477; M. Egli et al, J. Am. Chem. Soc. (2006), 128(33):10847-56; A. Eschenmoser in *Chemical Synthesis: Gnosis to Prognosis*, C. Chatgilialoglu and V. Sniekus, Ed., (Kluwer Academic, Netherlands, 1996), p. 293; K.-U. Schoning et al, Science (2000), 290:1347-1351; A. Eschenmoser et al, Helv. Chim. Acta (1992), 75:218; J. Hunziker et al, Helv. Chim. Acta (1993), 76:259; G. Otting et al, Helv. Chim. Acta (1993), 76:2701; K. Groebke et al, Helv. Chim. Acta (1998), 81:375; and A. Eschenmoser, Science (1999), 284:2118. Modifications to the 2' modifications can be found in Verma, S. et al. *Annu. Rev. Biochem.* 1998, 67, 99-134 and all references therein. Specific modifications to the ribose can be found in the following references: 2'-fluoro (Kawasaki et. al., *J. Med. Chem.*, 1993, 36, 831- 841), 2'-MOE (Martin, P. *Helv. Chim. Acta* 1996, 79, 1930-1938), "LNA" (Wengel, J. *Acc. Chem. Res.* 1999, 32, 301-310). In some embodiments, a modified sugar is any of those described in PCT Publication No. WO2012/030683, incorporated herein by reference, and/or depicted herein. In some embodiments, a modified sugar is any modified sugar described in any of: Gryaznov, S; Chen, J.-K. J. Am. Chem. Soc. 1994, 116, 3143; Hendrix et al. 1997 Chem. Eur. J. 3: 110; Hyrup et al. 1996 Bioorg. Med. Chem. 4: 5; Jepsen et al. 2004 Oligo. 14: 130-146; Jones et al. J. Org. Chem. 1993, 58, 2983; Koizumi et al. 2003 Nuc. Acids Res. 12: 3267-3273; Koshkin et al. 1998 Tetrahedron 54: 3607-3630; Kumar et al. 1998 Bioo. Med. Chem. Let. 8: 2219-2222; Lauritsen et al. 2002 Chem. Comm. 5: 530-531; Lauritsen et al. 2003 Bioo. Med. Chem. Lett. 13: 253-256; Mesmaeker et al. Angew. Chem., Int. Ed. Engl. 1994, 33, 226; Morita et al. 2001 Nucl. Acids Res. Supp. 1: 241-242; Morita et al. 2002 Bioo. Med. Chem. Lett. 12: 73-76; Morita et al. 2003 Bioo. Med. Chem. Lett. 2211-2226; Nielsen et al. 1997 Chem. Soc. Rev. 73; Nielsen et al. 1997 J. Chem. Soc. Perkins Transl. 1: 3423-3433; Obika et al. 1997 Tetrahedron Lett. 38 (50): 8735-8; Obika et al. 1998 Tetrahedron Lett. 39: 5401-5404; Pallan et al. 2012 Chem. Comm. 48: 8195-8197; Petersen et al. 2003 TRENDS Biotech. 21: 74-81; Rajwanshi et al. 1999 Chem. Commun. 1395-1396; Schultz et al. 1996 Nucleic Acids Res. 24: 2966; Seth et al. 2009 J. Med. Chem. 52: 10-13; Seth et al. 2010 J. Med. Chem. 53: 8309-8318; Seth et al. 2010 J. Org. Chem. 75: 1569-1581; Seth et al. 2012 Bioo. Med. Chem. Lett. 22: 296-299; Seth et al. 2012 Mol. Ther-Nuc. Acids. 1, e47; Seth, Punit P; Siwkowski, Andrew; Allerson, Charles R; Vasquez, Guillermo; Lee, Sam; Prakash, Thazha P; Kinberger, Garth; Migawa, Michael T; Gaus, Hans; Bhat, Balkrishen; et al. From Nucleic Acids Symposium Series (2008), 52(1), 553-554; Singh et al. 1998 Chem. Comm. 1247-1248; Singh et al. 1998 J. Org. Chem. 63: 10035-39; Singh et al. 1998 J. Org. Chem. 63: 6078-6079; Sorensen 2003 Chem. Comm. 2130-2131; Ts'o et al. Ann. N. Y. Acad. Sci. 1988, 507, 220; Van Aerschot et al. 1995 Angew. Chem. Int. Ed. Engl. 34: 1338; Vasseur et al. J. Am. Chem. Soc. 1992, 114, 4006; WO 20070900071; WO 20070900071; or WO 2016/079181.

In some embodiments, a modified sugar moiety is an optionally substituted pentose or hexose moiety. In some embodiments, a modified sugar moiety is an optionally substituted pentose moiety. In some embodiments, a modified sugar moiety is an optionally substituted hexose moiety. In some embodiments, a modified sugar moiety is an optionally substituted ribose or hexitol moiety. In some embodiments, a modified sugar moiety is an optionally substituted ribose moiety. In some embodiments, a modified sugar moiety is an optionally substituted hexitol moiety.

In some embodiments, an example modified nucleotide is selected from:

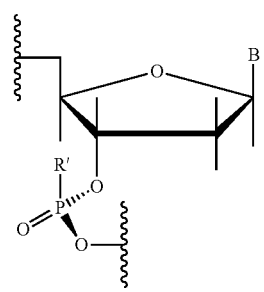

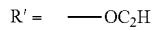
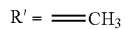

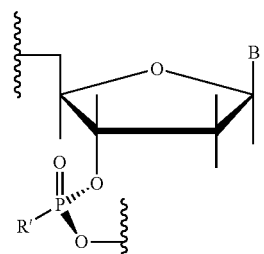

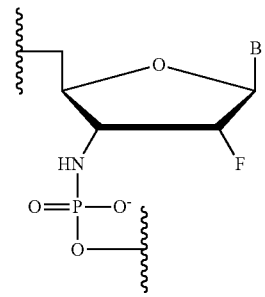

2'-Fluoro N3'-P5'-phosphoramidate

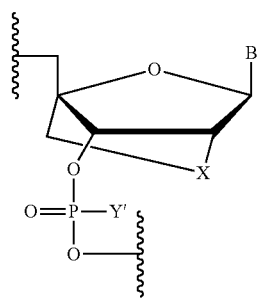
LNA: X = O, Y = O
2'-Thio-LNA: X = S, Y = O
2'-Phosphorothioate-LNA: X = O, Y = S
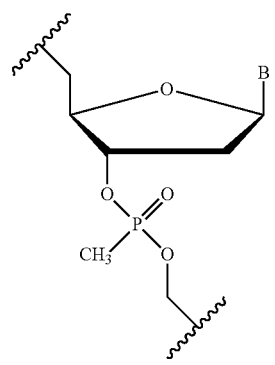
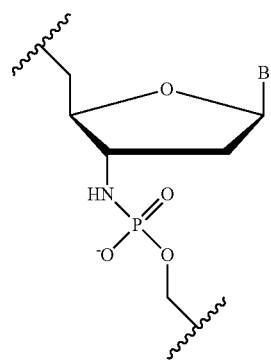
PS-LNA
In some embodiments, a nucleotide has a structure selected from any of:
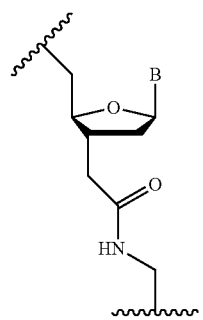 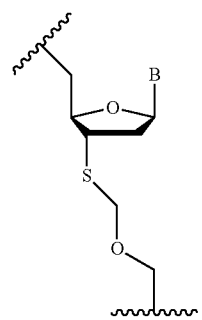
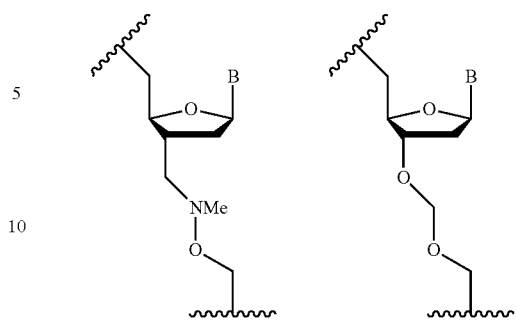
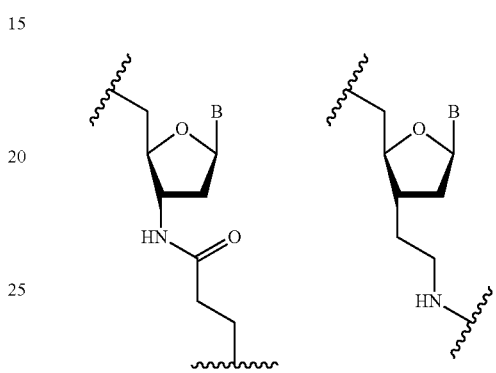
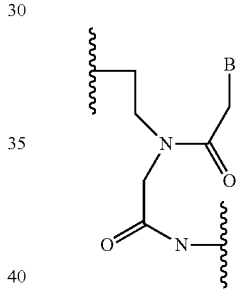
PNA
In some embodiments, a modified nucleoside has a structure selected from:
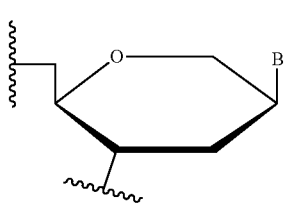
HNA
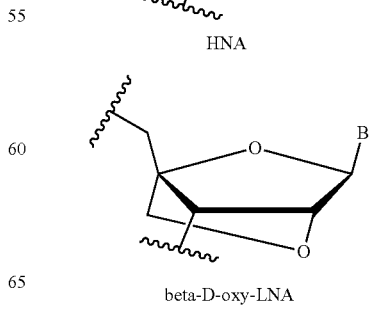
beta-D-oxy-LNA -continued

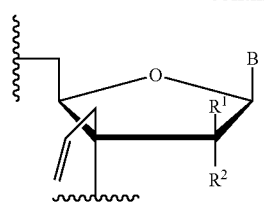

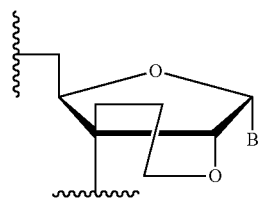

wherein $R^1$ and $R^2$ are independently —H, —F, —OMe, -MOE or substituted or unsubstituted $C_{1-6}$ alkyl;

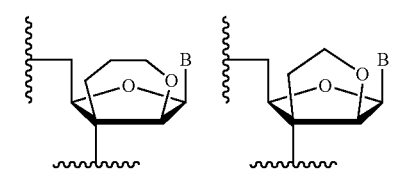

2'-O, 3'-C-linked bicyclic

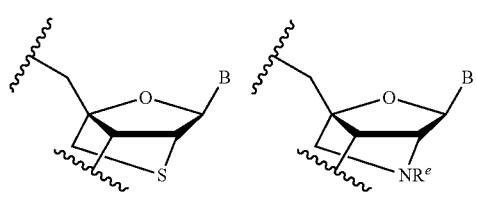

beta-D-thio-LNA    beta-D-amino-LNA where $R^e$ is substituted or unsubstituted $C_{1-6}$ alkyl or H

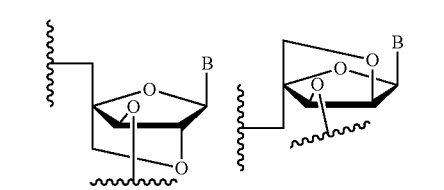

xylo-LNA [c]

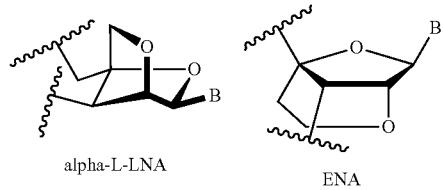

alpha-L-LNA    ENA

-continued

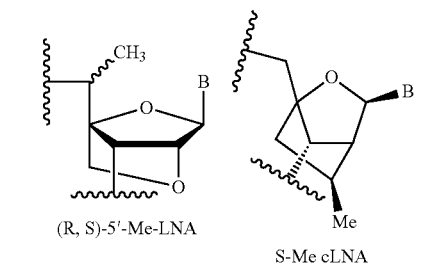

beta-D-ENA    methylphosphonate-LNA (R, S)-cEt    (R, S)-cMOE (R, S)-cMOE


(R, S)-5'-Me-LNA    S-Me cLNA

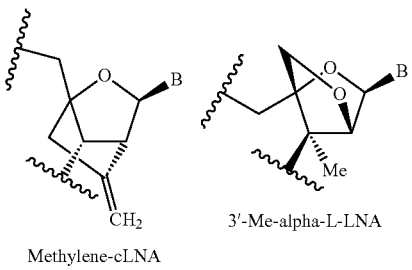

Methylene-cLNA    3'-Me-alpha-L-LNA


R-6'-Me-alpha-L-LNA    S-5'-Me-alpha-L-LNA


R-5'-Me-alpha-L-LNA

In some embodiments, a nucleotide and adjacent nucleoside have the structure of:

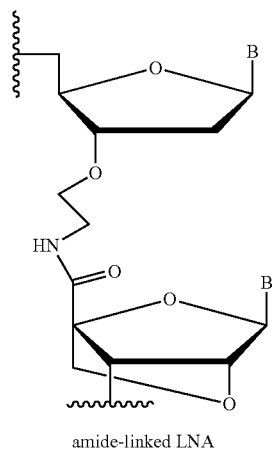

amide-linked LNA

In some embodiments, $R^1$ is R as defined and described. In some embodiments, $R^2$ is R. In some embodiments, $R^e$ is R. In some embodiments, $R^e$ is H, $CH_3$, Bn, $COCF_3$, benzoyl, benzyl, pyren-1-ylcarbonyl, pyren-1-ylmethyl, 2-aminoethyl. In some embodiments, a non-limiting example internucleotidic linkage or sugar is or comprises a component of any of: N-methanocarba, C3-amide, Formacetal, Thioformacetal, MMI, PMO (phosphorodiamidate linked morpholino), PNA (peptide nucleic acid), LNA, cMOE BNA, cEt BNA, α-L-NA or a related analog, HNA, Me-ANA, MOE-ANA, Ara-FHNA, FHNA, R-6'-Me-FHNA, S-6'-Me-FHNA, ENA, or c-ANA. In some embodiments, a non-limiting example internucleotidic linkage or sugar is or comprises a component of any of those described in Allerson et al. 2005 J. Med. Chem. 48: 901-4; BMCL 2011 21: 1122; BMCL 2011 21: 588; BMCL 2012 22: 296; Chattopadhyaya et al. 2007 J. Am. Chem. Soc. 129: 8362; Chem. Bio. Chem. 2013 14: 58; Curr. Prot. Nucl. Acids Chem. 2011 1.24.1; Egli et al. 2011 J. Am. Chem. Soc. 133: 16642; Hendrix et al. 1997 Chem. Eur. J. 3: 110; Hyrup et al. 1996 Bioorg. Med. Chem. 4: 5; Imanishi 1997 Tet. Lett. 38: 8735; J. Am. Chem. Soc. 1994, 116, 3143; J. Med. Chem. 2009 52: 10; J. Org. Chem. 2010 75: 1589; Jepsen et al. 2004 Oligo. 14: 130-146; Jones et al. J. Org. Chem. 1993, 58, 2983; Jung et al. 2014 ACIEE 53: 9893; Kodama et al. 2014 AGDS; Koizumi 2003 BMC 11: 2211; Koizumi et al. 2003 Nuc. Acids Res. 12: 3267-3273; Koshkin et al. 1998 Tetrahedron 54: 3607-3630; Kumar et al. 1998 Bioo. Med. Chem. Let. 8: 2219-2222; Lauritsen et al. 2002 Chem. Comm. 5: 530-531; Lauritsen et al. 2003 Bioo. Med. Chem. Lett. 13: 253-256; Lima et al. 2012 Cell 150: 883-894; Mesmaeker et al. Angew. Chem., Int. Ed. Engl. 1994, 33, 226; Migawa et al. 2013 Org. Lett. 15: 4316; Mol. Ther. Nucl. Acids 2012 1: e47; Morita et al. 2001 Nucl. Acids Res. Supp. 1: 241-242; Morita et al. 2002 Bioo. Med. Chem. Lett. 12: 73-76; Morita et al. 2003 Bioo. Med. Chem. Lett. 2211-2226; Murray et al. 2012 Nucl. Acids Res. 40: 6135; Nielsen et al. 1997 Chem. Soc. Rev. 73; Nielsen et al. 1997 J. Chem. Soc. Perkins Transl. 1: 3423-3433; Obika et al. 1997 Tetrahedron Lett. 38 (50): 8735-8; Obika et al. 1998 Tetrahedron Lett. 39: 5401-5404; Obika et al. 2008 J. Am. Chem. Soc. 130: 4886; Obika et al. 2011 Org. Lett. 13: 6050; Oestergaard et al. 2014 JOC 79: 8877; Pallan et al. 2012 Biochem. 51: 7; Pallan et al. 2012 Chem. Comm. 48: 8195-8197; Petersen et al. 2003 TRENDS Biotech. 21: 74-81; Prakash et al. 2010 J. Med. Chem. 53: 1636; Prakash et al. 2015 Nucl. Acids Res. 43: 2993-3011; Prakash et al. 2016 Bioorg. Med. Chem. Lett. 26: 2817-2820; Rajwanshi et al. 1999 Chem. Commun. 1395-1396; Schultz et al. 1996 Nucleic Acids Res. 24: 2966; Seth et al. 2008 Nucl. Acid Sym. Ser. 52: 553; Seth et al. 2009 J. Med. Chem. 52: 10-13; Seth et al. 2010 J. Am. Chem. Soc. 132: 14942; Seth et al. 2010 J. Med. Chem. 53: 8309-8318; Seth et al. 2010 J. Org. Chem. 75: 1569-1581; Seth et al. 2011 BMCL 21: 4690; Seth et al. 2012 Bioo. Med. Chem. Lett. 22: 296-299; Seth et al. 2012 Mol. Ther-Nuc. Acids. 1, e47; Seth et al., Nucleic Acids Symposium Series (2008), 52(1), 553-554; Singh et al. 1998 Chem. Comm. 1247-1248; Singh et al. 1998 J. Org. Chem. 63: 10035-39; Singh et al. 1998 J. Org. Chem. 63: 6078-6079; Sorensen 2003 Chem. Comm. 2130-2131; Starrup et al. 2010 Nucl. Acids Res. 38: 7100; Swayze et al. 2007 Nucl. Acids Res. 35: 687; Ts'o et al. Ann. N. Y. Acad. Sci. 1988, 507, 220; Van Aerschot et al. 1995 Angew. Chem. Int. Ed. Engl. 34: 1338; Vasseur et al. J. Am. Chem. Soc. 1992, 114, 4006; WO 20070900071; WO 2016/079181; U.S. Pat. Nos. 6,326,199; 6,066,500; and 6,440,739, the base and sugar modifications of each of which is herein incorporated by reference.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any sugar described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any sugar described herein or known in the art in combination with any other structural element or modification described herein, including but not limited to, base sequence or portion thereof, base; internucleotidic linkage; stereochemistry or pattern thereof; additional chemical moiety, including but not limited to, a targeting moiety, lipid moiety, a GalNAc moiety, etc.; 5'-end structure; 5'-end region; 5' nucleotide moiety; seed region; post-seed region; 3'-end region; 3'-terminal dinucleotide; 3'-end cap; GC content; long GC stretch; pattern of modifications of sugars, bases or internucleotidic linkages; format or any structural element thereof, and/or any other structural element or modification described herein; and in some embodiments, the present disclosure pertains to multimers of any such oligonucleotides. Various additional sugars are described in the art and can be utilized in accordance with the present disclosure.

Base Sequence of an Oligonucleotide

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides can comprise any base sequence or portion thereof, described herein, wherein a portion is a span of at least 15 contiguous bases, or a span of at least 15 contiguous bases with 1-5 mismatches.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any base sequence described herein. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any base sequence or portion thereof, described herein. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any base sequence or portion thereof, described herein, wherein a portion is a span of 15 contiguous bases, or a span of 15 contiguous bases with 1-5 mismatches.

The sequence of a single-stranded RNAi agent has a sufficient length and identity to a transcript target to mediate target-specific RNA interference. In some embodiments, the RNAi agent is complementary to a portion of a transcript target sequence.

The base sequence of a single-stranded RNAi agent is complementary to that of a target transcript. As used herein, "target transcript sequence," "target sequence", "target gene", and the like, refer to a contiguous portion of the nucleotide sequence of an mRNA molecule formed during the transcription of a gene, e.g., a target gene, including mRNA that is a product of RNA processing of a primary transcription product.

The terms "complementary," "fully complementary" and "substantially complementary" herein may be used with respect to the base matching between the strand of a single-stranded RNAi agent and a target sequence or between an antisense oligonucleotide and a target sequence, as will be understood from the context of their use. A strand of a single-stranded RNAi agent or antisense oligonucleotide or other oligonucleotide is complementary to that of a target sequence when each base of the single-stranded RNAi agent, antisense oligonucleotide or other oligonucleotide is capable of base-pairing with a sequential base on the target strand, when maximally aligned. As a non-limiting example, if a target sequence has, for example, a base sequence of 5'-GCAUAGCGAGCGAGGGAAAAC-3' (SEQ ID NO: 2), an oligonucleotide with a base sequence of 5' GUUUUCCCUCGCUCGCUAUGC-3' (SEQ ID NO: 3) is complementary or fully complementary to such a target sequence. It is noted, of course, that substitution of T for U, or vice versa, does not alter the amount of complementarity.

As used herein, a polynucleotide that is "substantially complementary" to a target sequence is largely or mostly complementary but not 100% complementary. In some embodiments, a sequence (e.g., a strand of a single-stranded RNAi agent or an antisense oligonucleotide) which is substantially complementary has 1, 2, 3, 4 or 5 mismatches from a sequence which is 100% complementary to the target sequence. In the case of a single-stranded RNAi agent, this disclosure notes that the 5' terminal nucleotide ($N_1$) in many cases has a mismatch from the complement of a target sequence. Similarly, in a single-stranded RNAi agent, the 3'-terminal dinucleotide, if present, can be a mismatch from the complement of the target sequence. As a non-limiting example, if a target sequence has, for example, a base sequence of 5'-GCAUAGCGAGCGAGGGAAAAC-3' (SEQ ID NO: 4), a single-stranded RNAi agent with a base sequence of 5'TUUUUCCCUCGCUCGCUAUTU-3' (SEQ ID NO: 5) is substantially complementary to such a target sequence.

The present disclosure presents, in Table 1A and elsewhere, various single-stranded RNAi agents and antisense oligonucleotides and other oligonucleotides, each of which has a defined base sequence. In some embodiments, the disclosure encompasses any oligonucleotide having a base sequence which is, comprises, or comprises a portion of the base sequence of any various single-stranded RNAi agent, antisense oligonucleotide and other oligonucleotide disclosed herein. In some embodiments, the disclosure encompasses any oligonucleotide having a base sequence which is, comprises, or comprises a portion of the base sequence of any various single-stranded RNAi agent, antisense oligonucleotide and other oligonucleotide disclosed herein, which has any chemical modification, stereochemistry, format, structural feature (e.g., if the oligonucleotide is a single-stranded RNAi agent, the 5'-end structure, 5'-end region, 5' nucleotide moiety, seed region, post-seed region, 3'-end region, 3'-terminal dinucleotide, 3'-end cap, or any structure, pattern or portion thereof), and/or any other modification described herein (e.g., conjugation with another moiety, such as a targeting moiety, carbohydrate moiety, a GalNAc moiety, lipid moiety, etc.; and/or multimerization).

In some embodiments, an oligonucleotide has a base sequence which is, comprises or comprises a portion of the base sequence of any oligonucleotide disclosed herein.

In some embodiments, an oligonucleotide targets ACVR2B and has a base sequence which is, comprises or comprises a portion of the base sequence of any oligonucleotide disclosed herein.

In some embodiments, an oligonucleotide targets APOB and has a base sequence which is, comprises or comprises a portion of: the base sequence of any oligonucleotide disclosed herein.

In some embodiments, an oligonucleotide targets FXI and has a base sequence which is, comprises or comprises a portion of the base sequence of any oligonucleotide disclosed herein.

In some embodiments, an oligonucleotide targets KRT and has a base sequence which is, comprises or comprises a portion of the base sequence of any oligonucleotide disclosed herein.

In some embodiments, an oligonucleotide targets KRT14 and has a base sequence which is, comprises or comprises a portion of the base sequence of any oligonucleotide disclosed herein.

In some embodiments, an oligonucleotide targets MSTN and has a base sequence which is, comprises or comprises a portion of the base sequence of any oligonucleotide disclosed herein.

In some embodiments, an oligonucleotide targets MSTN-R and has a base sequence which is, comprises or comprises a portion of the base sequence of any oligonucleotide disclosed herein.

In some embodiments, an oligonucleotide targets PCSK9 and has a base sequence which is, comprises or comprises a portion of the base sequence of any oligonucleotide disclosed herein.

In some embodiments, an oligonucleotide targets APOC3 and has a base sequence which is, comprises or comprises a portion of: AAAGCTGGACAAGAAGCTA (SEQ ID NO: 6).

In some embodiments, an oligonucleotide targets APOC3 and has a base sequence which is, comprises or comprises a portion of: AACCTTAGCTGGGTCTGCCA (SEQ ID NO: 7).

In some embodiments, an oligonucleotide targets APOC3 and has a base sequence which is, comprises or comprises a portion of: AAGCAGCTTCTTGTCCAGC (SEQ ID NO: 8).

In some embodiments, an oligonucleotide targets APOC3 and has a base sequence which is, comprises or comprises a portion of: AAGGGAGGCATCCTCGGCCT (SEQ ID NO: 9).

In some embodiments, an oligonucleotide targets APOC3 and has a base sequence which is, comprises or comprises a portion of: AAGTTGGTCTGACCTCAGGG (SEQ ID NO: 10).

In some embodiments, an oligonucleotide targets APOC3 and has a base sequence which is, comprises or comprises a portion of: AATAAAGCTGGACAAGAAGCTGCTAT (SEQ ID NO: 11).

In some embodiments, an oligonucleotide targets APOC3 and has a base sequence which is, comprises or comprises a portion of: AATACTGTCCCTTTTAAGC (SEQ ID NO: 12).

In some embodiments, an oligonucleotide targets APOC3 and has a base sequence which is, comprises or comprises a portion of: ACACCACCCTCTCAACTTCA (SEQ ID NO: 13).

In some embodiments, an oligonucleotide targets APOC3 and has a base sequence which is, comprises or comprises a portion of: ACACCCATGTCCCCACTGGA (SEQ ID NO: 14).

In some embodiments, an oligonucleotide targets APOC3 and has a base sequence which is, comprises or comprises a portion of: ACCGCCAAGGATGCACTGAGCAGC (SEQ ID NO: 15).

In some embodiments, an oligonucleotide targets APOC3 and has a base sequence which is, comprises or comprises a portion of: ACTTGTCCAGCTTTATTGG (SEQ ID NO: 16).

In some embodiments, an oligonucleotide targets APOC3 and has a base sequence which is, comprises or comprises a portion of: AGCAGCGTGCAGGAGTCCCAGGTG (SEQ ID NO: 17).

In some embodiments, an oligonucleotide targets APOC3 and has a base sequence which is, comprises or comprises a portion of: AGCAGCTTCTTGTCCAGC (SEQ ID NO: 18).

In some embodiments, an oligonucleotide targets APOC3 and has a base sequence which is, comprises or comprises a portion of: AGCAGCTTCTTGTCCAGCT (SEQ ID NO: 19).

In some embodiments, an oligonucleotide targets APOC3 and has a base sequence which is, comprises or comprises a portion of: AGCAGCTTCTTGTCCAG (SEQ ID NO: 20).

In some embodiments, an oligonucleotide targets APOC3 and has a base sequence which is, comprises or comprises a portion of: AGCCACGGCTGAAGTTGGTC (SEQ ID NO: 21).

In some embodiments, an oligonucleotide targets APOC3 and has a base sequence which is, comprises or comprises a portion of: AGCCATCGGTCACCCAGCCC (SEQ ID NO: 22).

In some embodiments, an oligonucleotide targets APOC3 and has a base sequence which is, comprises or comprises a portion of: AGCTTCTTGTCCAGCTTTAT (SEQ ID NO: 23).

In some embodiments, an oligonucleotide targets APOC3 and has a base sequence which is, comprises or comprises a portion of: AGCTTCTTGTCCAG (SEQ ID NO: 24).

In some embodiments, an oligonucleotide targets APOC3 and has a base sequence which is, comprises or comprises a portion of: AGCTTCTTGTCCAGCTTT (SEQ ID NO: 25).

In some embodiments, an oligonucleotide targets APOC3 and has a base sequence which is, comprises or comprises a portion of: AGCTTCTTGTCCAGCTTTATTT (SEQ ID NO: 26).

In some embodiments, an oligonucleotide targets APOC3 and has a base sequence which is, comprises or comprises a portion of: AGCTTCTTGTCCAGCT (SEQ ID NO: 27).

In some embodiments, an oligonucleotide targets APOC3 and has a base sequence which is, comprises or comprises a portion of: AGCTTCTTGTCCAGCTTT (SEQ ID NO: 28).

In some embodiments, an oligonucleotide targets APOC3 and has a base sequence which is, comprises or comprises a portion of: AGCTTCTTGTCCAGCTTTA (SEQ ID NO: 29).

In some embodiments, an oligonucleotide targets APOC3 and has a base sequence which is, comprises or comprises a portion of: AGGCATCCTCGGCCTCTGAA (SEQ ID NO: 30).

In some embodiments, an oligonucleotide targets APOC3 and has a base sequence which is, comprises or comprises a portion of: AGGCCAGCATGCCTGGAGGG (SEQ ID NO: 31).

In some embodiments, an oligonucleotide targets APOC3 and has a base sequence which is, comprises or comprises a portion of: AGGCCAGCATGCCTGGAGG (SEQ ID NO: 32).

In some embodiments, an oligonucleotide targets APOC3 and has a base sequence which is, comprises or comprises a portion of: AGGGAGGCATCCTCGGCCTC (SEQ ID NO: 33).

In some embodiments, an oligonucleotide targets APOC3 and has a base sequence which is, comprises or comprises a portion of: AGGGTTACATGAAGCACGC (SEQ ID NO: 34).

In some embodiments, an oligonucleotide targets APOC3 and has a base sequence which is, comprises or comprises a portion of: AGGTCTCAGGCAGCCACGGC (SEQ ID NO: 35).

In some embodiments, an oligonucleotide targets APOC3 and has a base sequence which is, comprises or comprises a portion of: AGGTCTCAGGCAGCCACG (SEQ ID NO: 36).

In some embodiments, an oligonucleotide targets APOC3 and has a base sequence which is, comprises or comprises a portion of: AGGTCTCAGGCAGCCACGG (SEQ ID NO: 37).

In some embodiments, an oligonucleotide targets APOC3 and has a base sequence which is, comprises or comprises a portion of: AGTCCAGCTTTATTGGGAG (SEQ ID NO: 38).

In some embodiments, an oligonucleotide targets APOC3 and has a base sequence which is, comprises or comprises a portion of: ATAGCAGCTTCTTGTCGAGC (SEQ ID NO: 39).

In some embodiments, an oligonucleotide targets APOC3 and has a base sequence which is, comprises or comprises a portion of: ATAGCAGCTTCTTGTCCAGC (SEQ ID NO: 40).

In some embodiments, an oligonucleotide targets APOC3 and has a base sequence which is, comprises or comprises a portion of: ATAGCAGCTTCTTGTCCA (SEQ ID NO: 41).

In some embodiments, an oligonucleotide targets APOC3 and has a base sequence which is, comprises or comprises a portion of: ATAGCAGCTTCTTGTCCAG (SEQ ID NO: 42).

In some embodiments, an oligonucleotide targets APOC3 and has a base sequence which is, comprises or comprises a portion of: ATCCTTGGCGGTCTTGGTGG (SEQ ID NO: 43).

In some embodiments, an oligonucleotide targets APOC3 and has a base sequence which is, comprises or comprises a portion of: ATCGGTCACCCAGCCCCTGG (SEQ ID NO: 44).

In some embodiments, an oligonucleotide targets APOC3 and has a base sequence which is, comprises or comprises a portion of: ATCTTGTCCAGCTTTATTG (SEQ ID NO: 45).

In some embodiments, an oligonucleotide targets APOC3 and has a base sequence which is, comprises or comprises a portion of: ATGAAGCACGCCACCAAGA (SEQ ID NO: 46).

In some embodiments, an oligonucleotide targets APOC3 and has a base sequence which is, comprises or comprises a portion of: ATGCACTGAGCAGCGTGCAG-GAGTCCCAGGTG (SEQ ID NO: 47).

In some embodiments, an oligonucleotide targets APOC3 and has a base sequence which is, comprises or comprises a portion of: ATGTCCAGCTTTATTGGGA (SEQ ID NO: 48).

In some embodiments, an oligonucleotide targets APOC3 and has a base sequence which is, comprises or comprises a portion of: CAATAAAGCTGGACAAGAAGCTA (SEQ ID NO: 49).

In some embodiments, an oligonucleotide targets APOC3 and has a base sequence which is, comprises or comprises a portion of: CACCAAGACCGCCAAGGATGCACT-GAGCAG (SEQ ID NO: 50).

In some embodiments, an oligonucleotide targets APOC3 and has a base sequence which is, comprises or comprises a portion of: CACCCATTGGGACTGGGATC (SEQ ID NO: 51).

In some embodiments, an oligonucleotide targets APOC3 and has a base sequence which is, comprises or comprises a portion of: CACGCTGCTCAGTGCATCCT (SEQ ID NO: 52).

In some embodiments, an oligonucleotide targets APOC3 and has a base sequence which is, comprises or comprises a portion of: CACGGCTGAAGTTGGTCTGA (SEQ ID NO: 53).

In some embodiments, an oligonucleotide targets APOC3 and has a base sequence which is, comprises or comprises a portion of: CACTGAGAATACTGTCCCAA (SEQ ID NO: 54).

In some embodiments, an oligonucleotide targets APOC3 and has a base sequence which is, comprises or comprises a portion of: CACTGAGAATACTGTCCC (SEQ ID NO: 55).

In some embodiments, an oligonucleotide targets APOC3 and has a base sequence which is, comprises or comprises a portion of: CAGCCGTGGCTGCCTGAGACCTCA (SEQ ID NO: 56).

In some embodiments, an oligonucleotide targets APOC3 and has a base sequence which is, comprises or comprises a portion of: CAGCCGTGGCTGCCTGAGACCTCAA (SEQ ID NO: 57).

In some embodiments, an oligonucleotide targets APOC3 and has a base sequence which is, comprises or comprises a portion of: CAGCTTCTTGTCCAGCTTTA (SEQ ID NO: 58).

In some embodiments, an oligonucleotide targets APOC3 and has a base sequence which is, comprises or comprises a portion of: CAGCTTCTTGTCCAGCTT (SEQ ID NO: 59).

In some embodiments, an oligonucleotide targets APOC3 and has a base sequence which is, comprises or comprises a portion of: CAGCTTCTTGTCCAGCTTT (SEQ ID NO: 60).

In some embodiments, an oligonucleotide targets APOC3 and has a base sequence which is, comprises or comprises a portion of: CAGGGGCTGGGTGACCGATGGC (SEQ ID NO: 61).

In some embodiments, an oligonucleotide targets APOC3 and has a base sequence which is, comprises or comprises a portion of: CAGTGCATCCTTGGCGGTCT (SEQ ID NO: 62).

In some embodiments, an oligonucleotide targets APOC3 and has a base sequence which is, comprises or comprises a portion of: CATAGCAGCTTCTTGTCCAG (SEQ ID NO: 63).

In some embodiments, an oligonucleotide targets APOC3 and has a base sequence which is, comprises or comprises a portion of: CATCCTCGGCCTCTGAAGCT (SEQ ID NO: 64).

In some embodiments, an oligonucleotide targets APOC3 and has a base sequence which is, comprises or comprises a portion of: CATCCTTGGCGGTCTTGGTG (SEQ ID NO: 65).

In some embodiments, an oligonucleotide targets APOC3 and has a base sequence which is, comprises or comprises a portion of: CATCCTCGGCCTCTGAAGC (SEQ ID NO: 66).

In some embodiments, an oligonucleotide targets APOC3 and has a base sequence which is, comprises or comprises a portion of: CATCCTTGGCGGTCTTGG (SEQ ID NO: 67).

In some embodiments, an oligonucleotide targets APOC3 and has a base sequence which is, comprises or comprises a portion of: CATCGGTCACCCAGCCCCTG (SEQ ID NO: 68).

In some embodiments, an oligonucleotide targets APOC3 and has a base sequence which is, comprises or comprises a portion of: CCACCAAGACCGCCAAGGATGCAC (SEQ ID NO: 69).

In some embodiments, an oligonucleotide targets APOC3 and has a base sequence which is, comprises or comprises a portion of: CCACCTGGGACTCCTGCACG (SEQ ID NO: 70).

In some embodiments, an oligonucleotide targets APOC3 and has a base sequence which is, comprises or comprises a portion of: CCACCTGGGACTCCTGCAC (SEQ ID NO: 71).

In some embodiments, an oligonucleotide targets APOC3 and has a base sequence which is, comprises or comprises a portion of: CCACGGCTGAAGTTGGTCTG (SEQ ID NO: 72).

In some embodiments, an oligonucleotide targets APOC3 and has a base sequence which is, comprises or comprises a portion of: CCAGCTTTATTAGGGACAGC (SEQ ID NO: 73).

In some embodiments, an oligonucleotide targets APOC3 and has a base sequence which is, comprises or comprises a portion of: CCAGCTTTATTGGGAGGCC (SEQ ID NO: 74).

In some embodiments, an oligonucleotide targets APOC3 and has a base sequence which is, comprises or comprises a portion of: CCAGCTTTATTAGGGAC (SEQ ID NO: 75).

In some embodiments, an oligonucleotide targets APOC3 and has a base sequence which is, comprises or comprises a portion of: CCAGCTTTATTGGGAGGC (SEQ ID NO: 76).

In some embodiments, an oligonucleotide targets APOC3 and has a base sequence which is, comprises or comprises a portion of: CCAGGAGCGCCAGGAGGGCA (SEQ ID NO: 77).

In some embodiments, an oligonucleotide targets APOC3 and has a base sequence which is, comprises or comprises a portion of: CCATCGGTCACCCAGCCCCT (SEQ ID NO: 78).

In some embodiments, an oligonucleotide targets APOC3 and has a base sequence which is, comprises or comprises a portion of: CCATCGGTCACCCAGCCC (SEQ ID NO: 79).

In some embodiments, an oligonucleotide targets APOC3 and has a base sequence which is, comprises or comprises a portion of: CCCTGGAGATTGCAGGAC (SEQ ID NO: 80).

In some embodiments, an oligonucleotide targets APOC3 and has a base sequence which is, comprises or comprises a portion of: CCGTGGCTGCCTGAGACCT (SEQ ID NO: 81).

In some embodiments, an oligonucleotide targets APOC3 and has a base sequence which is, comprises or comprises a portion of: CCTCAGTCTGCTTCGCAC (SEQ ID NO: 82).

In some embodiments, an oligonucleotide targets APOC3 and has a base sequence which is, comprises or comprises a portion of: CCTCAGTCTGCTTCGCACCTTC (SEQ ID NO: 83).

In some embodiments, an oligonucleotide targets APOC3 and has a base sequence which is, comprises or comprises a portion of: CCTCAGTCTGCTTCGCACCT (SEQ ID NO: 84).

In some embodiments, an oligonucleotide targets APOC3 and has a base sequence which is, comprises or comprises a portion of: CCTCCAGGCATGCTGGCCT (SEQ ID NO: 85).

In some embodiments, an oligonucleotide targets APOC3 and has a base sequence which is, comprises or comprises a portion of: CCTCCCAATAAAGCTGGACA (SEQ ID NO: 86).

In some embodiments, an oligonucleotide targets APOC3 and has a base sequence which is, comprises or comprises a portion of: CCTCGGCCTCTGAAGCTCG (SEQ ID NO: 87).

In some embodiments, an oligonucleotide targets APOC3 and has a base sequence which is, comprises or comprises a portion of: CCTCGGCCTCTGAAGCTCGG (SEQ ID NO: 88).

In some embodiments, an oligonucleotide targets APOC3 and has a base sequence which is, comprises or comprises a portion of: CCTCTGAAAGTGGATTACCA (SEQ ID NO: 89).

In some embodiments, an oligonucleotide targets APOC3 and has a base sequence which is, comprises or comprises a portion of: CCTCTGAAGCTCGGGCAGAG (SEQ ID NO: 90).

In some embodiments, an oligonucleotide targets APOC3 and has a base sequence which is, comprises or comprises a portion of: CCTGGAGATTGCAGGACCCA (SEQ ID NO: 91).

In some embodiments, an oligonucleotide targets APOC3 and has a base sequence which is, comprises or comprises a portion of: CCTGGGACTCCTGCACGCTG (SEQ ID NO: 92).

In some embodiments, an oligonucleotide targets APOC3 and has a base sequence which is, comprises or comprises a portion of: CCTTGCAGGAACCCCAGCA (SEQ ID NO: 93).

In some embodiments, an oligonucleotide targets APOC3 and has a base sequence which is, comprises or comprises a portion of: CCTTGGCGGTCTTGGTGGCG (SEQ ID NO: 94).

In some embodiments, an oligonucleotide targets APOC3 and has a base sequence which is, comprises or comprises a portion of: CCTTGGCGGTCTTGGTGGC (SEQ ID NO: 95).

In some embodiments, an oligonucleotide targets APOC3 and has a base sequence which is, comprises or comprises a portion of: CGGCCTCTGAAGCTCGGGC (SEQ ID NO: 96).

In some embodiments, an oligonucleotide targets APOC3 and has a base sequence which is, comprises or comprises a portion of: CGGCCTCTGAAGCTCGGGCA (SEQ ID NO: 97).

In some embodiments, an oligonucleotide targets APOC3 and has a base sequence which is, comprises or comprises a portion of: CGGTCACCCAGCCCCTGGC (SEQ ID NO: 98).

In some embodiments, an oligonucleotide targets APOC3 and has a base sequence which is, comprises or comprises a portion of: CGTGCTTCATGTAACCCTGC (SEQ ID NO: 99).

In some embodiments, an oligonucleotide targets APOC3 and has a base sequence which is, comprises or comprises a portion of: CTCAGGCAGCCACGGCT (SEQ ID NO: 100).

In some embodiments, an oligonucleotide targets APOC3 and has a base sequence which is, comprises or comprises a portion of: CTCCTGCACGCTGCTCAGTG (SEQ ID NO: 101).

In some embodiments, an oligonucleotide targets APOC3 and has a base sequence which is, comprises or comprises a portion of: CTCCTGCTTGACCACCCATT (SEQ ID NO: 102).

In some embodiments, an oligonucleotide targets APOC3 and has a base sequence which is, comprises or comprises a portion of: CTCCTTGGGTCCTGCAACTCCAGGGCTGC (SEQ ID NO: 103).

In some embodiments, an oligonucleotide targets APOC3 and has a base sequence which is, comprises or comprises a portion of: CTCGGCCTCTGAAGCTCGGG (SEQ ID NO: 104).

In some embodiments, an oligonucleotide targets APOC3 and has a base sequence which is, comprises or comprises a portion of: CTCTGAAGCTCGGGCAGAGG (SEQ ID NO: 105).

In some embodiments, an oligonucleotide targets APOC3 and has a base sequence which is, comprises or comprises a portion of: CTGAAGCCATCGGTCACCCA (SEQ ID NO: 106).

In some embodiments, an oligonucleotide targets APOC3 and has a base sequence which is, comprises or comprises a portion of: CTGCATGGCACCTCTGTTCC (SEQ ID NO: 107).

In some embodiments, an oligonucleotide targets APOC3 and has a base sequence which is, comprises or comprises a portion of: CTGCCTCTAGGGATGAACTG (SEQ ID NO: 108).

In some embodiments, an oligonucleotide targets APOC3 and has a base sequence which is, comprises or comprises a portion of: CTGCTGGGCCACCTGGGACT (SEQ ID NO: 109).

In some embodiments, an oligonucleotide targets APOC3 and has a base sequence which is, comprises or comprises a portion of: CTGCTGGGCCACCTGGGAC (SEQ ID NO: 110).

In some embodiments, an oligonucleotide targets APOC3 and has a base sequence which is, comprises or comprises a portion of: CTGGAGATTGCAGGACCC (SEQ ID NO: 111).

In some embodiments, an oligonucleotide targets APOC3 and has a base sequence which is, comprises or comprises a portion of: CTGGAGCACCGTTAAGGACAAG (SEQ ID NO: 112).

In some embodiments, an oligonucleotide targets APOC3 and has a base sequence which is, comprises or comprises a portion of: CTGGCCTGCTGGGCCACCTG (SEQ ID NO: 113).

In some embodiments, an oligonucleotide targets APOC3 and has a base sequence which is, comprises or comprises a portion of: CTGGCCTCCCAATAAAGCTGGACA (SEQ ID NO: 114).

In some embodiments, an oligonucleotide targets APOC3 and has a base sequence which is, comprises or comprises a portion of: CTGGGACTCCTGCACGCT (SEQ ID NO: 115).

In some embodiments, an oligonucleotide targets APOC3 and has a base sequence which is, comprises or comprises a portion of: CTTCAGCCGTGGCTGCCTGAGACCTCAATA (SEQ ID NO: 116).

In some embodiments, an oligonucleotide targets APOC3 and has a base sequence which is, comprises or comprises a portion of: CTTCTTGTCCAGCTTTATTG (SEQ ID NO: 117).

In some embodiments, an oligonucleotide targets APOC3 and has a base sequence which is, comprises or comprises a portion of: CTTCTTGTCCAGCTTTAT (SEQ ID NO: 118).

In some embodiments, an oligonucleotide targets APOC3 and has a base sequence which is, comprises or comprises a portion of: CTTCTTGTCCAGCTTTATT (SEQ ID NO: 119).

In some embodiments, an oligonucleotide targets APOC3 and has a base sequence which is, comprises or comprises a portion of: CTTGGCGGTCTTGGTGGCGT (SEQ ID NO: 120).

In some embodiments, an oligonucleotide targets APOC3 and has a base sequence which is, comprises or comprises a portion of: CTTGGGTCCTGCAATCTCCAGGGCT (SEQ ID NO: 121).

In some embodiments, an oligonucleotide targets APOC3 and has a base sequence which is, comprises or comprises a portion of: CTTGGTGGCGTGCTTCATG (SEQ ID NO: 122).

In some embodiments, an oligonucleotide targets APOC3 and has a base sequence which is, comprises or comprises a portion of: CTTGGTGGCGTGCTTCAT (SEQ ID NO: 123).

In some embodiments, an oligonucleotide targets APOC3 and has a base sequence which is, comprises or comprises a portion of: CTTGTCCAGCTTTATTG (SEQ ID NO: 124).

In some embodiments, an oligonucleotide targets APOC3 and has a base sequence which is, comprises or comprises a portion of: CTTGTCCAGCTTTATTGG (SEQ ID NO: 125).

In some embodiments, an oligonucleotide targets APOC3 and has a base sequence which is, comprises or comprises a portion of: CTTGTCCAGCTTTATTGGG (SEQ ID NO: 126).

In some embodiments, an oligonucleotide targets APOC3 and has a base sequence which is, comprises or comprises a portion of: CTTGTCCAGCTTTATTGGGA (SEQ ID NO: 127).

In some embodiments, an oligonucleotide targets APOC3 and has a base sequence which is, comprises or comprises a portion of: CTTGTCCTTAACGGTGCTCC (SEQ ID NO: 128).

In some embodiments, an oligonucleotide targets APOC3 and has a base sequence which is, comprises or comprises a portion of: GAAGCCATCGGTCACCCAG (SEQ ID NO: 129).

In some embodiments, an oligonucleotide targets APOC3 and has a base sequence which is, comprises or comprises a portion of: GAAGCCATCGGTCACCCA (SEQ ID NO: 130).

In some embodiments, an oligonucleotide targets APOC3 and has a base sequence which is, comprises or comprises a portion of: GAAGGGAGGCATCCTCGGCC (SEQ ID NO: 131).

In some embodiments, an oligonucleotide targets APOC3 and has a base sequence which is, comprises or comprises a portion of: GAAGTTGGTCTGACCTCAG (SEQ ID NO: 132).

In some embodiments, an oligonucleotide targets APOC3 and has a base sequence which is, comprises or comprises a portion of: GAAGTTGGTCTGACCTCA (SEQ ID NO: 133).

In some embodiments, an oligonucleotide targets APOC3 and has a base sequence which is, comprises or comprises a portion of: GACCCTGAGGTCAGACCAA (SEQ ID NO: 134).

In some embodiments, an oligonucleotide targets APOC3 and has a base sequence which is, comprises or comprises a portion of: GAGAACTCCTCTGTAGGCA (SEQ ID NO: 135).

In some embodiments, an oligonucleotide targets APOC3 and has a base sequence which is, comprises or comprises a portion of: GAGAAGGGAGGCATCCTCG (SEQ ID NO: 136).

In some embodiments, an oligonucleotide targets APOC3 and has a base sequence which is, comprises or comprises a portion of: GAGGCATCCTCGGCCTCTGA (SEQ ID NO: 137).

In some embodiments, an oligonucleotide targets APOC3 and has a base sequence which is, comprises or comprises a portion of: GAGGTCTCAGGCAGCCACG (SEQ ID NO: 138).

In some embodiments, an oligonucleotide targets APOC3 and has a base sequence which is, comprises or comprises a portion of: GAGGTCAGACCAACTTCA (SEQ ID NO: 139).

In some embodiments, an oligonucleotide targets APOC3 and has a base sequence which is, comprises or comprises a portion of: GAGGTCTCAGGCAGCCACGG (SEQ ID NO: 140).

In some embodiments, an oligonucleotide targets APOC3 and has a base sequence which is, comprises or comprises a portion of: GAGGTCTCAGGCAGCCAC (SEQ ID NO: 141).

In some embodiments, an oligonucleotide targets APOC3 and has a base sequence which is, comprises or comprises a In some embodiments, an oligonucleotide targets APOC3 and has a base sequence which is, comprises or comprises a portion of: GCACTGAGCAGCGTGCAGGAGTCCCAGGT (SEQ ID NO: 142).

In some embodiments, an oligonucleotide targets APOC3 and has a base sequence which is, comprises or comprises a portion of: GCAGCTTCTTGTCCAGCT (SEQ ID NO: 143).

In some embodiments, an oligonucleotide targets APOC3 and has a base sequence which is, comprises or comprises a portion of: GCAGCTTCTTGTCCAGCTT (SEQ ID NO: 144).

In some embodiments, an oligonucleotide targets APOC3 and has a base sequence which is, comprises or comprises a portion of: GCAGGAGTCCCAGGTGGCCCAGCAGG (SEQ ID NO: 145).

In some embodiments, an oligonucleotide targets APOC3 and has a base sequence which is, comprises or comprises a portion of: GCATCCTTGGCGGTCTTGG (SEQ ID NO: 146).

In some embodiments, an oligonucleotide targets APOC3 and has a base sequence which is, comprises or comprises a portion of: GCATCCTTGGCGGTCTTGGT (SEQ ID NO: 147).

In some embodiments, an oligonucleotide targets APOC3 and has a base sequence which is, comprises or comprises a portion of: GCATCCTTGGCGGTCTTG (SEQ ID NO: 148).

In some embodiments, an oligonucleotide targets APOC3 and has a base sequence which is, comprises or comprises a portion of: GCCACGGCTGAAGTTGGTCT (SEQ ID NO: 149).

In some embodiments, an oligonucleotide targets APOC3 and has a base sequence which is, comprises or comprises a portion of: GCCATCGGTCACCCAGCCCC (SEQ ID NO: 150).

In some embodiments, an oligonucleotide targets APOC3 and has a base sequence which is, comprises or comprises a portion of: GCCATCGGTCACCCAGCCC (SEQ ID NO: 151).

In some embodiments, an oligonucleotide targets APOC3 and has a base sequence which is, comprises or comprises a portion of: GCCCCTGGCCTGCTGGGCCA (SEQ ID NO: 152).

In some embodiments, an oligonucleotide targets APOC3 and has a base sequence which is, comprises or comprises a portion of: GCCCTGGAGATTGCAGGACC (SEQ ID NO: 153).

In some embodiments, an oligonucleotide targets APOC3 and has a base sequence which is, comprises or comprises a portion of: GCCGTGGCTGCCTGAGACCTCAAT (SEQ ID NO: 154).

In some embodiments, an oligonucleotide targets APOC3 and has a base sequence which is, comprises or comprises a portion of: GCCTGACAAAGGCCCTGTGA (SEQ ID NO: 155).

In some embodiments, an oligonucleotide targets APOC3 and has a base sequence which is, comprises or comprises a portion of: GCCTCCCAATAAAGCTGGA (SEQ ID NO: 156).

In some embodiments, an oligonucleotide targets APOC3 and has a base sequence which is, comprises or comprises a portion of: GCCTCTAGGGATGAACTGA (SEQ ID NO: 157).

In some embodiments, an oligonucleotide targets APOC3 and has a base sequence which is, comprises or comprises a portion of: GCCTCTGAAGCTCGGGCAGA (SEQ ID NO: 158).

In some embodiments, an oligonucleotide targets APOC3 and has a base sequence which is, comprises or comprises a portion of: GCGGTCTTGGTGGCGTGC (SEQ ID NO: 159).

In some embodiments, an oligonucleotide targets APOC3 and has a base sequence which is, comprises or comprises a portion of: GCGTGCTTCATGTAACCCTG (SEQ ID NO: 160).

In some embodiments, an oligonucleotide targets APOC3 and has a base sequence which is, comprises or comprises a portion of: GCTCAGTGCATCCTTGGCG (SEQ ID NO: 161).

In some embodiments, an oligonucleotide targets APOC3 and has a base sequence which is, comprises or comprises a portion of: GCTCAGTGCATCCTTGGC (SEQ ID NO: 162).

In some embodiments, an oligonucleotide targets APOC3 and has a base sequence which is, comprises or comprises a portion of: GCTCCTGCTTGACCACCCAT (SEQ ID NO: 163).

In some embodiments, an oligonucleotide targets APOC3 and has a base sequence which is, comprises or comprises a portion of: GCTGAAGTTGGTCTGACCTC (SEQ ID NO: 164).

In some embodiments, an oligonucleotide targets APOC3 and has a base sequence which is, comprises or comprises a portion of: GCTGGCCTCCCAATAAAGCTGGACAAGAAG (SEQ ID NO: 165).

In some embodiments, an oligonucleotide targets APOC3 and has a base sequence which is, comprises or comprises a portion of: GCTGGGCCACCTGGGAC (SEQ ID NO: 166).

In some embodiments, an oligonucleotide targets APOC3 and has a base sequence which is, comprises or comprises a portion of: GCTTAAAAGGGACAGTA (SEQ ID NO: 167).

In some embodiments, an oligonucleotide targets APOC3 and has a base sequence which is, comprises or comprises a portion of: GCTTAAAAGGGACAGTATT (SEQ ID NO: 168).

In some embodiments, an oligonucleotide targets APOC3 and has a base sequence which is, comprises or comprises a portion of: GCTTCAGAGGCCGAGGATG (SEQ ID NO: 169).

In some embodiments, an oligonucleotide targets APOC3 and has a base sequence which is, comprises or comprises a portion of: GCTTCTTGTCCAGCTTTA (SEQ ID NO: 170).

In some embodiments, an oligonucleotide targets APOC3 and has a base sequence which is, comprises or comprises a portion of: GCTTCTTGTCCAGCTTT (SEQ ID NO: 171).

In some embodiments, an oligonucleotide targets APOC3 and has a base sequence which is, comprises or comprises a portion of: GCTTCTTGTCCAGCTTTAT (SEQ ID NO: 172).

In some embodiments, an oligonucleotide targets APOC3 and has a base sequence which is, comprises or comprises a portion of: GGACTCCTGCACGCTGCTCA (SEQ ID NO: 173).

In some embodiments, an oligonucleotide targets APOC3 and has a base sequence which is, comprises or comprises a portion of: GGAGCACCGTTAAGGACAAGT (SEQ ID NO: 174).

In some embodiments, an oligonucleotide targets APOC3 and has a base sequence which is, comprises or comprises a portion of: GGAGCAGCTGCCTCTAGGG (SEQ ID NO: 175).

In some embodiments, an oligonucleotide targets APOC3 and has a base sequence which is, comprises or comprises a portion of: GGAGCAGCTGCCTCTAGGGA (SEQ ID NO: 176).

In some embodiments, an oligonucleotide targets APOC3 and has a base sequence which is, comprises or comprises a portion of: GGAGGCATCCTCGGCCTCTG (SEQ ID NO: 177).

In some embodiments, an oligonucleotide targets APOC3 and has a base sequence which is, comprises or comprises a portion of: GGAGTCCCAGGTGGCCCAGCAGGC (SEQ ID NO: 178).

In some embodiments, an oligonucleotide targets APOC3 and has a base sequence which is, comprises or comprises a portion of: GGCAGAGGCCAGGAGCGCCA (SEQ ID NO: 179).

In some embodiments, an oligonucleotide targets APOC3 and has a base sequence which is, comprises or comprises a portion of: GGCATCCTCGGCCTCTGAAG (SEQ ID NO: 180).

In some embodiments, an oligonucleotide targets APOC3 and has a base sequence which is, comprises or comprises a portion of: GGCCAGGGGCTGGGTGACC-GATGGCTTCAG (SEQ ID NO: 181).

In some embodiments, an oligonucleotide targets APOC3 and has a base sequence which is, comprises or comprises a portion of: GGCCAGGGGCTGGGTGACC-GATGGCTTCAGT (SEQ ID NO: 182).

In some embodiments, an oligonucleotide targets APOC3 and has a base sequence which is, comprises or comprises a portion of: GGCCTCCCAATAAAGCTGGACA (SEQ ID NO: 183).

In some embodiments, an oligonucleotide targets APOC3 and has a base sequence which is, comprises or comprises a portion of: GGCCTCCCAATAAAGCTGGACAAG (SEQ ID NO: 184).

In some embodiments, an oligonucleotide targets APOC3 and has a base sequence which is, comprises or comprises a portion of: GGCCTCCCAATAAAGCTGGACAAGAA (SEQ ID NO: 185).

In some embodiments, an oligonucleotide targets APOC3 and has a base sequence which is, comprises or comprises a portion of: GGCGGTCTTGGTGGCGTGC (SEQ ID NO: 186).

In some embodiments, an oligonucleotide targets APOC3 and has a base sequence which is, comprises or comprises a portion of: GGCGGTCTTGGTGGCGTGCT (SEQ ID NO: 187).

In some embodiments, an oligonucleotide targets APOC3 and has a base sequence which is, comprises or comprises a portion of: GGCTGGGTGACCGATGGCTTCAGT (SEQ ID NO: 188).

In some embodiments, an oligonucleotide targets APOC3 and has a base sequence which is, comprises or comprises a portion of: GGGACAGTATTCTCAGTGA (SEQ ID NO: 189).

In some embodiments, an oligonucleotide targets APOC3 and has a base sequence which is, comprises or comprises a portion of: GGGACTCCTGCACGCTGCT (SEQ ID NO: 190).

In some embodiments, an oligonucleotide targets APOC3 and has a base sequence which is, comprises or comprises a portion of: GGGACTCCTGCACGCTGCTC (SEQ ID NO: 191).

In some embodiments, an oligonucleotide targets APOC3 and has a base sequence which is, comprises or comprises a portion of: GGGAGGCATCCTCGGCCTCT (SEQ ID NO: 192).

In some embodiments, an oligonucleotide targets APOC3 and has a base sequence which is, comprises or comprises a portion of: GGGCCTCCCAAGGCAAACCC (SEQ ID NO: 193).

In some embodiments, an oligonucleotide targets APOC3 and has a base sequence which is, comprises or comprises a portion of: GGGCTCCTGCTTGACCACC (SEQ ID NO: 194).

In some embodiments, an oligonucleotide targets APOC3 and has a base sequence which is, comprises or comprises a portion of: GGGCTGCATGGCACCTCTGT (SEQ ID NO: 195).

In some embodiments, an oligonucleotide targets APOC3 and has a base sequence which is, comprises or comprises a portion of: GGGCTGGGTGACCGATGGC (SEQ ID NO: 196).

In some embodiments, an oligonucleotide targets APOC3 and has a base sequence which is, comprises or comprises a portion of: GGTCTGACCTCAGGGTCCA (SEQ ID NO: 197).

In some embodiments, an oligonucleotide targets APOC3 and has a base sequence which is, comprises or comprises a portion of: GGTCTCAGGCAGCCACGG (SEQ ID NO: 198).

In some embodiments, an oligonucleotide targets APOC3 and has a base sequence which is, comprises or comprises a portion of: GGTCTTGGTGGCGTGCTTCA (SEQ ID NO: 199).

In some embodiments, an oligonucleotide targets APOC3 and has a base sequence which is, comprises or comprises a portion of: GTCCAGCTTTATTGGGAGG (SEQ ID NO: 200).

In some embodiments, an oligonucleotide targets APOC3 and has a base sequence which is, comprises or comprises a portion of: GTCCAGCTTATTGGGAGGC (SEQ ID NO: 201).

In some embodiments, an oligonucleotide targets APOC3 and has a base sequence which is, comprises or comprises a portion of: GTCCAGCTTTATTG (SEQ ID NO: 202).

In some embodiments, an oligonucleotide targets APOC3 and has a base sequence which is, comprises or comprises a portion of: GTCCAGCTTTATTGGG (SEQ ID NO: 203).

In some embodiments, an oligonucleotide targets APOC3 and has a base sequence which is, comprises or comprises a portion of: GTCCAGCTTTATTGGGA (SEQ ID NO: 204).

In some embodiments, an oligonucleotide targets APOC3 and has a base sequence which is, comprises or comprises a portion of: GTCCAGCTTTATTGGGAG (SEQ ID NO: 205).

In some embodiments, an oligonucleotide targets APOC3 and has a base sequence which is, comprises or comprises a portion of: GTCCAGCTTTATTGGGAGGC (SEQ ID NO: 206).

In some embodiments, an oligonucleotide targets APOC3 and has a base sequence which is, comprises or comprises a portion of: GTCCAGCTTTATTGGGAGGCCA (SEQ ID NO: 207).

In some embodiments, an oligonucleotide targets APOC3 and has a base sequence which is, comprises or comprises a portion of: GTCCAGCTTTATTGGGAGGCCT (SEQ ID NO: 208).

In some embodiments, an oligonucleotide targets APOC3 and has a base sequence which is, comprises or comprises a portion of: GTCCAGCTTTATTGGGAT (SEQ ID NO: 209).

In some embodiments, an oligonucleotide targets APOC3 and has a base sequence which is, comprises or comprises a portion of: GTCCCAGGTGGCCCAGCAG (SEQ ID NO: 210).

In some embodiments, an oligonucleotide targets APOC3 and has a base sequence which is, comprises or comprises a portion of: GTCTCAGGCAGCCACGGCTG (SEQ ID NO: 211).

In some embodiments, an oligonucleotide targets APOC3 and has a base sequence which is, comprises or comprises a portion of: GTCTTGGTGGCGTGCTTCAT (SEQ ID NO: 212).

In some embodiments, an oligonucleotide targets APOC3 and has a base sequence which is, comprises or comprises a portion of: GTGCAGGAGTCCCAGGTGG (SEQ ID NO: 213).

In some embodiments, an oligonucleotide targets APOC3 and has a base sequence which is, comprises or comprises a portion of: GTGCATCCTTGGCGGTCTTG (SEQ ID NO: 214).

In some embodiments, an oligonucleotide targets APOC3 and has a base sequence which is, comprises or comprises a portion of: GTGCATCCTTGGCGGTCTT (SEQ ID NO: 215).

In some embodiments, an oligonucleotide targets APOC3 and has a base sequence which is, comprises or comprises a portion of: GTTCCTGGAGCAGCTGCCT (SEQ ID NO: 216).

In some embodiments, an oligonucleotide targets APOC3 and has a base sequence which is, comprises or comprises a portion of: GTTGCTTAAAAGGGACAGTATTCTC (SEQ ID NO: 217).

In some embodiments, an oligonucleotide targets APOC3 and has a base sequence which is, comprises or comprises a portion of: GTTTATGCCCCTGGGCCTGA (SEQ ID NO: 218).

In some embodiments, an oligonucleotide targets APOC3 and has a base sequence which is, comprises or comprises a portion of: TCTTGTCCAGCTTTATTGG (SEQ ID NO: 219).

In some embodiments, an oligonucleotide targets APOC3 and has a base sequence which is, comprises or comprises a portion of: TCTTGTCCAGCTTTATT (SEQ ID NO: 220).

In some embodiments, an oligonucleotide targets APOC3 and has a base sequence which is, comprises or comprises a portion of: TCTTGTCCAGCTTTATTG (SEQ ID NO: 221).

In some embodiments, an oligonucleotide targets APOC3 and has a base sequence which is, comprises or comprises a portion of: TGGCGGTCTTGGTGGCGTG (SEQ ID NO: 222).

In some embodiments, an oligonucleotide targets APOC3 and has a base sequence which is, comprises or comprises a portion of: TGGGTCCTGCAATCTCCAGGGCT (SEQ ID NO: 223).

In some embodiments, an oligonucleotide targets APOC3 and has a base sequence which is, comprises or comprises a portion of: TGGTCTGACCTCAGGGTCC (SEQ ID NO: 224).

In some embodiments, an oligonucleotide targets APOC3 and has a base sequence which is, comprises or comprises a portion of: TGGTCTGACCTCAGGGTC (SEQ ID NO: 225).

In some embodiments, an oligonucleotide targets APOC3 and has a base sequence which is, comprises or comprises a portion of: TGGTGGCGTGCTTCATGTA (SEQ ID NO: 226).

In some embodiments, an oligonucleotide targets APOC3 and has a base sequence which is, comprises or comprises a portion of: TGTCCAGCTTTATTGGG (SEQ ID NO: 227).

In some embodiments, an oligonucleotide targets APOC3 and has a base sequence which is, comprises or comprises a portion of: TGTCCAGCTTTATTGGGA (SEQ ID NO: 228).

In some embodiments, an oligonucleotide targets APOC3 and has a base sequence which is, comprises or comprises a portion of: TGTCCAGCTTTATTGGGAG (SEQ ID NO: 229).

In some embodiments, an oligonucleotide targets APOC3 and has a base sequence which is, comprises or comprises a portion of: TGTCCTTAACGGTGCTC (SEQ ID NO: 230).

In some embodiments, an oligonucleotide targets PNPLA3 and has a base sequence which is, comprises or comprises a portion of: AAAGGCATGAAGCAGGAA (SEQ ID NO: 231).

In some embodiments, an oligonucleotide targets PNPLA3 and has a base sequence which is, comprises or comprises a portion of: AAAGGCATGAAGCAGGAACA (SEQ ID NO: 232).

In some embodiments, an oligonucleotide targets PNPLA3 and has a base sequence which is, comprises or comprises a portion of: AACGTCTCCATGGCGGGGGTAACAAGA (SEQ ID NO: 233).

In some embodiments, an oligonucleotide targets PNPLA3 and has a base sequence which is, comprises or comprises a portion of: AAGGCATGAAGCAGGAAC (SEQ ID NO: 234).

In some embodiments, an oligonucleotide targets PNPLA3 and has a base sequence which is, comprises or comprises a portion of: AAGGCATGAAGCAGGAACAT (SEQ ID NO: 235).

In some embodiments, an oligonucleotide targets PNPLA3 and has a base sequence which is, comprises or comprises a portion of: AAGGCCACTGTAGAAAGGCATGAA (SEQ ID NO: 236).

In some embodiments, an oligonucleotide targets PNPLA3 and has a base sequence which is, comprises or comprises a portion of: AAGGCCACTGTAGAAAGGCATGAAG (SEQ ID NO: 237).

In some embodiments, an oligonucleotide targets PNPLA3 and has a base sequence which is, comprises or comprises a portion of: AAGGCCACTGTAGAAAG (SEQ ID NO: 238).

In some embodiments, an oligonucleotide targets PNPLA3 and has a base sequence which is, comprises or comprises a portion of: AAGGCCACTGTAGAAAGG (SEQ ID NO: 239).

In some embodiments, an oligonucleotide targets PNPLA3 and has a base sequence which is, comprises or comprises a portion of: AAGGCCACTGTAGAAAGGC (SEQ ID NO: 240).

In some embodiments, an oligonucleotide targets PNPLA3 and has a base sequence which is, comprises or comprises a portion of: AAGGCCACTGTAGAAAGGCA (SEQ ID NO: 241).

In some embodiments, an oligonucleotide targets PNPLA3 and has a base sequence which is, comprises or comprises a portion of: AAGGGACCCTCTGCACTGGG (SEQ ID NO: 242).

In some embodiments, an oligonucleotide targets PNPLA3 and has a base sequence which is, comprises or comprises a portion of: AAGGGCATGAAGCAGGAACA (SEQ ID NO: 243).

In some embodiments, an oligonucleotide targets PNPLA3 and has a base sequence which is, comprises or comprises a portion of: ACCCCCGCCATGGAGACGT (SEQ ID NO: 244).

In some embodiments, an oligonucleotide targets PNPLA3 and has a base sequence which is, comprises or comprises a portion of: ACCCCCGCCATGGAGACG (SEQ ID NO: 245).

In some embodiments, an oligonucleotide targets PNPLA3 and has a base sequence which is, comprises or comprises a portion of: ACCCCCGCCATGGAGACGTT (SEQ ID NO: 246).

In some embodiments, an oligonucleotide targets PNPLA3 and has a base sequence which is, comprises or comprises a portion of: ACCCCGCGGTCCATCCTCAGGTCCAGC (SEQ ID NO: 247).

In some embodiments, an oligonucleotide targets PNPLA3 and has a base sequence which is, comprises or comprises a portion of: ACCCTGCCTCAGTGTCTCG (SEQ ID NO: 248).

In some embodiments, an oligonucleotide targets PNPLA3 and has a base sequence which is, comprises or comprises a portion of: ACCTGAGGATGGACCGCG (SEQ ID NO: 249).

In some embodiments, an oligonucleotide targets PNPLA3 and has a base sequence which is, comprises or comprises a portion of: ACCTGAGGATGGACCGCGGG (SEQ ID NO: 250).

In some embodiments, an oligonucleotide targets PNPLA3 and has a base sequence which is, comprises or comprises a portion of: ACGTTGTCACTCACTCCTCC (SEQ ID NO: 251).

In some embodiments, an oligonucleotide targets PNPLA3 and has a base sequence which is, comprises or comprises a portion of: ACTGTAGAAAGGCATGAAGCAGGAA (SEQ ID NO: 252).

In some embodiments, an oligonucleotide targets PNPLA3 and has a base sequence which is, comprises or comprises a portion of: ACTGTAGAAAGGCATGAA (SEQ ID NO: 253).

In some embodiments, an oligonucleotide targets PNPLA3 and has a base sequence which is, comprises or comprises a portion of: ACTGTAGAAAGGCATGAAGC (SEQ ID NO: 254).

In some embodiments, an oligonucleotide targets PNPLA3 and has a base sequence which is, comprises or comprises a portion of: AGAAAGGCATGAAGCAGGA (SEQ ID NO: 255).

In some embodiments, an oligonucleotide targets PNPLA3 and has a base sequence which is, comprises or comprises a portion of: AGAAAGGCATGAAGCAGGAA (SEQ ID NO: 256).

In some embodiments, an oligonucleotide targets PNPLA3 and has a base sequence which is, comprises or comprises a portion of: AGAAAGGCATGAAGCAGGAACATA (SEQ ID NO: 257).

In some embodiments, an oligonucleotide targets PNPLA3 and has a base sequence which is, comprises or comprises a portion of: AGAAAGGCATGAAGCAG (SEQ ID NO: 258).

In some embodiments, an oligonucleotide targets PNPLA3 and has a base sequence which is, comprises or comprises a portion of: AGAAAGGCATGAAGCAGG (SEQ ID NO: 259).

In some embodiments, an oligonucleotide targets PNPLA3 and has a base sequence which is, comprises or comprises a portion of: AAATGCCTTTCTACAGTGGCA (SEQ ID NO: 260).

In some embodiments, an oligonucleotide targets PNPLA3 and has a base sequence which is, comprises or comprises a portion of: AATCATGCCTTTCTACAGTGGCA (SEQ ID NO: 261).

In some embodiments, an oligonucleotide targets PNPLA3 and has a base sequence which is, comprises or comprises a portion of: ACATGGGCCAGCCTACCCCC (SEQ ID NO: 262).

In some embodiments, an oligonucleotide targets PNPLA3 and has a base sequence which is, comprises or comprises a portion of: ACCTGTGAGGTCACCCACTG (SEQ ID NO: 263).

In some embodiments, an oligonucleotide targets PNPLA3 and has a base sequence which is, comprises or comprises a portion of: ATCTTGTTACCCCCGCCATG (SEQ ID NO: 264).

In some embodiments, an oligonucleotide targets PNPLA3 and has a base sequence which is, comprises or comprises a portion of: ATGCCTTTCTACAGTGGCA (SEQ ID NO: 265).

In some embodiments, an oligonucleotide targets PNPLA3 and has a base sequence which is, comprises or comprises a portion of: GCCACTGTAGAAAGGCATGATT (SEQ ID NO: 266).

In some embodiments, an oligonucleotide targets PNPLA3 and has a base sequence which is, comprises or comprises a portion of: GCCACTGTAGAAAGGCATTT (SEQ ID NO: 267).

In some embodiments, an oligonucleotide targets PNPLA3 and has a base sequence which is, comprises or comprises a portion of: TGCCACTGTAGAAAGGCATGATT (SEQ ID NO: 268).

In some embodiments, an oligonucleotide targets PNPLA3 and has a base sequence which is, comprises or comprises a portion of: TCATGCCTTTCTACAGTGGCA (SEQ ID NO: 269).

In some embodiments, an oligonucleotide targets PNPLA3 and has a base sequence which is, comprises or comprises a portion of: TGCCACTGTAGAAAGGCATTT (SEQ ID NO: 270).

In some embodiments, an oligonucleotide targets PNPLA3 and has a base sequence which is, comprises or comprises a portion of: AGAGGCTGGGATCCTCCACG (SEQ ID NO: 271).

In some embodiments, an oligonucleotide targets PNPLA3 and has a base sequence which is, comprises or comprises a portion of: AGCCACTGTAGAAAGGCATGA (SEQ ID NO: 272).

In some embodiments, an oligonucleotide targets PNPLA3 and has a base sequence which is, comprises or comprises a portion of: AGCGAGCCTGGGCGAGAGGG (SEQ ID NO: 273).

In some embodiments, an oligonucleotide targets PNPLA3 and has a base sequence which is, comprises or comprises a portion of: AGCGCTCTCTACCCTGCCTC (SEQ ID NO: 274).

In some embodiments, an oligonucleotide targets PNPLA3 and has a base sequence which is, comprises or comprises a portion of: AGCTGGTGGACATTGGCCGG (SEQ ID NO: 275).

In some embodiments, an oligonucleotide targets PNPLA3 and has a base sequence which is, comprises or comprises a portion of: AGGCATGAAGCAGGAACA (SEQ ID NO: 276).

In some embodiments, an oligonucleotide targets PNPLA3 and has a base sequence which is, comprises or comprises a portion of: AGGCATGAAGCAGGAACATA (SEQ ID NO: 277).

In some embodiments, an oligonucleotide targets PNPLA3 and has a base sequence which is, comprises or comprises a portion of: AGGCCACTGTAGAAAGGCATGAAGC (SEQ ID NO: 278).

In some embodiments, an oligonucleotide targets PNPLA3 and has a base sequence which is, comprises or comprises a portion of: AGGCCACTGTAGAAAGGC (SEQ ID NO: 279).

In some embodiments, an oligonucleotide targets PNPLA3 and has a base sequence which is, comprises or comprises a portion of: AGGCCACTGTAGAAAGGCAT (SEQ ID NO: 280).

In some embodiments, an oligonucleotide targets PNPLA3 and has a base sequence which is, comprises or comprises a portion of: AGGCTGGGATCCTCCACGTC (SEQ ID NO: 281).

In some embodiments, an oligonucleotide targets PNPLA3 and has a base sequence which is, comprises or comprises a portion of: AGGGACCCTCTGCACTGGGC (SEQ ID NO: 282).

In some embodiments, an oligonucleotide targets PNPLA3 and has a base sequence which is, comprises or comprises a portion of: ATAAGGCCACTGTAGAAAGG (SEQ ID NO: 283).

In some embodiments, an oligonucleotide targets PNPLA3 and has a base sequence which is, comprises or comprises a portion of: ATAAGGCCACTGTAGAAA (SEQ ID NO: 284).

In some embodiments, an oligonucleotide targets PNPLA3 and has a base sequence which is, comprises or comprises a portion of: ATCTTGTTACCCCCGCCATG (SEQ ID NO: 285).

In some embodiments, an oligonucleotide targets PNPLA3 and has a base sequence which is, comprises or comprises a portion of: ATGACACCAGGAAGCCCAGTGCAGAGG (SEQ ID NO: 286).

In some embodiments, an oligonucleotide targets PNPLA3 and has a base sequence which is, comprises or comprises a portion of: ATGTTCCGACTCCTGGCC (SEQ ID NO: 287).

In some embodiments, an oligonucleotide targets PNPLA3 and has a base sequence which is, comprises or comprises a portion of: ATTTGGGACCTGGAGGCGGG (SEQ ID NO: 288).

In some embodiments, an oligonucleotide targets PNPLA3 and has a base sequence which is, comprises or comprises a portion of: CACATGGGCCAGCCTACCCC (SEQ ID NO: 289).

In some embodiments, an oligonucleotide targets PNPLA3 and has a base sequence which is, comprises or comprises a portion of: CACCCCTTCCCACAGCATGG (SEQ ID NO: 290).

In some embodiments, an oligonucleotide targets PNPLA3 and has a base sequence which is, comprises or comprises a portion of: CACTGTAGAAAGGCATGAAGCAGGA (SEQ ID NO: 291).

In some embodiments, an oligonucleotide targets PNPLA3 and has a base sequence which is, comprises or comprises a portion of: CACTGTAGAAAGGCATGA (SEQ ID NO: 292).

In some embodiments, an oligonucleotide targets PNPLA3 and has a base sequence which is, comprises or comprises a portion of: CACTGTAGAAAGGCATGAAG (SEQ ID NO: 293).

In some embodiments, an oligonucleotide targets PNPLA3 and has a base sequence which is, comprises or comprises a portion of: CATGAAGCAGGAACATAC (SEQ ID NO: 294).

In some embodiments, an oligonucleotide targets PNPLA3 and has a base sequence which is, comprises or comprises a portion of: CATGAAGCAGGAACATACCA (SEQ ID NO: 295).

In some embodiments, an oligonucleotide targets PNPLA3 and has a base sequence which is, comprises or comprises a portion of: CCACTGTAGAAAGGCATGAAGCAGG (SEQ ID NO: 296).

In some embodiments, an oligonucleotide targets PNPLA3 and has a base sequence which is, comprises or comprises a portion of: CCACTGTAGAAAGGCATG (SEQ ID NO: 297).

In some embodiments, an oligonucleotide targets PNPLA3 and has a base sequence which is, comprises or comprises a portion of: CCACTGTAGAAAGGCATGAA (SEQ ID NO: 298).

In some embodiments, an oligonucleotide targets PNPLA3 and has a base sequence which is, comprises or comprises a portion of: CCAGCACCTTGAGATCCGGG (SEQ ID NO: 299).

In some embodiments, an oligonucleotide targets PNPLA3 and has a base sequence which is, comprises or comprises a portion of: CCCAGCACCTTGAGATCCGG (SEQ ID NO: 300).

In some embodiments, an oligonucleotide targets PNPLA3 and has a base sequence which is, comprises or comprises a portion of: CCCCCAGGCAGGAGCCAAGCACAGCAG (SEQ ID NO: 301).

In some embodiments, an oligonucleotide targets PNPLA3 and has a base sequence which is, comprises or comprises a portion of: CCCCCGCCATGGAGACGT (SEQ ID NO: 302).

In some embodiments, an oligonucleotide targets PNPLA3 and has a base sequence which is, comprises or comprises a portion of: CCCCCGCCATGGAGACGTTT (SEQ ID NO: 303).

In some embodiments, an oligonucleotide targets PNPLA3 and has a base sequence which is, comprises or comprises a portion of: CCCCGCCATGGAGACGTT (SEQ ID NO: 304).

In some embodiments, an oligonucleotide targets PNPLA3 and has a base sequence which is, comprises or comprises a portion of: CCCTGCCTCAGTGTCTCGGC (SEQ ID NO: 305).

In some embodiments, an oligonucleotide targets PNPLA3 and has a base sequence which is, comprises or comprises a portion of: CCGACTCCTGGCCTTCCGCA (SEQ ID NO: 306).

In some embodiments, an oligonucleotide targets PNPLA3 and has a base sequence which is, comprises or comprises a portion of: CCGACTCCTGGCCTTCCGC (SEQ ID NO: 307).

In some embodiments, an oligonucleotide targets PNPLA3 and has a base sequence which is, comprises or comprises a portion of: CCTCAGTGTCTCGGCCAGGG (SEQ ID NO: 308).

In some embodiments, an oligonucleotide targets PNPLA3 and has a base sequence which is, comprises or comprises a portion of: CCTGAGGATGGACCGCGGGG (SEQ ID NO: 309).

In some embodiments, an oligonucleotide targets PNPLA3 and has a base sequence which is, comprises or comprises a portion of: CCTGCCTCAGTGTCTCGGCC (SEQ ID NO: 310).

In some embodiments, an oligonucleotide targets PNPLA3 and has a base sequence which is, comprises or comprises a portion of: CCTGCTGTGCTTGGCTCCT (SEQ ID NO: 311).

In some embodiments, an oligonucleotide targets PNPLA3 and has a base sequence which is, comprises or comprises a portion of: CCTGCTGTGCTTGGCTCCTG (SEQ ID NO: 312).

In some embodiments, an oligonucleotide targets PNPLA3 and has a base sequence which is, comprises or comprises a portion of: CCTGGGCGAGAGGGTGTCCA (SEQ ID NO: 313).

In some embodiments, an oligonucleotide targets PNPLA3 and has a base sequence which is, comprises or comprises a portion of: CCTGTGAGGTCACCCACTGC (SEQ ID NO: 314).

In some embodiments, an oligonucleotide targets PNPLA3 and has a base sequence which is, comprises or comprises a portion of: CCTGTTGGCTGCTCACTGGC (SEQ ID NO: 315).

In some embodiments, an oligonucleotide targets PNPLA3 and has a base sequence which is, comprises or comprises a portion of: CGAACTGCACCCCTTCCCAC (SEQ ID NO: 316).

In some embodiments, an oligonucleotide targets PNPLA3 and has a base sequence which is, comprises or comprises a portion of: CGACCTCAGGATCCATCCCT (SEQ ID NO: 317).

In some embodiments, an oligonucleotide targets PNPLA3 and has a base sequence which is, comprises or comprises a portion of: CGACTCCTGGCCTTCCGCAC (SEQ ID NO: 318).

In some embodiments, an oligonucleotide targets PNPLA3 and has a base sequence which is, comprises or comprises a portion of: CGCCACTGTAGAAAGGCATGA (SEQ ID NO: 319).

In some embodiments, an oligonucleotide targets PNPLA3 and has a base sequence which is, comprises or comprises a portion of: CGGCCAGGGCATTCCCAGCG (SEQ ID NO: 320).

In some embodiments, an oligonucleotide targets PNPLA3 and has a base sequence which is, comprises or comprises a portion of: CTCAGAGGCTGGGATCCTCC (SEQ ID NO: 321).

In some embodiments, an oligonucleotide targets PNPLA3 and has a base sequence which is, comprises or comprises a portion of: CTCAGGCAGCGGGTCGCCCC (SEQ ID NO: 322).

In some embodiments, an oligonucleotide targets PNPLA3 and has a base sequence which is, comprises or comprises a portion of: CTCCTGCTGTGCTTGGCTCC (SEQ ID NO: 323).

In some embodiments, an oligonucleotide targets PNPLA3 and has a base sequence which is, comprises or comprises a portion of: CTCGGCCAGGGCATTCCCA (SEQ ID NO: 324).

In some embodiments, an oligonucleotide targets PNPLA3 and has a base sequence which is, comprises or comprises a portion of: CTCTGCTGGACAGCCCTTGG (SEQ ID NO: 325).

In some embodiments, an oligonucleotide targets PNPLA3 and has a base sequence which is, comprises or comprises a portion of: CTGAGGATGGACCGCGGG (SEQ ID NO: 326).

In some embodiments, an oligonucleotide targets PNPLA3 and has a base sequence which is, comprises or comprises a portion of: CTGCACTGGGCTTCCTGGT (SEQ ID NO: 327).

In some embodiments, an oligonucleotide targets PNPLA3 and has a base sequence which is, comprises or comprises a portion of: CTGCACTGGGCTTCCTGGTG (SEQ ID NO: 328).

In some embodiments, an oligonucleotide targets PNPLA3 and has a base sequence which is, comprises or comprises a portion of: CTGCCTCAGTGTCTCGGCCA (SEQ ID NO: 329).

In some embodiments, an oligonucleotide targets PNPLA3 and has a base sequence which is, comprises or comprises a portion of: CTGCTAGACTCGCCTCCTC (SEQ ID NO: 330).

In some embodiments, an oligonucleotide targets PNPLA3 and has a base sequence which is, comprises or comprises a portion of: CTGCTCCAGCGGGATACCG (SEQ ID NO: 331).

In some embodiments, an oligonucleotide targets PNPLA3 and has a base sequence which is, comprises or comprises a portion of: CTGCTCCAGCGGGATACCGG (SEQ ID NO: 332).

In some embodiments, an oligonucleotide targets PNPLA3 and has a base sequence which is, comprises or comprises a portion of: CTGCTGGACAGCCCTTGGG (SEQ ID NO: 333).

In some embodiments, an oligonucleotide targets PNPLA3 and has a base sequence which is, comprises or comprises a portion of: CTGCTGGACAGCCCTTGGGG (SEQ ID NO: 334).

In some embodiments, an oligonucleotide targets PNPLA3 and has a base sequence which is, comprises or comprises a portion of: CTGCTGTGCTTGGCTCCTGC (SEQ ID NO: 335).

In some embodiments, an oligonucleotide targets PNPLA3 and has a base sequence which is, comprises or comprises a portion of: CTGGACCTGAGGATGGACCG (SEQ ID NO: 336).

In some embodiments, an oligonucleotide targets PNPLA3 and has a base sequence which is, comprises or comprises a portion of: CTGGGCATGGCGACCTCAGG (SEQ ID NO: 337).

In some embodiments, an oligonucleotide targets PNPLA3 and has a base sequence which is, comprises or comprises a portion of: CTGGTGGACATTGGCCGGGA (SEQ ID NO: 338).

In some embodiments, an oligonucleotide targets PNPLA3 and has a base sequence which is, comprises or comprises a portion of: CTGTAGAAAGGCATGAAGCA (SEQ ID NO: 339).

In some embodiments, an oligonucleotide targets PNPLA3 and has a base sequence which is, comprises or In some embodiments, an oligonucleotide targets PNPLA3 and has a base sequence which is, comprises or comprises a portion of: CTGTAGAAAGGCAT-GAAGCAGGAAC (SEQ ID NO: 340).

In some embodiments, an oligonucleotide targets PNPLA3 and has a base sequence which is, comprises or comprises a portion of: CTGTAGAAAGGCATGAAG (SEQ ID NO: 341).

In some embodiments, an oligonucleotide targets PNPLA3 and has a base sequence which is, comprises or comprises a portion of: CTGTAGAAAGGCATGAAGCA (SEQ ID NO: 342).

In some embodiments, an oligonucleotide targets PNPLA3 and has a base sequence which is, comprises or comprises a portion of: CTGTTGGCTGCTCACTGGCA (SEQ ID NO: 343).

In some embodiments, an oligonucleotide targets PNPLA3 and has a base sequence which is, comprises or comprises a portion of: CTTGTTACCCCCGCCATGG (SEQ ID NO: 344).

In some embodiments, an oligonucleotide targets PNPLA3 and has a base sequence which is, comprises or comprises a portion of: CTTGTTACCCCCGCCATGGA (SEQ ID NO: 345).

In some embodiments, an oligonucleotide targets PNPLA3 and has a base sequence which is, comprises or comprises a portion of: GAAAGGCATGAAGCAGGA (SEQ ID NO: 346).

In some embodiments, an oligonucleotide targets PNPLA3 and has a base sequence which is, comprises or comprises a portion of: GAAAGGCATGAAGCAGGAAC (SEQ ID NO: 347).

In some embodiments, an oligonucleotide targets PNPLA3 and has a base sequence which is, comprises or comprises a portion of: GAAGCCCAGTGCAGAGGGTCCCTTACT (SEQ ID NO: 348).

In some embodiments, an oligonucleotide targets PNPLA3 and has a base sequence which is, comprises or comprises a portion of: GAAGGGCATGAAGCAGGAAC (SEQ ID NO: 349).

In some embodiments, an oligonucleotide targets PNPLA3 and has a base sequence which is, comprises or comprises a portion of: GACCCTCTGCACTGGGCTTC (SEQ ID NO: 350).

In some embodiments, an oligonucleotide targets PNPLA3 and has a base sequence which is, comprises or comprises a portion of: GACCCTCTGCACTGGGCT (SEQ ID NO: 351).

In some embodiments, an oligonucleotide targets PNPLA3 and has a base sequence which is, comprises or comprises a portion of: GACCTGAGGATGGACCGC (SEQ ID NO: 352).

In some embodiments, an oligonucleotide targets PNPLA3 and has a base sequence which is, comprises or comprises a portion of: GACCTGAGGATGGACCGCGG (SEQ ID NO: 353).

In some embodiments, an oligonucleotide targets PNPLA3 and has a base sequence which is, comprises or comprises a portion of: GACGAACTGCACCCCTTCCC (SEQ ID NO: 354).

In some embodiments, an oligonucleotide targets PNPLA3 and has a base sequence which is, comprises or comprises a portion of: GACTCCTGGCCTTCCGCACA (SEQ ID NO: 355).

In some embodiments, an oligonucleotide targets PNPLA3 and has a base sequence which is, comprises or comprises a portion of: GATAAGGCCACTGTAGAAAG (SEQ ID NO: 356).

In some embodiments, an oligonucleotide targets PNPLA3 and has a base sequence which is, comprises or comprises a portion of: GCACTGGGCTTCCTGGTGT (SEQ ID NO: 357).

In some embodiments, an oligonucleotide targets PNPLA3 and has a base sequence which is, comprises or comprises a portion of: GCAGAGACCCTGTCGGAGG (SEQ ID NO: 358).

In some embodiments, an oligonucleotide targets PNPLA3 and has a base sequence which is, comprises or comprises a portion of: GCATGAAGCAGGAACATACC (SEQ ID NO: 359).

In some embodiments, an oligonucleotide targets PNPLA3 and has a base sequence which is, comprises or comprises a portion of: GCATGAAGCAGGAACATA (SEQ ID NO: 360).

In some embodiments, an oligonucleotide targets PNPLA3 and has a base sequence which is, comprises or comprises a portion of: GCCACTGTAGAAAGGCATGA (SEQ ID NO: 361).

In some embodiments, an oligonucleotide targets PNPLA3 and has a base sequence which is, comprises or comprises a portion of: GCCACTGTAGAAAGGCAT-GAAGCAG (SEQ ID NO: 362).

In some embodiments, an oligonucleotide targets PNPLA3 and has a base sequence which is, comprises or comprises a portion of: GCCACTGTAGAAAGGCATGA (SEQ ID NO: 363).

In some embodiments, an oligonucleotide targets PNPLA3 and has a base sequence which is, comprises or comprises a portion of: GCCACTGTAGAAACGCAT (SEQ ID NO: 364).

In some embodiments, an oligonucleotide targets PNPLA3 and has a base sequence which is, comprises or comprises a portion of: GCCACTGTAGAAAGCCAT (SEQ ID NO: 365).

In some embodiments, an oligonucleotide targets PNPLA3 and has a base sequence which is, comprises or comprises a portion of: GCCACTGTAGAAAGCCATGA (SEQ ID NO: 366).

In some embodiments, an oligonucleotide targets PNPLA3 and has a base sequence which is, comprises or comprises a portion of: GCCACTGTAGAAAGGAATGA (SEQ ID NO: 367).

In some embodiments, an oligonucleotide targets PNPLA3 and has a base sequence which is, comprises or comprises a portion of: GCCACTGTAGAAAGGC (SEQ ID NO: 368).

In some embodiments, an oligonucleotide targets PNPLA3 and has a base sequence which is, comprises or comprises a portion of: GCCACTGTAGAAAGGCA (SEQ ID NO: 369).

In some embodiments, an oligonucleotide targets PNPLA3 and has a base sequence which is, comprises or comprises a portion of: GCCACTGTAGAAAGGCAA (SEQ ID NO: 370).

In some embodiments, an oligonucleotide targets PNPLA3 and has a base sequence which is, comprises or comprises a portion of: GCCACTGTAGAAAGGCAGG (SEQ ID NO: 371).

In some embodiments, an oligonucleotide targets PNPLA3 and has a base sequence which is, comprises or comprises a portion of: GCCACTGTAGAAAGGCAT (SEQ ID NO: 372).

In some embodiments, an oligonucleotide targets PNPLA3 and has a base sequence which is, comprises or comprises a portion of: GCCACTGTAGAAAGGCATGA (SEQ ID NO: 373).

In some embodiments, an oligonucleotide targets PNPLA3 and has a base sequence which is, comprises or comprises a portion of: GCCACTGTAGAAAGGCATCA (SEQ ID NO: 374).

In some embodiments, an oligonucleotide targets PNPLA3 and has a base sequence which is, comprises or comprises a portion of: GCCACTGTAGAAAGGCATG (SEQ ID NO: 375).

In some embodiments, an oligonucleotide targets PNPLA3 and has a base sequence which is, comprises or comprises a portion of: GCCACTGTAGAAAGGCATGA (SEQ ID NO: 376).

In some embodiments, an oligonucleotide targets PNPLA3 and has a base sequence which is, comprises or comprises a portion of: GCCACTGTAGAAAGGCATGAA (SEQ ID NO: 377).

In some embodiments, an oligonucleotide targets PNPLA3 and has a base sequence which is, comprises or comprises a portion of: GCCACTGTAGAAAGGCATGAAG (SEQ ID NO: 378).

In some embodiments, an oligonucleotide targets PNPLA3 and has a base sequence which is, comprises or comprises a portion of: GCCACTGTAGAAAGGCATGT (SEQ ID NO: 379).

In some embodiments, an oligonucleotide targets PNPLA3 and has a base sequence which is, comprises or comprises a portion of: GCCACTGTAGAAAGGCGG (SEQ ID NO: 380).

In some embodiments, an oligonucleotide targets PNPLA3 and has a base sequence which is, comprises or comprises a portion of: GCCACTGTAGAAAGGCGTGA (SEQ ID NO: 381).

In some embodiments, an oligonucleotide targets PNPLA3 and has a base sequence which is, comprises or comprises a portion of: GCCACTGTAGAAAGGCTT (SEQ ID NO: 382).

In some embodiments, an oligonucleotide targets PNPLA3 and has a base sequence which is, comprises or comprises a portion of: GCCACTGTAGAAAGGCTTGA (SEQ ID NO: 383).

In some embodiments, an oligonucleotide targets PNPLA3 and has a base sequence which is, comprises or comprises a portion of: GCCACTGTAGAAAGGGAT (SEQ ID NO: 384).

In some embodiments, an oligonucleotide targets PNPLA3 and has a base sequence which is, comprises or comprises a portion of: GCCACTGTAGAAAGGTATGA (SEQ ID NO: 385).

In some embodiments, an oligonucleotide targets PNPLA3 and has a base sequence which is, comprises or comprises a portion of: GCCACTGTAGAATGGCAT (SEQ ID NO: 386).

In some embodiments, an oligonucleotide targets PNPLA3 and has a base sequence which is, comprises or comprises a portion of: GCCACTGTAGAGAGGCATGA (SEQ ID NO: 387).

In some embodiments, an oligonucleotide targets PNPLA3 and has a base sequence which is, comprises or comprises a portion of: GCCTCAGTGTCTCGGCCAGG (SEQ ID NO: 388).

In some embodiments, an oligonucleotide targets PNPLA3 and has a base sequence which is, comprises or comprises a portion of: GCCTGGGCGAGAGGGTGTCC (SEQ ID NO: 389).

In some embodiments, an oligonucleotide targets PNPLA3 and has a base sequence which is, comprises or comprises a portion of: GCCTGTTGGCTGCTCACTGG (SEQ ID NO: 390).

In some embodiments, an oligonucleotide targets PNPLA3 and has a base sequence which is, comprises or comprises a portion of: GCGCTCTCTACCCTGCCTCA (SEQ ID NO: 391).

In some embodiments, an oligonucleotide targets PNPLA3 and has a base sequence which is, comprises or comprises a portion of: GCTCCAGCGGGATACCGGA (SEQ ID NO: 392).

In some embodiments, an oligonucleotide targets PNPLA3 and has a base sequence which is, comprises or comprises a portion of: GCTCGGCCTCCAGTTCCA (SEQ ID NO: 393).

In some embodiments, an oligonucleotide targets PNPLA3 and has a base sequence which is, comprises or comprises a portion of: GCTGGTGGACATTGGCCGGG (SEQ ID NO: 394).

In some embodiments, an oligonucleotide targets PNPLA3 and has a base sequence which is, comprises or comprises a portion of: GCTGTAGCGAGCCTGGGCG (SEQ ID NO: 395).

In some embodiments, an oligonucleotide targets PNPLA3 and has a base sequence which is, comprises or comprises a portion of: GCTGTGCTTGGCTCCTGCC (SEQ ID NO: 396).

In some embodiments, an oligonucleotide targets PNPLA3 and has a base sequence which is, comprises or comprises a portion of: GGACCCTCTGCACTGGGC (SEQ ID NO: 397).

In some embodiments, an oligonucleotide targets PNPLA3 and has a base sequence which is, comprises or comprises a portion of: GGACCCTCTGCACTGGGCTT (SEQ ID NO: 398).

In some embodiments, an oligonucleotide targets PNPLA3 and has a base sequence which is, comprises or comprises a portion of: GGACCTGAGGATGGACCGC (SEQ ID NO: 399).

In some embodiments, an oligonucleotide targets PNPLA3 and has a base sequence which is, comprises or comprises a portion of: GGACCTGAGGATGGACCGCG (SEQ ID NO: 400).

In some embodiments, an oligonucleotide targets PNPLA3 and has a base sequence which is, comprises or comprises a portion of: GGATAAGGCCACTGTAGAAA (SEQ ID NO: 401).

In some embodiments, an oligonucleotide targets PNPLA3 and has a base sequence which is, comprises or comprises a portion of: GGCATGAAGCAGGAACAT (SEQ ID NO: 402).

In some embodiments, an oligonucleotide targets PNPLA3 and has a base sequence which is, comprises or comprises a portion of: GGCATGAAGCAGGAACATAC (SEQ ID NO: 403).

In some embodiments, an oligonucleotide targets PNPLA3 and has a base sequence which is, comprises or comprises a portion of: GGCCACTGTAGAAAGGCATGAAGCA (SEQ ID NO: 404).

In some embodiments, an oligonucleotide targets PNPLA3 and has a base sequence which is, comprises or comprises a portion of: GGCCACTGTAGAAAGGCATG (SEQ ID NO: 405).

In some embodiments, an oligonucleotide targets PNPLA3 and has a base sequence which is, comprises or comprises a portion of: GGCCACTGTAGAAAGGCA (SEQ ID NO: 406).

In some embodiments, an oligonucleotide targets PNPLA3 and has a base sequence which is, comprises or comprises a portion of: GGCCACTGTAGAAAGGCATGA (SEQ ID NO: 407).

In some embodiments, an oligonucleotide targets PNPLA3 and has a base sequence which is, comprises or comprises a portion of: GGCTGGGATCCTCCACGTCA (SEQ ID NO: 408).

In some embodiments, an oligonucleotide targets PNPLA3 and has a base sequence which is, comprises or comprises a portion of: GGGACCCTCTGCACTGGGCT (SEQ ID NO: 409).

In some embodiments, an oligonucleotide targets PNPLA3 and has a base sequence which is, comprises or comprises a portion of: GGGAGGCCTGTTGGCTGCTC (SEQ ID NO: 410).

In some embodiments, an oligonucleotide targets PNPLA3 and has a base sequence which is, comprises or comprises a portion of: GGGATCCTCCACGTCACAG (SEQ ID NO: 411).

In some embodiments, an oligonucleotide targets PNPLA3 and has a base sequence which is, comprises or comprises a portion of: GGGCGAGAGGGTGTCCAGG (SEQ ID NO: 412).

In some embodiments, an oligonucleotide targets PNPLA3 and has a base sequence which is, comprises or comprises a portion of: GGGTGGCCTCTGCTTTGGTC (SEQ ID NO: 413).

In some embodiments, an oligonucleotide targets PNPLA3 and has a base sequence which is, comprises or comprises a portion of: GGTCTCTGCTGGACAGCCCT (SEQ ID NO: 414).

In some embodiments, an oligonucleotide targets PNPLA3 and has a base sequence which is, comprises or comprises a portion of: GGTGGACATTGGCCGGGAG (SEQ ID NO: 415).

In some embodiments, an oligonucleotide targets PNPLA3 and has a base sequence which is, comprises or comprises a portion of: GGTGGCCTCTGCTTTGGTCT (SEQ ID NO: 416).

In some embodiments, an oligonucleotide targets PNPLA3 and has a base sequence which is, comprises or comprises a portion of: GTAGAAAGGCATGAAGCAG (SEQ ID NO: 417).

In some embodiments, an oligonucleotide targets PNPLA3 and has a base sequence which is, comprises or comprises a portion of: GTAGAAAGGCATGAAGCAG-GAACA (SEQ ID NO: 418).

In some embodiments, an oligonucleotide targets PNPLA3 and has a base sequence which is, comprises or comprises a portion of: GTAGAAAGGCATGAAGCAG-GAACAT (SEQ ID NO: 419).

In some embodiments, an oligonucleotide targets PNPLA3 and has a base sequence which is, comprises or comprises a portion of: GTAGAAAGGCATGAAGC (SEQ ID NO: 420).

In some embodiments, an oligonucleotide targets PNPLA3 and has a base sequence which is, comprises or comprises a portion of: GTAGAAAGGCATGAAGCA (SEQ ID NO: 421).

In some embodiments, an oligonucleotide targets PNPLA3 and has a base sequence which is, comprises or comprises a portion of: GTAGAAAGGCATGAAGCAG (SEQ ID NO: 422).

In some embodiments, an oligonucleotide targets PNPLA3 and has a base sequence which is, comprises or comprises a portion of: GTAGAAAGGCATGAAGCAGG (SEQ ID NO: 423).

In some embodiments, an oligonucleotide targets PNPLA3 and has a base sequence which is, comprises or comprises a portion of: GTCACTGTAGAAAGGCATGA (SEQ ID NO: 424).

In some embodiments, an oligonucleotide targets PNPLA3 and has a base sequence which is, comprises or comprises a portion of: GTGCTTGGCTCCTGCCTGG (SEQ ID NO: 425).

In some embodiments, an oligonucleotide targets PNPLA3 and has a base sequence which is, comprises or comprises a portion of: GTGCTTGGCTCCTGCCTGGG (SEQ ID NO: 426).

In some embodiments, an oligonucleotide targets PNPLA3 and has a base sequence which is, comprises or comprises a portion of: GTTACCCCGCCATGGAGA (SEQ ID NO: 427).

In some embodiments, an oligonucleotide targets PNPLA3 and has a base sequence which is, comprises or comprises a portion of: GTTCCGACTCCTGGCCTTC (SEQ ID NO: 428).

In some embodiments, an oligonucleotide targets PNPLA3 and has a base sequence which is, comprises or comprises a portion of: GTTCCGACTCCTGGCCTTCC (SEQ ID NO: 429).

In some embodiments, an oligonucleotide targets PNPLA3 and has a base sequence which is, comprises or comprises a portion of: TACCCCGCCATGGAGACG (SEQ ID NO: 430).

In some embodiments, an oligonucleotide targets PNPLA3 and has a base sequence which is, comprises or comprises a portion of: TCCGACTCCTGGCCTTCCG (SEQ ID NO: 431).

In some embodiments, an oligonucleotide targets PNPLA3 and has a base sequence which is, comprises or comprises a portion of: TGTTACCCCGCCATGG (SEQ ID NO: 432).

In some embodiments, an oligonucleotide targets PNPLA3 and has a base sequence which is, comprises or comprises a portion of: TGTTACCCCGCCATGGAG (SEQ ID NO: 433).

In some embodiments, the present disclosure discloses an oligonucleotide of a sequence recited herein. In some embodiments, the present disclosure discloses an oligonucleotide of a sequence recited herein, wherein the oligonucleotide is capable of directing a decrease in the expression and/or level of a target gene or its gene product. In some embodiments, an oligonucleotide of a recited sequence is a single-stranded RNAi agent. In some embodiments, an oligonucleotide of a recited sequence is an antisense oligonucleotide which directs RNase H-mediated knockdown. In some embodiments, an oligonucleotide of a recited sequence directs both RNA interference and RNase H-mediated knockdown. In some embodiments, an oligonucleotide of a recited sequence comprises any structure described herein (e.g., any 5'-end structure, 5'-end region, 5' nucleotide moiety, seed region, post-seed region, 3'-terminal dinucleotide, 3'-end cap, or any portion of any of these structures, or any chemistry, stereochemistry, additional chemical moiety, etc., described herein). If the oligonucleotide is a ssRNAi agent, the sequence can be preceded by a T (as a non-limiting example, a 2'-deoxy T, 5'-(R)-Me OH T, 5'-(R)-Me PO T, 5'-(R)-Me PS T, 5'-(R)-Me PH T, 5'-(S)-Me OH T, 5'-(S)-Me PO T, 5'-(S)-Me PS T, or 5'-(S)—PH T) or the first nucleobase is replaced by a T (as a non-limiting example, a 2'-deoxy T, 5'-(R)-Me OH T, 5'-(R)-Me PO T, 5'-(R)-Me PS T, 5'-(R)-Me PH T, 5'-(S)-Me OH T, 5'-(S)-Me PO T, 5'-(S)-Me PS T, or 5'-(S)—PH T) and/or followed by a 3'-terminal dinucleotide (e.g., as non-limiting examples: TT, UU, TU, etc.). In various sequences, U can be replaced by T or vice versa, or a sequence can comprise a mixture of U and T. In some embodiments, an oligonucleotide has a length of no more than about 49, 45, 40, 30, 35, 25, 23 total nucleotides. In some embodiments, a portion is a span of at least 15, 16, 17, 18, 19, 20, 21, 22, 23, 24, or 25 total nucleotides with 0-3 mismatches. In some embodiments, a portion is a span of at least 15, 16, 17, 18, 19, 20, 21, 22, 23, 24, or 25 total nucleotides with 0-3 mismatches, wherein a span with 0 mismatches is complementary and a span with 1 or more mismatches is a non-limiting example of substantial complementarity. In some embodiments, wherein the sequence recited above starts with a U at the 5'-end, the U can be deleted and/or replaced by another base. In some embodiments, the disclosure encompasses any oligonucleotide having a base sequence which is or comprises or comprises a portion of the base sequence of any oligonucleotide disclosed herein, which has a format or a portion of a format disclosed herein.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any base sequence described herein. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any base sequence or portion thereof, described herein. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any base sequence or portion thereof, described herein, wherein a portion is a span of 15 contiguous bases, or a span of 15 contiguous bases with 1-5 mismatches. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any base sequence or portion thereof described herein in combination with any other structural element or modification described herein, including but not limited to, sugar, base; internucleotidic linkage; stereochemistry or pattern thereof; additional chemical moiety, including but not limited to, a targeting moiety, lipid moiety, a GalNAc moiety, etc.; 5'-end structure; 5'-end region; 5' nucleotide moiety; seed region; post-seed region; 3'-end region; 3'-terminal dinucleotide; 3'-end cap; GC content; long GC stretch; pattern of modifications of sugars, bases or internucleotidic linkages; format or any structural element thereof, and/or any other structural element or modification described herein; and in some embodiments, the present disclosure pertains to multimers of any such oligonucleotides.

Non-limiting examples of oligonucleotides having various base sequences are disclosed in Table 1A, below.

Lengthy table referenced here

US11603532-20230314-T00001

Please refer to the end of the specification for access instructions.

Lengthy table referenced here

US11603532-20230314-T00002

Please refer to the end of the specification for access instructions.

Lengthy table referenced here

US11603532-20230314-T00003

Please refer to the end of the specification for access instructions.

Lengthy table referenced here

US11603532-20230314-T00004

Please refer to the end of the specification for access instructions.

Lengthy table referenced here

US11603532-20230314-T00005

Please refer to the end of the specification for access instructions.

Lengthy table referenced here

US11603532-20230314-T00006

Please refer to the end of the specification for access instructions.

Lengthy table referenced here

US11603532-20230314-T00007

Please refer to the end of the specification for access instructions.

Lengthy table referenced here

US11603532-20230314-T00008

Please refer to the end of the specification for access instructions.

Lengthy table referenced here

US11603532-20230314-T00009

Please refer to the end of the specification for access instructions.

Lengthy table referenced here

US11603532-20230314-T00010

Please refer to the end of the specification for access instructions.

The disclosure notes that some sequences, due to their length, are divided into multiple lines; however, these sequences, as are all oligonucleotides in Table 1A, are single-stranded (unless otherwise noted).

Moieties and Modifications Listed in the Tables (or Compounds Used to Construct Oligonucleotides Comprising these Moieties or Modifications:

IT

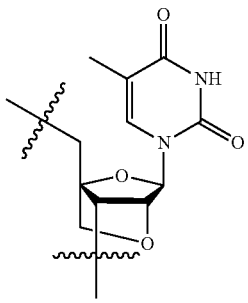 [SMILES: *C[C@]12CO[C@@H](C1*)[C@H](n1cc(C)c(=O)[nH]c1=O)O2]

if between 5'-end groups and/or internucleotidic linkages (e.g., in WV-3819);

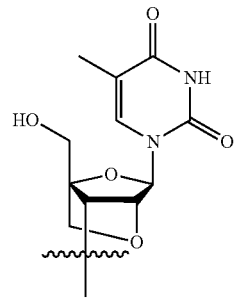 [SMILES: *C1[C@@H]2OC[C@]1(CO)O[C@H]2n1cc(C)c(=O)[nH]c1=O]

if at 5'-end and without 5'-end groups (e.g., in WV-3818);

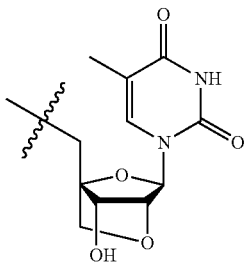 [SMILES: *C[C@]12CO[C@@H](C1O)[C@H](n1cc(C)c(=O)[nH]c1=O)O2]

if at 3'-end (e.g., in WV-7821).

IG 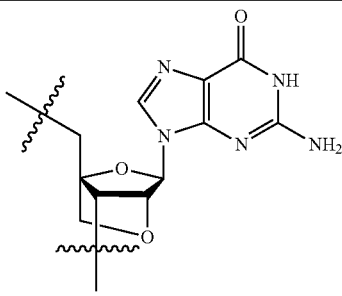
if between 5'-end groups and/or internucleotidic linkages (e.g., in WV-6689);
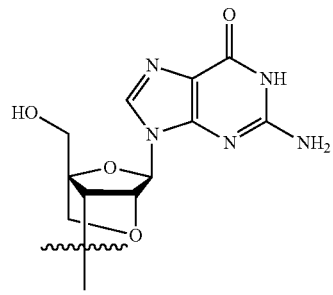 [SMILES: *C1[C@@H]2OC[C@]1(CO)O[C@H]2n1cnc2c(=O)[nH]c(N)nc21]
if at 5'-end and without 5'-end groups (e.g., in WV-6711);
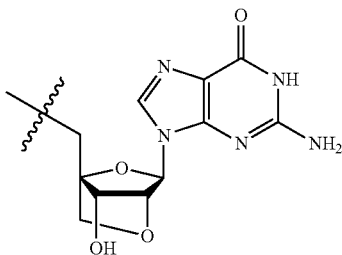 [SMILES: *C[C@]12CO[C@@H](C1O)[C@H](n1cnc3c(=O)[nH]c(N)nc31)O2]
if at 3'-end (e.g., in WV-7827).
IA 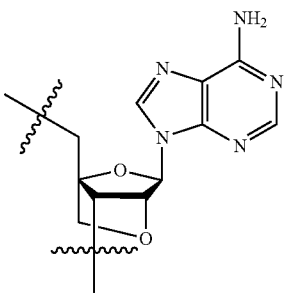 [SMILES: *C[C@]12CO[C@@H](C1*)[C@H](n1cnc3c(N)ncnc31)O2]
if between 5'-end groups and/or internucleotidic linkages (e.g., in WV-6692);
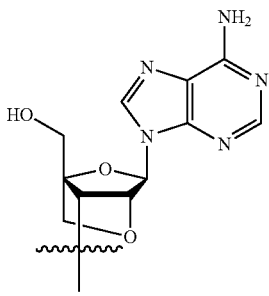 [SMILES: *C1[C@@H]2OC[C@]1(CO)O[C@H]2n1cnc2c(N)ncnc21]

if at 5'-end and without 5'-end groups (e.g., in WV-6710);
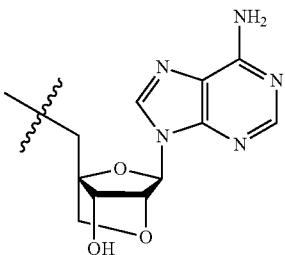 [SMILES: *C[C@]12CO[C@@H](C1O)[C@H](n1cnc3c(N)ncnc31)O2]
if at 3'-end (e.g., in WV-7817).
Im5C
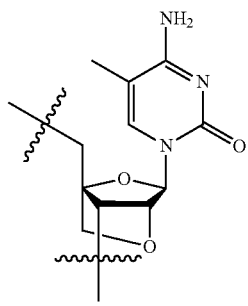 [SMILES: *C[C@]12CO[C@@H](C1*)[C@H](n1cc(C)c(N)nc1=O)O2]
if between 5'-end groups and/or internucleotidic linkages (e.g., in WV-6690);
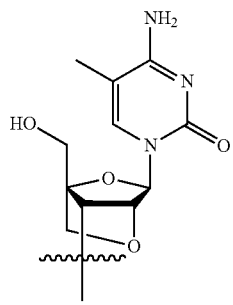 [SMILES: *C1[C@@H]2OC[C@]1(CO)O[C@H]2n1cc(C)c(N)nc1=O]
if at 5'-end and without 5'-end groups (e.g., in WV-7817);
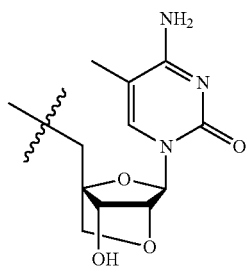 [SMILES: *C[C@]12CO[C@@H](C1O)[C@H](n1cc(C)c(N)nc1=O)O2]
if at 3'-end (e.g., in WV-7818).
MeOT
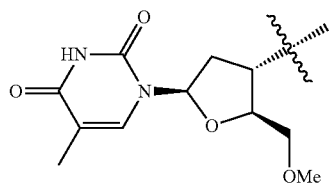 [SMILES: *[C@H]1C[C@H](n2cc(C)c(=O)[nH]c2=O)O[C@@H]1COC]

-continued

Mod001

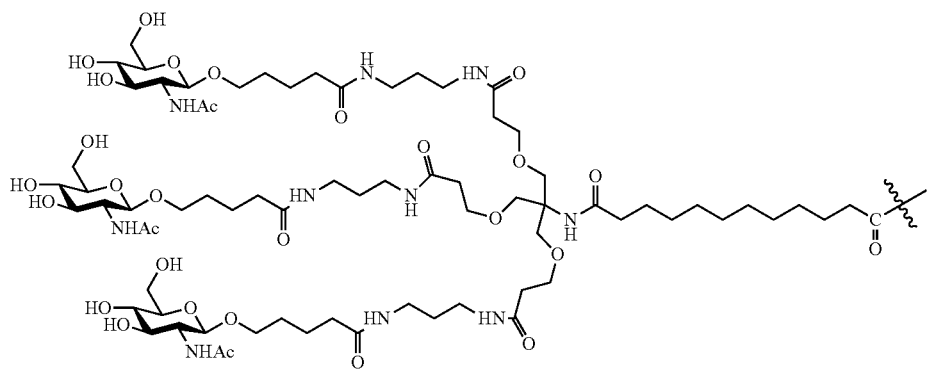

Mod022 CH₃CH₂CH₂—; connected to 5'-end of oligonucleotide chain through either a phosphate linkage (O or PO) or phosphorothioate linkage (* if the phosphorothioate not chirally controlled; can also be Sp if chirally controlled and has an Sp configuration, and Rp if chirally controlled and has an Rp configuration) as illustrated.

PH

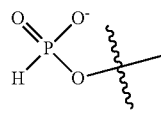

Mod023

connected to 5'-end of oligonucleotide chain through either a phosphate linkage (O or PO) or phosphorothioate linkage (* if the phosphorothioate not chirally controlled; can also be Sp if chirally controlled and has an Sp configuration, and Rp if chirally controlled and has an Rp configuration) as illustrated.

VPT

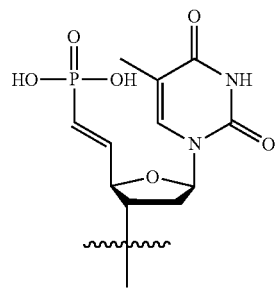

Mod034

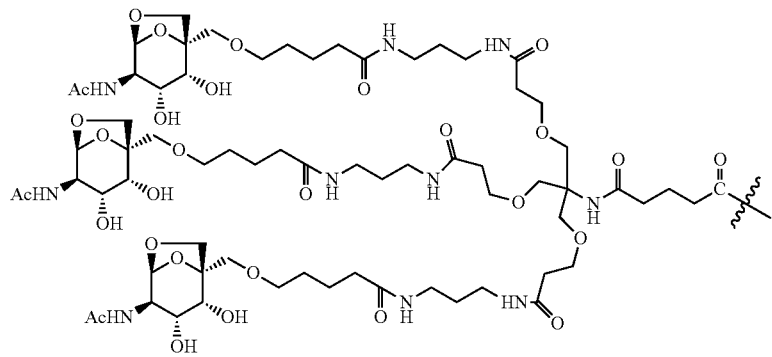 [SMILES: *C(=O)CCCC(=O)NC(COCCC(=O)NCCCNC(=O)CCCCOC[C@@]12CO[C@@H](O1)[C@H](NC(C)=O)[C@@H](O)[C@H]2O)(COCCC(=O)NCCCNC(=O)CCCCOC[C@@]12CO[C@@H](O1)[C@H](NC(C)=O)[C@@H](O)[C@H]2O)COCCC(=O)NCCCNC(=O)CCCCOC[C@@]12CO[C@@H](O1)[C@H](NC(C)=O)[C@@H](O)[C@H]2O]

-continued
Mod035
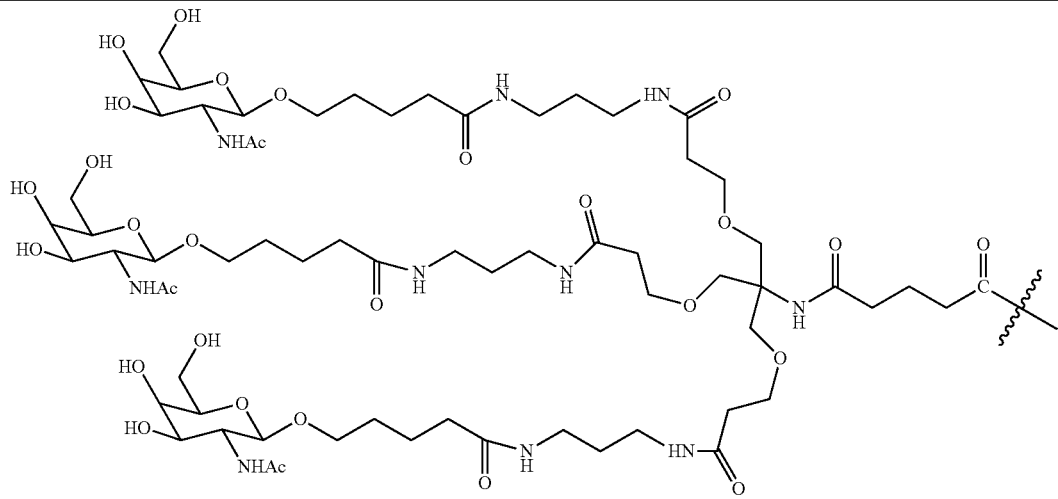
Mod036
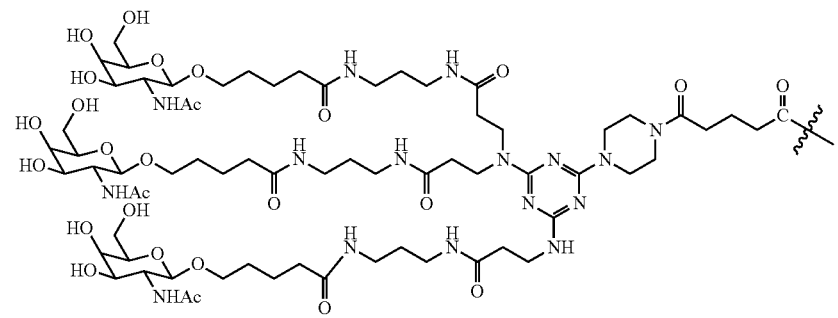 [SMILES: *C(=O)CCCC(=O)N1CCN(c2nc(NCCC(=O)NCCCNC(=O)CCCCOC3OC(CO)C(O)C(O)C3NC(C)=O)nc(N(CCC(=O)NCCCNC(=O)CCCCOC3OC(CO)C(O)C(O)C3NC(C)=O)CCC(=O)NCCCNC(=O)CCCCOC3OC(CO)C(O)C(O)C3NC(C)=O)n2)CC1]
Mod038
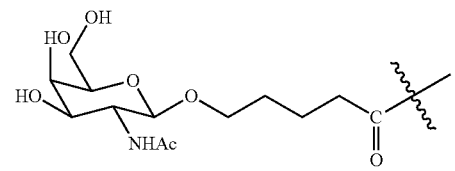 [SMILES: *C(=O)CCCCOC1OC(CO)C(O)C(O)C1NC(C)=O]
Mod039
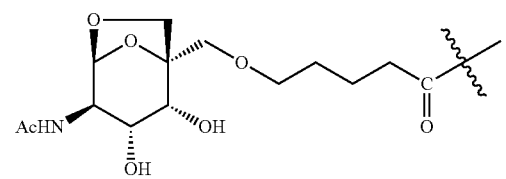 [SMILES: *C(=O)CCCCOC[C@@]12CO[C@@H](O1)[C@H](NC(C)=O)[C@@H](O)[C@H]2O]
Mod040
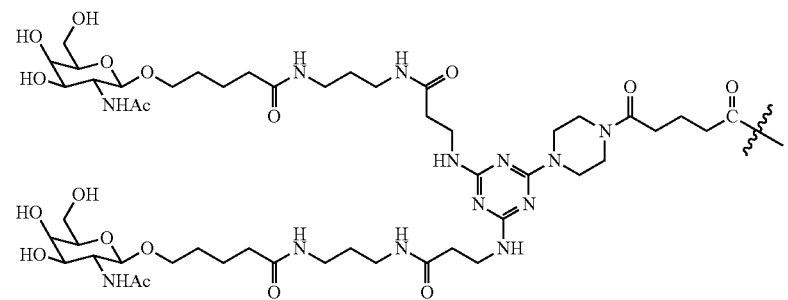 [SMILES: *C(=O)CCCC(=O)N1CCN(c2nc(NCCC(=O)NCCCNC(=O)CCCCOC3OC(CO)C(O)C(O)C3NC(C)=O)nc(NCCC(=O)NCCCNC(=O)CCCCOC3OC(CO)C(O)C(O)C3NC(C)=O)n2)CC1]

-continued
Mod041 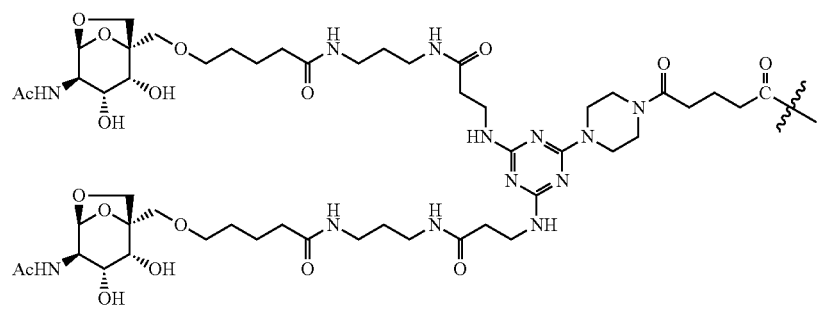 [SMILES: *C(=O)CCCC(=O)N1CCN(c2nc(NCCC(=O)NCCCNC(=O)CCCCOC[C@@]34CO[C@@H](O3)[C@H](NC(C)=O)[C@@H](O)[C@H]4O)nc(NCCC(=O)NCCCNC(=O)CCCCOC[C@@]34CO[C@@H](O3)[C@H](NC(C)=O)[C@@H](O)[C@H]4O)n2)CC1]
Mod079 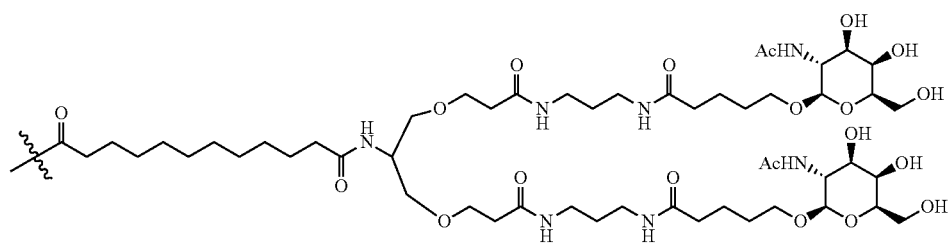 [SMILES: *C(=O)CCCCCCCCCCC(=O)NC(COCCC(=O)NCCCNC(=O)CCCCO[C@@H]1O[C@H](CO)[C@H](O)[C@H](O)[C@H]1NC(C)=O)COCCC(=O)NCCCNC(=O)CCCCO[C@@H]1O[C@H](CO)[C@H](O)[C@H](O)[C@H]1NC(C)=O]
Mod080 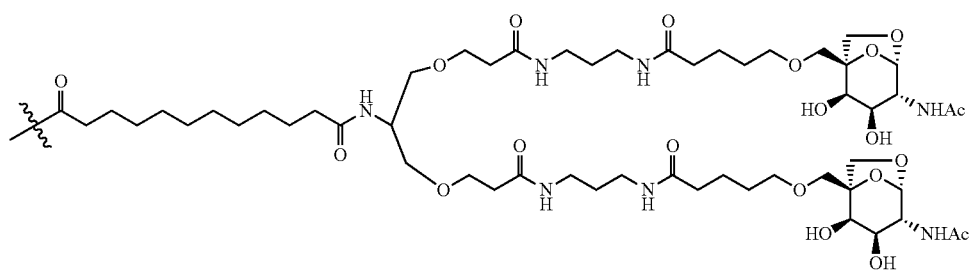 [SMILES: *C(=O)CCCCCCCCCCC(=O)NC(COCCC(=O)NCCCNC(=O)CCCCOC[C@@]12CO[C@@H](O1)[C@H](NC(C)=O)[C@@H](O)[C@H]2O)COCCC(=O)NCCCNC(=O)CCCCOC[C@@]12CO[C@@H](O1)[C@H](NC(C)=O)[C@@H](O)[C@H]2O]
Mod081 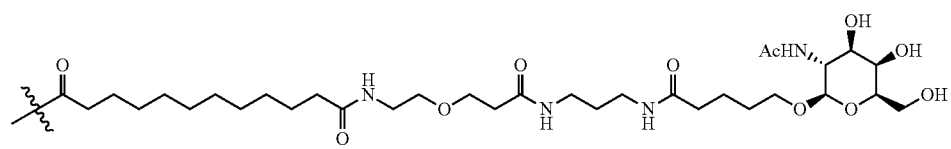 [SMILES: *C(=O)CCCCCCCCCCC(=O)NCCOCCC(=O)NCCCNC(=O)CCCCO[C@@H]1O[C@H](CO)[C@H](O)[C@H](O)[C@H]1NC(C)=O]
Mod082 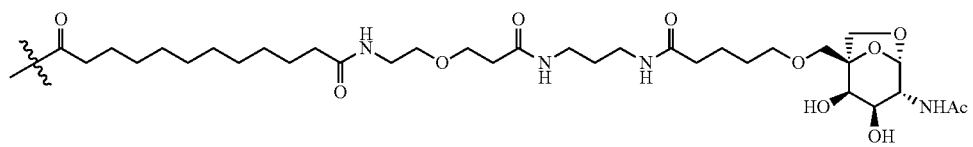 [SMILES: *C(=O)CCCCCCCCCCC(=O)NCCOCCC(=O)NCCCNC(=O)CCCCOC[C@@]12CO[C@@H](O1)[C@H](NC(C)=O)[C@@H](O)[C@H]2O]
Mod083 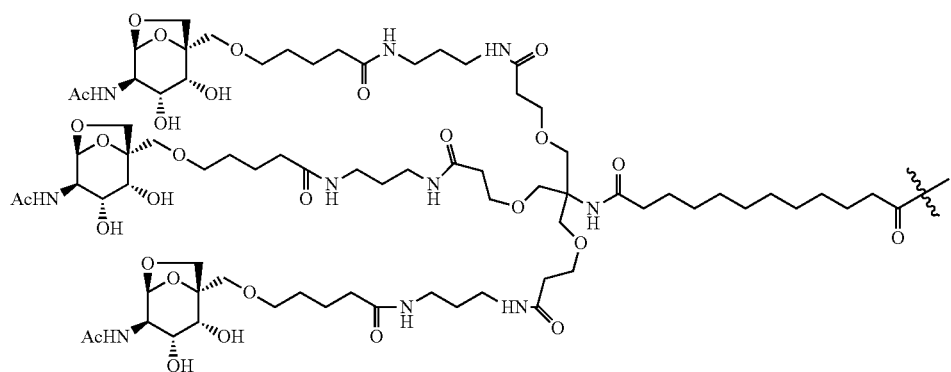 [SMILES: *C(=O)CCCCCCCCCCC(=O)NC(COCCC(=O)NCCCNC(=O)CCCCOC[C@@]12CO[C@@H](O1)[C@H](NC(C)=O)[C@@H](O)[C@H]2O)(COCCC(=O)NCCCNC(=O)CCCCOC[C@@]12CO[C@@H](O1)[C@H](NC(C)=O)[C@@H](O)[C@H]2O)COCCC(=O)NCCCNC(=O)CCCCOC[C@@]12CO[C@@H](O1)[C@H](NC(C)=O)[C@@H](O)[C@H]2O]

-continued
5mp 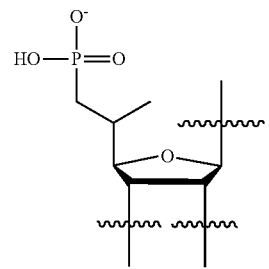
5MR 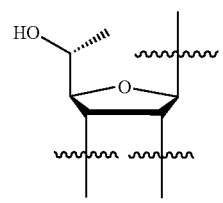
5mrp 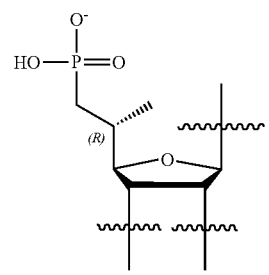
5MS 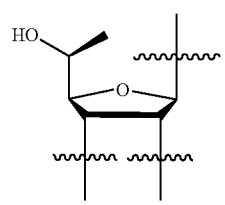
5msp 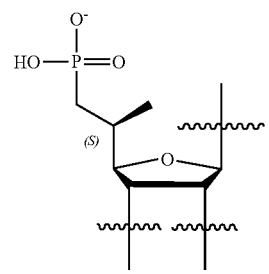
5mvp 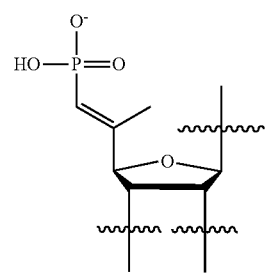

-continued
| 5pacet | 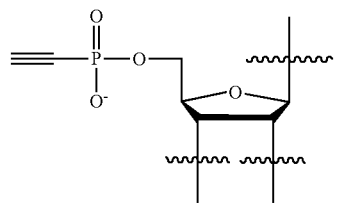 |
| 5ptz | 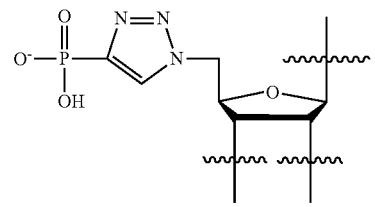 |
| 5tz | 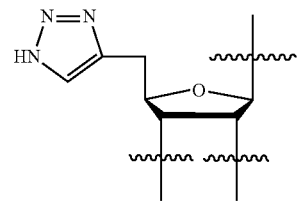 |
| 5tzpo | 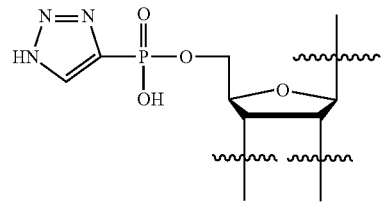 |
| 5mpdT | 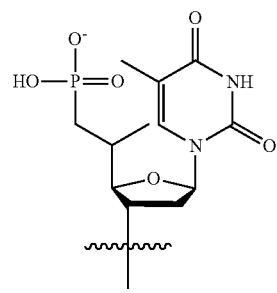 |
| 5MRdT | 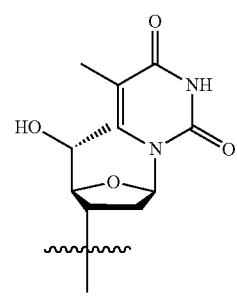 |

-continued
5mrpdT
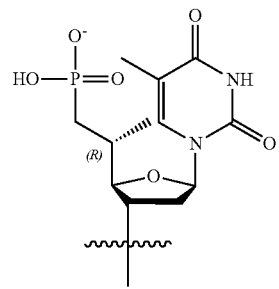
5MSdT
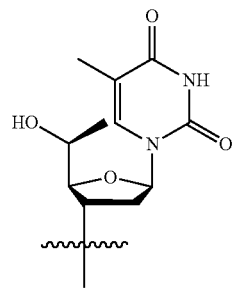
5mspdT
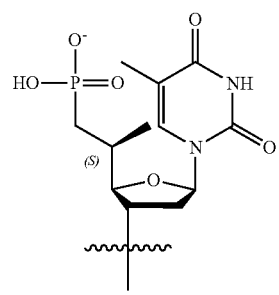
5mvpdT
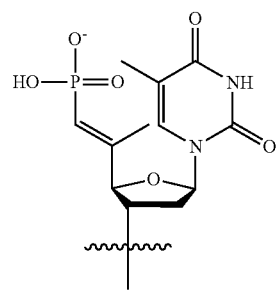
5pacetdT
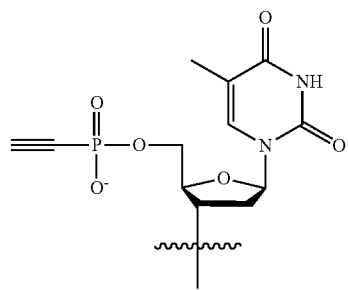

-continued
5ptzdT
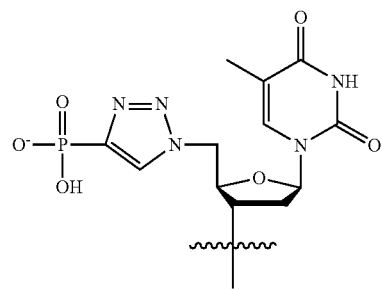
5tzdT
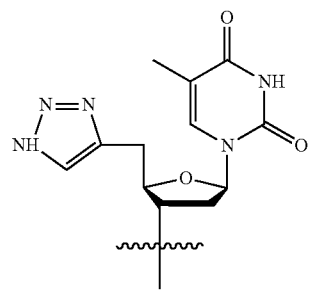
5tzpodT
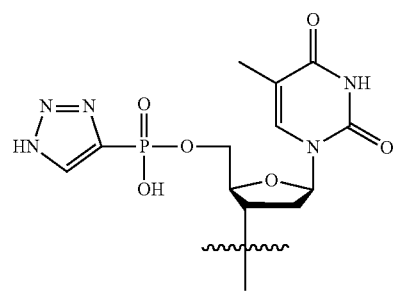
tbclc6T
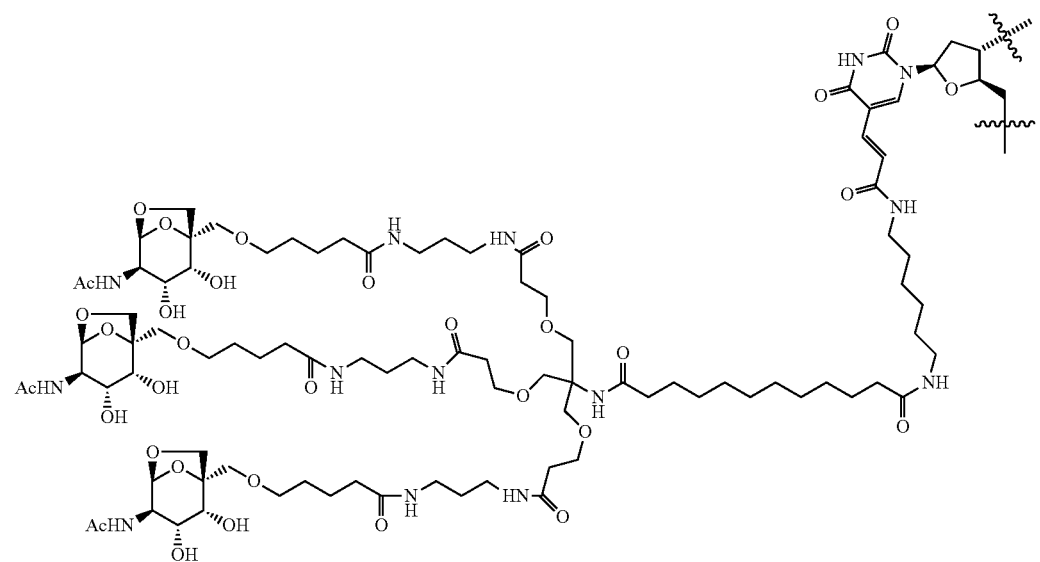 [SMILES: *C[C@H]1O[C@@H](n2cc(/C=C/C(=O)NCCCCCCNC(=O)CCCCCCCCCCC(=O)NC(COCCC(=O)NCCCNC(=O)CCCCOC[C@@]34CO[C@@H](O3)[C@H](NC(C)=O)[C@@H](O)[C@H]4O)(COCCC(=O)NCCCNC(=O)CCCCOC[C@@]34CO[C@@H](O3)[C@H](NC(C)=O)[C@@H](O)[C@H]4O)COCCC(=O)NCCCNC(=O)CCCCOC[C@@]34CO[C@@H](O3)[C@H](NC(C)=O)[C@@H](O)[C@H]4O)c(=O)[nH]c2=O)C[C@@H]1*]

bbclc6T

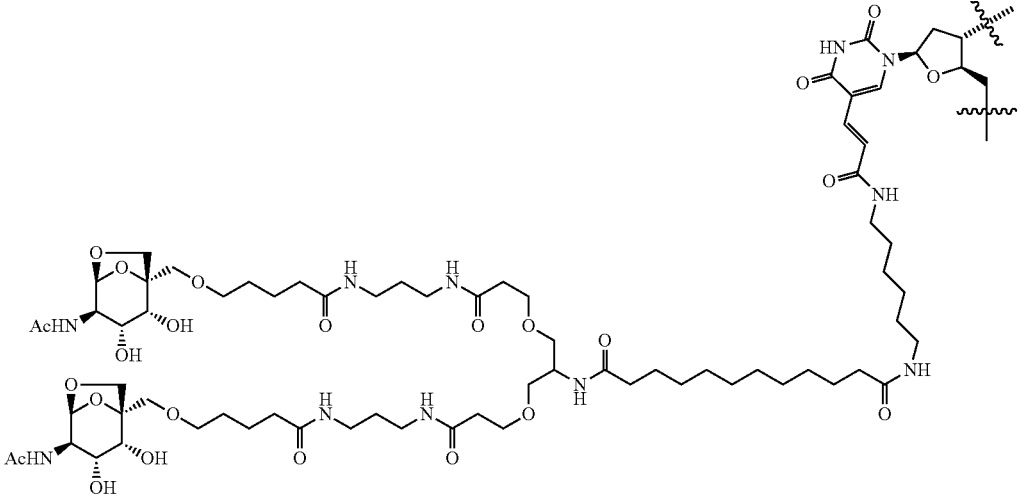 [SMILES: *C[C@H]1O[C@@H](n2cc(/C=C/C(=O)NCCCCCCNC(=O)CCCCCCCCCCC(=O)NC(COCCC(=O)NCCCNC(=O)CCCCOC[C@@]34CO[C@@H](O3)[C@H](NC(C)=O)[C@@H](O)[C@H]4O)COCCC(=O)NCCCNC(=O)CCCCOC[C@@]34CO[C@@H](O3)[C@H](NC(C)=O)[C@@H](O)[C@H]4O)c(=O)[nH]c2=O)C[C@@H]1*]

L009      —CH₂CH₂CH₂—. When L009 is present at the 5'-end of an oligonucleotide without a Mod, one end of L009 is connected to —OH and the other end connected to a 5'-carbon of the oligonucleotide chain via a linkage as indicated (e.g., in WV-9261, via a stereorandom phosphorothioate linkage ("*")).

In some embodiments, a linker, e.g., L009, L010, etc., can replace a sugar, and is bonded on either end to an internucleotidic linkage. For example:

WV-9266 comprises . . . * mAL009 * mUfG * . . . , which represents, from 5' to 3', a phosphorothioate (*), a sugar which is 2'-OMe (m) attached to a base (A), a phosphodiester linkage (not indicated), a L009 linker (L009), a phosphorothioate (*), a sugar which is 2'-OMe attached to a base which is U (mU), a phosphodiester linkage (not indicated), a sugar which is 2'-F (f) attached to a base (G) and a phosphorothioate.

WV-9267 comprises . . . * mAfC * LOO9fG * . . . , which represents, from 5' to 3', a phosphorothioate (*), a sugar which is 2'-OMe (m) attached to a base (A), a phosphodiester (not indicated), a sugar which is 2'-F (f) attached to a base (C), a phosphorothioate, a L009 linker (L009), a phosphodiester linkage (not indicated), a sugar which is 2'-F (f) attached to a base (G), and a phosphorothioate.

L010

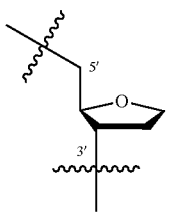

L010 is connected in the same fashion as typically in DNA (the 5'-carbon of a first sugar is connected to a 3'-carbon of a second sugar via an internucleotidic linkage, and the 3'-carbon of the first sugar is connected to the 5'-carbon of a third sugar via an internucleotidic linkage). When L010 is present at the 5'-end of an oligonucleotide without a Mod, the 5'-carbon of L010 is connected to —OH and the 3'-carbon connected to a 5'-carbon of the oligonucleotide chain via a linkage as indicated (e.g., in WV-9250, via a stereorandom phosphorothioate linkage ("*")).

In some embodiments, L010 can replace a sugar, and L010 is bonded on either end to an internucleotidic linkage.

n001, nX

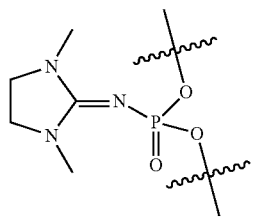

VPT
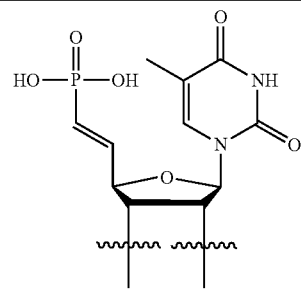
VP
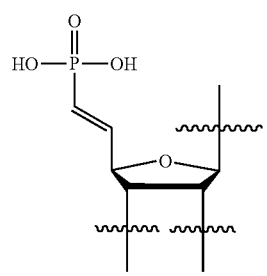
VQ
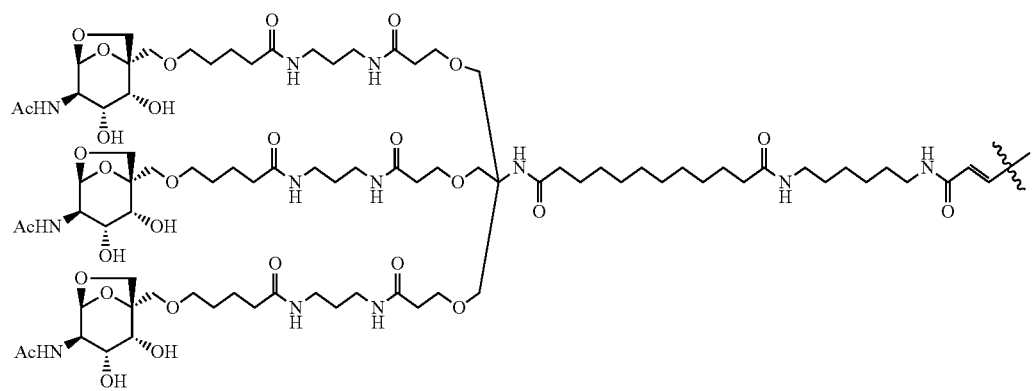 [SMILES: */C=C/C(=O)NCCCCCCNC(=O)CCCCCCCCCCC(=O)NC(COCCC(=O)NCCCNC(=O)CCCCOC[C@@]12CO[C@@H](O1)[C@H](NC(C)=O)[C@@H](O)[C@H]2O)(COCCC(=O)NCCCNC(=O)CCCCOC[C@@]12CO[C@@H](O1)[C@H](NC(C)=O)[C@@H](O)[C@H]2O)COCCC(=O)NCCCNC(=O)CCCCOC[C@@]12CO[C@@H](O1)[C@H](NC(C)=O)[C@@H](O)[C@H]2O]
VR
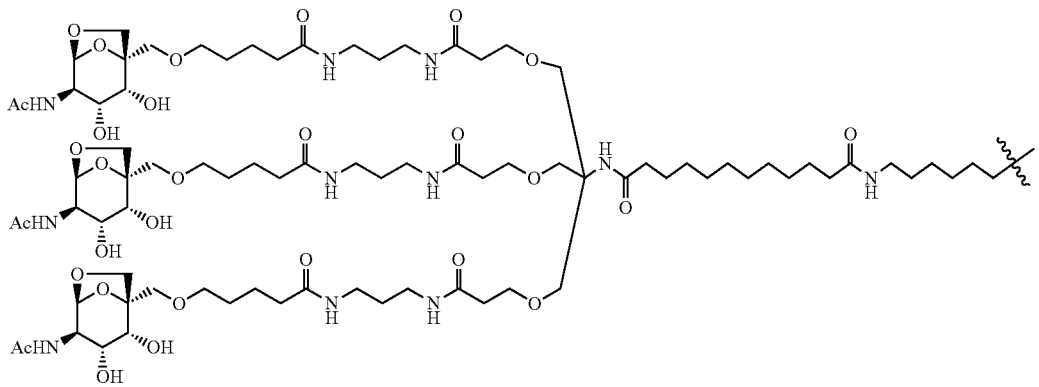 [SMILES: *CCCCCCNC(=O)CCCCCCCCCCC(=O)NC(COCCC(=O)NCCCNC(=O)CCCCOC[C@@]12CO[C@@H](O1)[C@H](NC(C)=O)[C@@H](O)[C@H]2O)(COCCC(=O)NCCCNC(=O)CCCCOC[C@@]12CO[C@@H](O1)[C@H](NC(C)=O)[C@@H](O)[C@H]2O)COCCC(=O)NCCCNC(=O)CCCCOC[C@@]12CO[C@@H](O1)[C@H](NC(C)=O)[C@@H](O)[C@H]2O]

-continued
VS
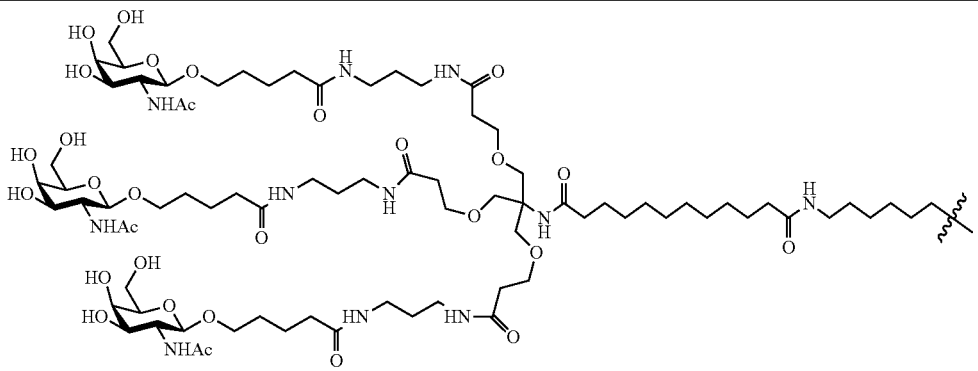
VT
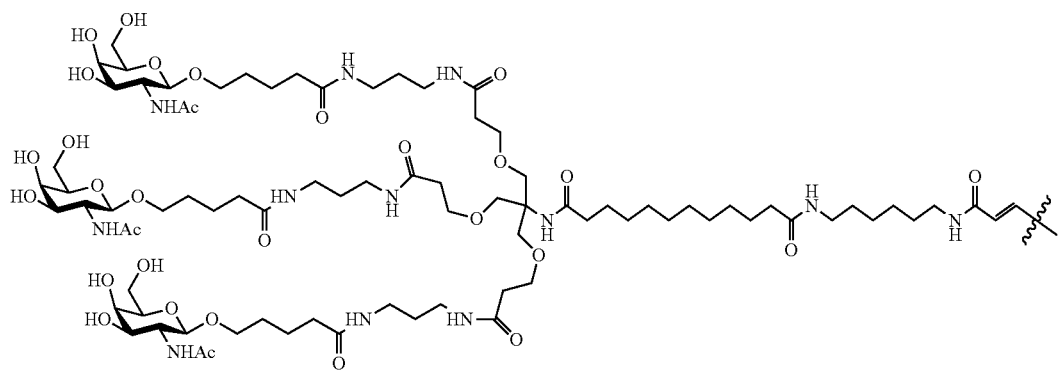
Additional Abbreviations:
AMC6T:
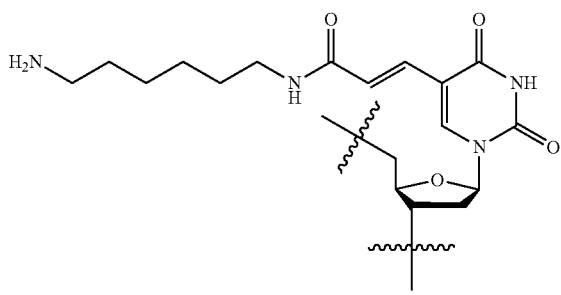
eo: 2'-MOE
F, f: 2'-F
GaNC6T:
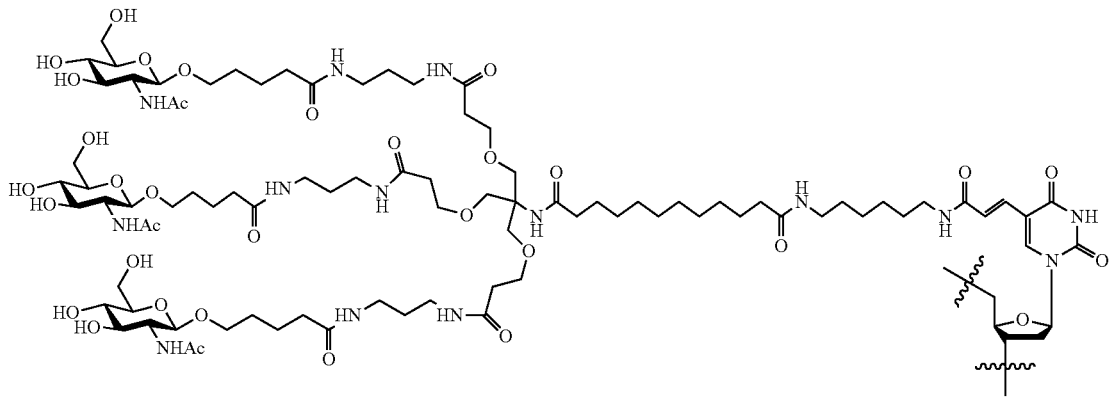
1: 2'-O—CH$_2$—4'

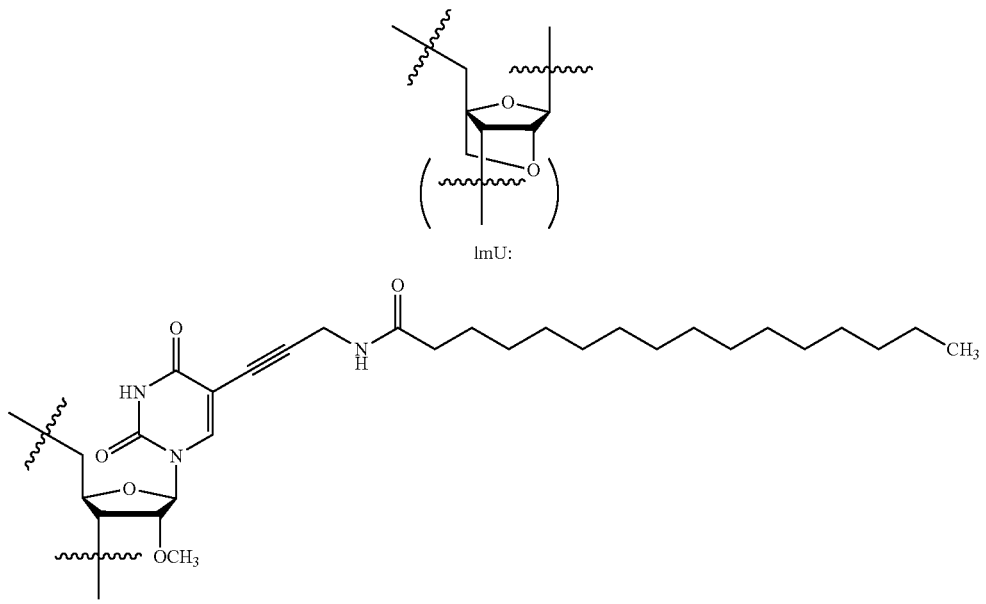

L001: —NH—(CH$_2$)$_6$— linker (C6 linker, C6 amine linker or C6 amino linker), connected to Mod, if any (if no Mod, —H, e.g., in WV-8240), through —NH—, and the 5'-end (e.g., in WV-2406) or 3'-end of oligonucleotide chain through either a phosphate linkage (O or PO) or phosphorothioate linkage (* if the phosphorothioate not chirally controlled; can also be Sp if chirally controlled and has an Sp configuration, and Rp if chirally controlled and has an Rp configuration) as illustrated. For example, in WV-2406, L001 is connected to Mod001 through —NH— (forming an amide group —C(O)—NH—), and is connected to the oligonucleotide chain through a phosphate linkage (OXXXXXXXXXXXXXXXXXXX); in WV-2422, L001 is not connected to any Mod, but —H, through —NH—, and is connected to the oligonucleotide chain through a phosphate linkage (OXXXXXXXXXXXXXXXXXXX)

L003:

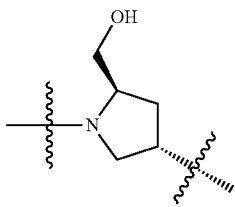 [SMILES: *[C@H]1C[C@H](CO)N(*)C1]

linker, connected to Mod, if any (if no Mod, —H, e.g., in WV-2426), through its amino group, and the 5'-end (e.g., in WV-2407) or 3'-end (e.g., in WV-8070) of oligonucleotide chain through either a phosphate linkage (O or PO) or phosphorothioate linkage (* if the phosphorothioate not chirally controlled; can also be Sp if chirally controlled and has an Sp configuration, and Rp if chirally controlled and has an Rp configuration) as illustrated. For example, in WV-2407, L003 is connected to Mod001 through its amino group (forming an amide group

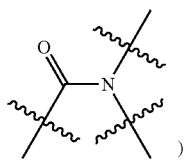 [SMILES: *C(=O)N(*)*]

and is connected to the 5'-end of oligonucleotide chain through a phosphate linkage (OXXXXXXXXXXXXXXXXXXX); in WV-2426, L001 is not connected to any Mod, but —H, through —NH—, and is connected to the oligonucleotide chain through a phosphate linkage (OXXXXXXXXXXXXXXXXXXX); in WV-8070, L003 is connected to Mod001 through its amino group (forming an amide group

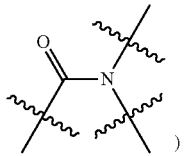 [SMILES: *C(=O)N(*)*]
)

and is connected to the 3'-end of oligonucleotide chain through a phosphate linkage ( . . . XXXXXXXXXXXXXXXXXXXXO)
m: 2'-OMe
m5: methyl at 5-position of C (nucleobase is 5-methylcytosine)
m5Ceo: 5-methyl 2'-methoxyethyl C
OMe: 2'-OMe
O, PO: phoshodiester (phosphate); can be an end group (typically "PO"; for example in WV-4260: POT*fC * . . . ), or a linkage, e.g., a linkage between linker and oligonucleotide chain, an internucleotidic linkage, etc.
*, PS: Phosphorothioate; can be an end group (typically "PS", for example, in WV-2653: PST*fA* . . . ), or a linkage, e.g., a linkage between linker and oligonucleotide chain, an internucleotidic linkage, etc.
R, Rp: Phosphorothioate in Rp conformation
S, Sp: Phosphorothioate in Sp conformation
X: Stereorandom phosphorothioate In some embodiments, a provided oligonucleotide comprises one or more moieties and/or modifications listed in the Tables, e.g., those described above (base modifications, sugar modifications, modified internucleotidic linkages, linkers, 5'-end groups, additional moieties (e.g., targeting moieties, carbohydrate-containing moieties, etc.), etc), and optionally and independently a linkage/stereochemistry pattern listed in the Tables (e.g., a part of Table 1A). In some embodiments, a provided oligonucleotide comprises a linkage/stereochemistry pattern in the Tables, and optionally and independently one or more moieties and/or modifications listed in the Tables. In some embodiments, a provided oligonucleotide composition is a composition of an oligonucleotide listed in Table 1A. In some embodiments, a provided oligonucleotide composition is a single-stranded RNAi agent listed in Table 1A or otherwise described herein. In some embodiments, example properties of provided oligonucleotides were demonstrated.

In some embodiments, a provided oligonucleotide has a structure of any of formats illustrated in FIG. 1.

In some embodiment, the present disclosure provides a composition comprising a single-stranded oligonucleotide capable of knocking down a target gene, wherein the oligonucleotide has or comprises the structure of:
5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-(N26-PX26-N27-PX27)$_{yz}$-(CAP)$_{zz}$-3'
or a salt thereof,
wherein:
each of N1 to N27 is independently a nucleoside;
each of PX0 to PX13 independently has the structure of an internucleotidic linkage;
mz to wz are independently 0 to 10;
wherein -(N26-PX26-N27-PX27)$_{yz}$- is a 3'-terminal dinucleotide, and (CAP)$_{zz}$ is a 3'-end cap, and yz and zz are 0 or 1.

In some embodiment, the present disclosure provides a composition comprising an oligonucleotide, e.g., a single-stranded oligonucleotide capable of knocking down a target gene, wherein the oligonucleotide has or comprises the structure of:

5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-(N26-PX26-N27-PX27)$_{yz}$-(CAP)$_{zz}$-3'
or a salt thereof,
wherein:
each of N1 to N27 is independently a nucleoside residue;
each of PX1 to PX26 is independently an internucleotidic linkage;
PX0 is —H, —OH, -L$^{PX}$-H, or -L-H;
L$^{PX}$ has the structure of an internucleotidic linkage;
L is as described in the present disclosure;
PX27 is —H, —OH, -L'—H, or -L-H when zz is O, and is —O—, -L'—, or -L- when zz is not 0;
mz, nz, pz, rz, sz, tz, vz, and wz are independently 0 to 10;
wherein N26-PX26-N27-PX27 is 3'-terminal dinucleotide;
CAP is a 3'-end cap;
yz and zz are independently 0 or 1.
In some embodiments, either yz=1 and $_{zz}$=0; or $_{yz}$=0 and zz=1.
In some embodiments, each of $_{mz, nz}$ and $_{pz}$ is an integer from 0 to 10, and the total of $_{mz}+_{nz}+_{pz}$ is an integer from 8 to 20.
In some embodiments, the oligonucleotide comprises at least 15 total bases.
In some embodiments, (a) at least one of $_{mz, nz}$ or $_{pz}$ is 1 or more; and at least one of PX9, PX10 or PX11 is a phosphodiester; (b) at least one of $_{mz, nz}$ or $_{pz}$ is 1 or more; and at least one of PX9, PX10 or PX11 is a phosphorothioate; (c) N13 is a nucleoside which is an abasic nucleoside and/or is 2'-modified; and/or (d) N12 is a 2'-deoxy nucleoside.
In some embodiments, knocking down a target gene comprises the step of decreasing the expression, stability and/or activity of the target gene or its gene product.
In some embodiments, knocking down a target gene comprises the step of decreasing the expression, stability and/or activity of the target gene mRNA.
In some embodiments, knocking down a target gene comprises the step of decreasing the expression, stability and/or activity of the target gene mRNA via RNA interference.

In some embodiments, knocking down a target gene comprises the step of decreasing the expression, stability and/or activity of the target gene mRNA via RNase H-mediated knockdown.

In some embodiments, knocking down a target gene comprises the step of decreasing the expression, stability and/or activity of the target gene mRNA via RNA interference and/or RNase H-mediated knockdown.

In some embodiments, a provided single-stranded oligonucleotide capable of directing RNA interference, wherein the oligonucleotide has or comprises the structure of:

5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-(N26-PX26-N27-PX27)$_{yz}$-(CAP)$_{zz}$-3' wherein: the oligonucleotide comprises multiple nucleosides (each independently represented by any of N1 to N27) and multiple internucleotidic linkages (each independently represented by any of PX0 to PX12). In some embodiments, an internucleotidic linkage is a modified internucleotidic linkage. In some embodiments, a provided single-stranded RNAi agent comprises a 3'-terminal dinucleotide (N26-PX26-N27-PX27)$_{yz}$, and does not comprise a 3'-end cap, wherein yz=1 and zz=0. In some embodiments, a provided single-stranded RNAi agent comprises a 3'-end cap (CAP)$_{zz}$, and does not comprise a 3'-terminal dinucleotide (N26-PX26-N27-PX27)$_{yz}$, and yz=0 and zz=1.

In some embodiments, any of PX0 to PX13 can be an internucleotidic linkage independently selected from: phosphodiester, phosphorothioate and phosphorodithioate, or any modified or variant of an internucleotidic linkage described herein or known in the art. In some embodiments, a phosphorothioate is random (wherein an oligonucleotide composition comprises both oligonucleotides with Rp and Sp chirality at the phosphorothioate this position). In some embodiments, a phosphorothioate is chirally controlled (wherein an oligonucleotide composition comprises oligonucleotides wherein a plurality or majority of the oligonucleotides have a Sp chirality at the phosphorothioate at this position, or a plurality or majority of the oligonucleotides have a Rp chirality at the phosphorothioate at this position.

In some embodiments, 1 or more of PX0 to PX13 are a Sp phosphorothioate. In some embodiments, 2 or more of PX0 to PX13 are a Sp phosphorothioate. In some embodiments, 3 or more of PX0 to PX13 are a Sp phosphorothioate. In some embodiments, 4 or more of PX0 to PX13 are a Sp phosphorothioate. In some embodiments, 5 or more of PX0 to PX13 are a Sp phosphorothioate. In some embodiments, 6 or more of PX0 to PX13 are a Sp phosphorothioate. In some embodiments, 7 or more of PX0 to PX13 are a Sp phosphorothioate. In some embodiments, 8 or more of PX0 to PX13 are a Sp phosphorothioate. In some embodiments, 9 or more of PX0 to PX13 are a Sp phosphorothioate. In some embodiments, 10 or more of PX0 to PX13 are a Sp phosphorothioate. In some embodiments, 11 or more of PX0 to PX13 are a Sp phosphorothioate. In some embodiments, 12 or more of PX0 to PX13 are a Sp phosphorothioate. In some embodiments, 13 or more of PX0 to PX13 are a Sp phosphorothioate. In some embodiments, 14 or more of PX0 to PX13 are a Sp phosphorothioate. In some embodiments, 15 or more of PX0 to PX13 are a Sp phosphorothioate. In some embodiments, 16 or more of PX0 to PX13 are a Sp phosphorothioate. In some embodiments, 17 or more of PX0 to PX13 are a Sp phosphorothioate. In some embodiments, 18 or more of PX0 to PX13 are a Sp phosphorothioate. In some embodiments, 19 or more of PX0 to PX13 are a Sp phosphorothioate. In some embodiments, 20 or more of PX0 to PX13 are a Sp phosphorothioate. In some embodiments, 21 or more of PX0 to PX13 are a Sp phosphorothioate. In some embodiments, 2 or more of PX0 to PX13 are a Rp phosphorothioate. In some embodiments, 3 or more of PX0 to PX13 are a Rp phosphorothioate. In some embodiments, 4 or more of PX0 to PX13 are a Rp phosphorothioate. In some embodiments, 5 or more of PX0 to PX13 are a Rp phosphorothioate. In some embodiments, 6 or more of PX0 to PX13 are a Rp phosphorothioate. In some embodiments, 7 or more of PX0 to PX13 are a Rp phosphorothioate. In some embodiments, 8 or more of PX0 to PX13 are a Rp phosphorothioate. In some embodiments, 9 or more of PX0 to PX13 are a Rp phosphorothioate. In some embodiments, 10 or more of PX0 to PX13 are a Rp phosphorothioate. In some embodiments, 11 or more of PX0 to PX13 are a Rp phosphorothioate. In some embodiments, 12 or more of PX0 to PX13 are a Rp phosphorothioate. In some embodiments, 13 or more of PX0 to PX13 are a Rp phosphorothioate. In some embodiments, 14 or more of PX0 to PX13 are a Rp phosphorothioate. In some embodiments, 15 or more of PX0 to PX13 are a Rp phosphorothioate. In some embodiments, 16 or more of PX0 to PX13 are a Rp phosphorothioate. In some embodiments, 17 or more of PX0 to PX13 are a Rp phosphorothioate. In some embodiments, 18 or more of PX0 to PX13 are a Rp phosphorothioate. In some embodiments, 19 or more of PX0 to PX13 are a Rp phosphorothioate. In some embodiments, 20 or more of PX0 to PX13 are a Rp phosphorothioate. In some embodiments, 21 or more of PX0 to PX13 are a Rp phosphorothioate.

In some embodiments, each of N1 to N27 are independently a nucleoside. In some embodiments, a nucleoside is a 2'-modified nucleoside or an abasic nucleoside (which comprises a sugar but lacks a nucleobase).

In some embodiments, 1 or more of N1 to N27 is an abasic nucleoside. In some embodiments, 1 or more of N1 to N27 is an 2'-deoxy nucleoside (DNA). 2 or more of N1 to N27 is an 2'-deoxy nucleoside (DNA). In some embodiments, 1 or more of N1 to N27 is a 2'-modified nucleoside. In some embodiments, 5 or more of N1 to N27 is a 2'-modified nucleoside. In some embodiments, 10 or more of N1 to N27 is a 2'-modified nucleoside. In some embodiments, 15 or more of N1 to N27 is a 2'-modified nucleoside. In some embodiments, 20 or more of N1 to N27 is a 2'-modified nucleoside. In some embodiments, 1 or more of N1 to N27 is a 2'-F nucleoside. In some embodiments, 5 or more of N1 to N27 is a 2'-F nucleoside. In some embodiments, 10 or more of N1 to N27 is a 2'-F nucleoside. In some embodiments, 15 or more of N1 to N27 is a 2'-F nucleoside. In some embodiments, 20 or more of N1 to N27 is a 2'-F nucleoside. In some embodiments, 21 or more of N1 to N27 is a 2'-F nucleoside. In some embodiments, 1 or more of N1 to N27 is a 2'-OMe nucleoside. In some embodiments, 10 or more of N1 to N27 is a 2'-OMe nucleoside.

Various examples of single-stranded RNAi agents of the structure of 5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-(N26-PX26-N27-PX27)$_{yz}$-(CAP)$_{zz}$-3' are disclosed herein, for example, in Table 1A and in the Figures and Tables. Various non-limiting examples of these single-stranded RNAi agents, and various structural elements, are described below and herein. These structural elements include, but are not limited to, the 5'-end structure, 5'-end region, the seed region, the target sequence, and length, the 3'-end region, and optional moieties conjugated to the single-stranded RNAi agent.

The present disclosure presents many non-limiting examples of oligonucleotides capable of mediating single-stranded RNA interference (e.g., single-stranded RNAi agents). Experimental data (not shown) demonstrated that various putative single-stranded RNAi agents were, in fact, capable of mediating RNA interference. In some experiments, an in vitro Ago-2 assay was used, including the use of a RNA test substrate WV-2372 (APOC3). The band representing the RNA test substrate is absent in the presence of oligonucleotides WV-1308 and WV-2420, indicating that these oligonucleotides are single-stranded RNAi agents capable of mediating RNA interference. The remaining lanes are controls: Substrate in the absence of negative control ASO WV-2134; substrate in the presence of negative control ASO WV-2134, which does not mediate RNA interference; substrate in the absence of test oligonucleotide WV-1308; substrate in the absence of test oligonucleotide WV-2420; substrate alone; no substrate, with added WV-2134; and no substrate, with added WV-1308. Also performed (data not shown) was an in vitro Ago-2 assay, using a APOC3 mRNA as a test substrate in a 3' RACE assay in Hep3B cells. A cleavage product of the APOC3 mRNA in the presence of test oligonucleotide WV-3021 was detected, the product corresponding to cleavage of the mRNA at a site corresponding to a cut between positions 10 and 11 of WV-3021. An artifactual cleavage product was also detected. Experimental data (not shown) demonstrated that dual mechanism oligonucleotide WV-2111 is capable of mediating knockdown by both RNase H and RNA interference. In an experiment, several oligonucleotides were capable of mediating RNA interference. The RNA test substrate was WV-2372. The experiment showed disappearance of the RNA test substrate in the presence of test oligonucleotides WV-1308; WV-2114; WV-2386; and WV-2387, indicating that all these oligonucleotides are capable of acting as single-stranded RNAi agents mediating RNA interference. The remaining lanes are controls. Thus, the experiment showed that oligonucleotides WV-1308, WV-2114, WV-2386, and WV-2387 were all able to mediate RNA interference. Thus, the experiments showed that several single-stranded RNAi agents (e.g., WV-1308, WV-2420, WV-3021, WV-2111, WV-2114, WV-2386, and WV-2387) are capable of mediating RNA interference. The present disclosure presents many non-limiting examples of oligonucleotides, having any of various sequences, formats, modifications, 5'-end regions, seed regions, post-seed regions, and 3'-end regions, and which are capable of mediating single-stranded RNA interference (e.g., single-stranded RNAi agents).

Formats of Oligonucleotides

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides can have any format or portion thereof or structural element thereof described herein or known in the art.

In some embodiments, an oligonucleotide can have any format or structural element thereof described herein or known in the art.

In some embodiments, an oligonucleotide capable of directing a decrease in the expression and/or level of a target gene or its gene product can have any format or structural element thereof described herein or known in the art.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can have any format or structural element thereof described herein or known in the art.

In some embodiments, an oligonucleotide capable of directing single-stranded RNA interference (a ssRNAi agent or ssRNAi) is represented by the structure:
5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-(N26-PX26-N27-PX27)$_{yz}$-(CAP)$_{zz}$-3'.

In some embodiments, a ssRNAi has a format depicted in FIG. 1.

Non-limiting examples of a ssRNAi of Format 1 include: WV-4270.

Non-limiting examples of a ssRNAi of Format 2 include: WV-4271, and WV-3122.

Non-limiting examples of a ssRNAi of Format 3 include: WV-2696.

Non-limiting examples of a ssRNAi of Format 4 include: WV-2716.

Non-limiting examples of a ssRNAi of Format 5 include: WV-2717.

Non-limiting examples of a ssRNAi of Format 6 include: WV-2146.

Non-limiting examples of a ssRNAi of Format 7 include: WV-2155.

Non-limiting examples of a ssRNAi of Format 8 include: WV-1831.

Non-limiting examples of a ssRNAi of Format 9 include: WV-2110.

Non-limiting examples of a ssRNAi of Format 10 include: WV-2112.

Non-limiting examples of a ssRNAi of Format 11 include: WV-1275.

Non-limiting examples of a ssRNAi of Format 12 include: WV-1307.

Non-limiting examples of a ssRNAi of Format 13 include: WV-1830.

Non-limiting examples of a ssRNAi of Format 14 include: WV-1829.

Non-limiting examples of a ssRNAi of Format 15 include: WV-1277.

Non-limiting examples of a ssRNAi of Format 16 include: WV-2721.

Non-limiting examples of a ssRNAi of Format 17 include: WV-4010.

Non-limiting examples of a ssRNAi of Format 18 include: WV-4011, and WV-4017.

Non-limiting examples of a ssRNAi of Format 19 include: WV-5301.

Non-limiting examples of a ssRNAi of Format 20 include: WV-2712.

Non-limiting examples of a ssRNAi of Format 21 include: WV-2713.

Non-limiting examples of a ssRNAi of Format 22 include: WV-3068.

Non-limiting examples of a ssRNAi of Format 23 include: WV-3245, and WV-3248.

Non-limiting examples of a ssRNAi of Format 24 include: WV-3249.

Non-limiting examples of a ssRNAi of Format 25 include: WV-3532.

Non-limiting examples of a ssRNAi of Format 26 include: WV-2652.

Non-limiting examples of a ssRNAi of Format 27 include: WV-2653.

Non-limiting examples of a ssRNAi of Format 28 include: WV-2654.

Non-limiting examples of a ssRNAi of Format 29 include: WV-6766.

Non-limiting examples of a ssRNAi of Format 30 include: WV-2157, WV-2113, and WV-2149.

Non-limiting examples of a ssRNAi of Format 31 include: WV-2148, and WV-2156.

Non-limiting examples of a ssRNAi of Format 32 include: WV-3069.

Non-limiting examples of a ssRNAi of Format 33 include: WV-2818.

Non-limiting examples of a ssRNAi of Format 34 include: WV-5297.

Non-limiting examples of a ssRNAi of Format 35 include: WV-5292, and WV-5293.

Non-limiting examples of a ssRNAi of Format 36 include: WV-5288, and WV-5289.

Non-limiting examples of a ssRNAi of Format 38 include: WV-6035.

Non-limiting examples of a ssRNAi of Format 39 include: WV-5298, and WV-5299.

Non-limiting examples of a ssRNAi of Format 40 include: WV-5294, and WV-5295.

Non-limiting examples of a ssRNAi of Format 41 include: WV-6439, and WV-7542.

Non-limiting examples of a ssRNAi of Format 42 include: WV-6765, and WV-6763.

Non-limiting examples of a ssRNAi of Format 43 include: WV-6731.

Non-limiting examples of a ssRNAi of Format 44 include: WV-6458.

Non-limiting examples of a ssRNAi of Format 45 include: WV-6459.

Non-limiting examples of a ssRNAi of Format 46 include: WV-6460.

Non-limiting examples of a ssRNAi of Format 47 include: WV-6461.

Non-limiting examples of a ssRNAi of Format 48 include: WV-6462.

Non-limiting examples of a ssRNAi of Format 49 include: WV-6463.

Non-limiting examples of a ssRNAi of Format 50 include: WV-6464.

Non-limiting examples of a ssRNAi of Format 51 include: WV-6465.

Non-limiting examples of a ssRNAi of Format 52 include: WV-6466.

Non-limiting examples of a ssRNAi of Format 53 include: WV-6467.

Non-limiting examples of a ssRNAi of Format 54 include: WV-6468.

Non-limiting examples of a ssRNAi of Format 55 include: WV-6469.

Non-limiting examples of a ssRNAi of Format 56 include: WV-6470.

Non-limiting examples of a ssRNAi of Format 57 include: WV-6496.

Non-limiting examples of a ssRNAi of Format 58 include: WV-6497.

Non-limiting examples of a ssRNAi of Format 59 include: WV-6498.

Non-limiting examples of a ssRNAi of Format 60 include: WV-6499.

Non-limiting examples of a ssRNAi of Format 61 include: WV-6500.

Non-limiting examples of a ssRNAi of Format 62 include: WV-6501.

Non-limiting examples of a ssRNAi of Format 63 include: WV-6502.

Non-limiting examples of a ssRNAi of Format 64 include: WV-6503.

Non-limiting examples of a ssRNAi of Format 65 include: WV-7521, and WV-7522.

Non-limiting examples of a ssRNAi of Format 66 include: WV-7523, and WV-7524.

Non-limiting examples of a ssRNAi of Format 67 include: WV-7525.

Non-limiting examples of a ssRNAi of Format 68 include: WV-7526.

Non-limiting examples of a ssRNAi of Format 69 include: WV-7527, and WV-7528.

Non-limiting examples of a ssRNAi of Format 70 include: WV-7540, and WV-7543.

Non-limiting examples of a ssRNAi of Format 71 include: WV-7544.

Non-limiting examples of a ssRNAi of Format 72 include WV-6432.

Non-limiting examples of a ssRNAi of Format 73 include: WV-6433.

Non-limiting examples of a ssRNAi of Format 74 include: WV-6434.

Non-limiting examples of a ssRNAi of Format 75 include: WV-6435.

Non-limiting examples of a ssRNAi of Format 76 include: WV-6436.

Non-limiting examples of a ssRNAi of Format 77 include: WV-6437.

Non-limiting examples of a ssRNAi of Format 78 include: WV-6438.

Non-limiting examples of a ssRNAi of Format 79 include: WV-7635, WV-7636, WV-7643, and WV-7644.

Non-limiting examples of a ssRNAi of Format 80 include: WV-7637, WV-7638, WV-7645, and WV-7646.

Non-limiting examples of a ssRNAi of Format 81 include: WV-7639, WV-7640, WV-7647, and WV-7648.

Non-limiting examples of a ssRNAi of Format 82 include: WV-7641, WV-7642, WV-7649, and WV-7650.

In some of formats 79 to 82, 5'-Me can be 5'-(R)-Me or 5'-(S)-Me.

Non-limiting examples of a ssRNAi of Format 83 include: WV-5300.

Non-limiting examples of a ssRNAi of Format 84 include: WV-6416.

Non-limiting examples of a ssRNAi of Format 85 include: WV-6417.

Non-limiting examples of a ssRNAi of Format 86 include: WV-6418.

Non-limiting examples of a ssRNAi of Format 87 include: WV-6426.

Non-limiting examples of a ssRNAi of Format 88 include: WV-6427.

Non-limiting examples of a ssRNAi of Format 89 include: WV-6428.

Non-limiting examples of a ssRNAi of Format 90 include: WV-4949.

Non-limiting examples of a ssRNAi of Format 91 include: WV-6035.

Non-limiting examples of a ssRNAi of Format 92 include: WV-2718.

Non-limiting examples of a ssRNAi of Format 93 include: WV-2719.

Non-limiting examples of a ssRNAi of Format 94 include: WV-2714.

Non-limiting examples of a ssRNAi of Format 95 include: WV-2715.

Non-limiting examples of a ssRNAi of Format 96 include: WV-2386.

Non-limiting examples of a ssRNAi of Format 97 include: WV-2655.

Non-limiting examples of a ssRNAi of Format 98 include: WV-2656.

Non-limiting examples of a ssRNAi of Format 99 include: WV-2657.

Non-limiting examples of a ssRNAi of Format 100 include: WV-2658.

Non-limiting examples of a ssRNAi of Format 101 include: WV-2111.

Non-limiting examples of a ssRNAi of Format 102 include: WV-2153.

Non-limiting examples of a ssRNAi of Format 103 include: WV-2819.

Non-limiting examples of a ssRNAi of Format 104 include: WV-7302.

Non-limiting examples of a ssRNAi of Format 105 include: WV-7303.

Non-limiting examples of a ssRNAi of Format 106 include: WV-7304.

Non-limiting examples of a ssRNAi of Format 107 include: WV-7305.

Additional non-limiting examples of various ssRNAi formats are embodied by various single-stranded RNAi agents described herein.

In some embodiments, a provided single-stranded RNAi comprises a 5'-end represented by any 5'-end of any single-stranded RNAi format depicted in FIG. 1 or any single-stranded RNAi agent or single-stranded RNAi format described herein.

In some embodiments, a provided single-stranded RNAi comprises a 5'-end structure or 5'-end region represented by any 5'-end structure or 5'-end region of any single-stranded RNAi format depicted in FIG. 1 or any single-stranded RNAi agent or single-stranded RNAi format described herein.

In some embodiments, a provided single-stranded RNAi comprises a 5'-nucleotide represented by any 5'-nucleotide of any single-stranded RNAi format depicted in FIG. 1 or any single-stranded RNAi agent or single-stranded RNAi format described herein.

In some embodiments, a provided single-stranded RNAi comprises a 5'-nucleoside represented by any 5'-nucleoside of any single-stranded RNAi format depicted in FIG. 1 or any single-stranded RNAi agent or single-stranded RNAi format described herein.

In some embodiments, a provided single-stranded RNAi comprises a seed region represented by any seed region of any single-stranded RNAi format depicted in FIG. 1 or any single-stranded RNAi agent or single-stranded RNAi format described herein.

In some embodiments, a provided single-stranded RNAi comprises a post-seed region represented by any post-seed region of any single-stranded RNAi format depicted in FIG. 1 or any single-stranded RNAi agent or single-stranded RNAi format described herein.

In some embodiments, a provided single-stranded RNAi comprises a post-seed region or component thereof represented by any post-seed region or component thereof of any single-stranded RNAi format depicted in FIG. 1 or any single-stranded RNAi agent or single-stranded RNAi format described herein.

In some embodiments, a provided single-stranded RNAi comprises a 3'-terminal dinucleotide represented by any 3'-terminal dinucleotide of any single-stranded RNAi format depicted in FIG. 1 or any single-stranded RNAi agent or single-stranded RNAi format described herein.

In some embodiments, a provided single-stranded RNAi comprises a seed region having a pattern of internucleotidic linkages represented by the pattern of internucleotidic linkages of any seed region of any single-stranded RNAi format depicted in FIG. 1 or any single-stranded RNAi agent or single-stranded RNAi format described herein.

In some embodiments, a provided single-stranded RNAi comprises a post-seed region having a pattern of internucleotidic linkages represented by the pattern of internucleotidic linkages of any post-seed region of any single-stranded RNAi format depicted in FIG. 1 or any single-stranded RNAi agent or single-stranded RNAi format described herein.

In some embodiments, a provided single-stranded RNAi comprises a post-seed region or component thereof having a pattern of internucleotidic linkages represented by the pattern of internucleotidic linkages of any post-seed region or component thereof of any single-stranded RNAi format depicted in FIG. 1 or any single-stranded RNAi agent or single-stranded RNAi format described herein.

In some embodiments, a provided single-stranded RNAi comprises a 3'-terminal dinucleotide having a pattern of internucleotidic linkages represented by the pattern of internucleotidic linkages of any 3'-terminal dinucleotide of any single-stranded RNAi format depicted in FIG. 1 or any single-stranded RNAi agent or single-stranded RNAi format described herein.

In some embodiments, a provided single-stranded RNAi comprises a seed region having a pattern of chemical modifications represented by the pattern of chemical modifications of any seed region of any single-stranded RNAi format depicted in FIG. 1 or any single-stranded RNAi agent or single-stranded RNAi format described herein.

In some embodiments, a provided single-stranded RNAi comprises a post-seed region having a pattern of chemical modifications represented by the pattern of chemical modifications of any post-seed region of any single-stranded RNAi format depicted in FIG. 1 or any single-stranded RNAi agent or single-stranded RNAi format described herein.

In some embodiments, a provided single-stranded RNAi comprises a post-seed region or component thereof having a pattern of chemical modifications represented by the pattern of chemical modifications of any post-seed region or component thereof of any single-stranded RNAi format depicted in FIG. 1 or any single-stranded RNAi agent or single-stranded RNAi format described herein.

In some embodiments, a provided single-stranded RNAi comprises a 3'-terminal dinucleotide having a pattern of chemical modifications represented by the pattern of chemical modifications of any 3'-terminal dinucleotide of any single-stranded RNAi format depicted in FIG. 1 or any single-stranded RNAi agent or single-stranded RNAi format described herein.

In some embodiments, a provided single-stranded RNAi comprises a chemical modification represented by any chemical modification of any single-stranded RNAi format depicted in FIG. 1 or any single-stranded RNAi agent or single-stranded RNAi format described herein.

In some embodiments, a provided single-stranded RNAi comprises a chemical modification represented by any chemical modification of any single-stranded RNAi format depicted in FIG. 1 or described herein, wherein the chemical modification is conjugation of a moiety comprising a phosphate, linker, or a targeting moiety.

In some embodiments, a provided single-stranded RNAi comprises a chemical modification represented by any chemical modification of any single-stranded RNAi format depicted in FIG. 1 or described herein, wherein the chemical modification is conjugation of a moiety comprising a phosphate, linker, or a targeting moiety, wherein the targeting moiety comprises a GalNAc moiety. In some embodiments, a GalNAc is a protected or de-protected GalNAc.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can have any format or structural element thereof described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can have any format or structural element thereof described herein or known in the art in combination with any other structural element or modification described herein, including but not limited to, base sequence or portion thereof, sugar, base; internucleotidic linkage; stereochemistry or pattern thereof; additional chemical moiety, including but not limited to, a targeting moiety, lipid moiety, a GalNAc moiety, etc.; 5'-end structure; 5'-end region; 5' nucleotide moiety; seed region; post-seed region; 3'-end region; 3'-terminal dinucleotide; 3'-end cap; GC content; long GC stretch; pattern of modifications of sugars, bases or internucleotidic linkages; format or any structural element thereof, and/or any other structural element or modification described herein; and in some embodiments, the present disclosure pertains to multimers of any such oligonucleotides.

In some embodiments, an oligonucleotide is capable of decreasing the expression, activity and/or level of a target gene and/or a gene product thereof and has the format of any oligonucleotide described herein. In some embodiments, an oligonucleotide is capable of decreasing the expression, activity and/or level of a target gene and/or a gene product thereof via a RNaseH-mediated mechanism or mechanism related to steric hindrance of translation and has the format of any oligonucleotide described herein. In some embodiments, an oligonucleotide is capable of decreasing the expression, activity and/or level of a target gene and/or a gene product thereof via a RNaseH-mediated mechanism or mechanism related to steric hindrance of translation and has an asymmetric format. In some embodiments, an oligonucleotide which has an asymmetric format comprises a first wing, a core and a second wing, wherein the core comprises a region of 5 or more contiguous 2'-deoxy nucleotides which can anneal to a target mRNA and form a structure recognized by RNaseH, and wherein the structure of the first and second wings are different. In some embodiments, the first and second wings differ in their 2'-modifications and/or internucleotidic linkages, or pattern of stereochemistry of the internucleotidic linkages.

In some embodiments, an oligonucleotide is capable of decreasing the expression, activity and/or level of a target gene and/or a gene product thereof comprises a neutral internucleotidic linkage (e.g., a neutral backbone).

In some embodiments, an oligonucleotide comprises a neutral backbone. In some embodiments, an oligonucleotide comprises an internucleotidic linkage which is or comprises a triazole, neutral triazole, or alkyne. In some embodiments, a nucleic acid (including but not limited to an oligonucleotide) which comprises an internucleotidic linkage which comprises a triazole, neutral triazole, or alkyne, wherein the internucleotidic linkage is stereocontrolled and in the Rp or Sp configuration. In some embodiments, an internucleotidic linkage comprising a triazole has a formula of:

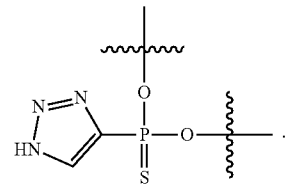

In some embodiments, an internucleotidic linkage comprising a neutral triazole has the formula of:

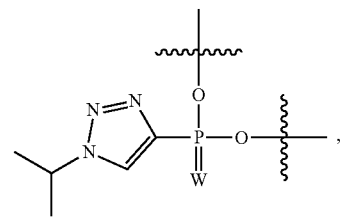

where W is O or S. In some embodiments, an internucleotidic linkage comprising an alkyne has the formula of:

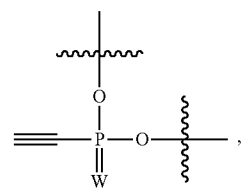

wherein W is O or S. In some embodiments, an internucleotidic linkage comprises a cyclic guanidine. In some embodiments,

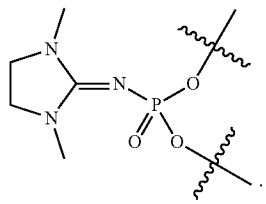

In some embodiments, a neutral internucleotidic linkage or internucleotidic linkage comprising a cyclic guanidine is stereochemically controlled. In some embodiments, a neutral internucleotidic linkage improves the activity, delivery and/or stability of an oligonucleotide and/or the ability of an oligonucleotide to perform endosomal escape.

Length of an Oligonucleotide

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides can have any length, wherein the length of an oligonucleotide is such that the oligonucleotide is capable of directing a decrease in the expression and/or level of a target gene or its gene product.

In some embodiments, the length of an oligonucleotide is such that the oligonucleotide is capable of directing a decrease in the expression and/or level of a target gene or its gene product.

In some embodiments, the length of a RNAi agent is such that the RNAi agent is capable of directing RNA interference of a specific target transcript in a sequence-specific manner. In some embodiments, the RNAi agent comprises a sufficient number of nucleobases of sufficient identity to recognize a target transcript. In some embodiments, the RNAi agent is also be of a length suitable for mediating RNAi interference.

The target portion of the sequence will be at least long enough to serve as a substrate for iRNA-directed cleavage at or near that portion. For example, the target sequence will generally be from about 9-36 nucleotides ("nt") in length, e.g., about 15-30 nucleotides in length, including all subranges therebetween.

As non-limiting examples, the target sequence can be from about 15-30 nt, about 15-26 nt, about 15-23 nt, about 15-22 nt, about 15-21 nt, about 15-20 nt, about 15-19 nt, about 15-18 nt, about 15-17 nt, about 18-30 nt, about 18-26 nt, about 18-23 nt, about 18-22 nt, about 18-21 nt, about 18-20 nt, about 19-30 nt, about 19-26 nt, about 19-23 nt, about 19-22 nt, about 19-21 nt, about 19-20 nt, about 20-30 nt, about 20-26 nt, about 20-25 nt, about 20-24 nt, about 20-23 nt, about 20-22 nt, about 20-21 nt, about 21-30 nt, about 21-26 nt, about 21-25 nt, about 21-24 nt, about 21-23 nt, or about 21-22 nt.

In some embodiments, a single-stranded RNAi agent is less than 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 bases long (wherein the term "bases" as used herein includes any combination of bases).

In some embodiments, a single-stranded RNAi agent is more than 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 bases long Examples of single-stranded RNAi agents of various lengths are shown in Table 1A.

FIG. 1 illustrates non-limiting examples of single-stranded RNAi agents having lengths from 19 to 25. Single-stranded RNAi agents having any of each of these lengths were constructed and found to be capable of knocking down a target gene. Thus, a provided single-stranded RNAi agent can be any of a variety of different lengths.

Non-limiting examples of formats of ssRNAi agents which are 19 bases long include: Formats 20-21 of FIG. 1.

Non-limiting examples of ssRNAi agents which are 19 bases long include: WV-2712 and WV-2713, Table 20.

Non-limiting examples of formats of ssRNAi agents which are 20 bases long include: Format 19 of FIG. 1.

Non-limiting examples of ssRNAi agents which are 20 bases long include: WV-5300, Table 36; and WV-5301, Table 37.

Non-limiting examples of formats of ssRNAi agents which are 21 bases long include: Formats 1-18, 22-30, and 34-38 of FIG. 1.

Non-limiting examples of formats of ssRNAi agents which are 23 bases long include: Formats 39-43 of FIG. 1. Non-limiting examples of formats of ssRNAi agents which are 23 bases long include: WV-5298, WV-5299, WV-5294, WV-5295, WV-6439, WV-7542, WV-6765, WV-6763, and WV-6731.

Non-limiting examples of formats of ssRNAi agents which are 25 bases long include: Formats 31-33 of FIG. 1. Non-limiting examples of formats of ssRNAi agents which are 25 bases long include: WV-2148, WV-2156, WV-3069, WV-2818.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any length described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any length described herein or known in the art in combination with any other structural element or modification described herein, including but not limited to, base sequence or portion thereof, sugar, base; internucleotidic linkage; stereochemistry or pattern thereof; additional chemical moiety, including but not limited to, a targeting moiety, lipid moiety, a GalNAc moiety, etc.; 5'-end structure; 5'-end region; 5' nucleotide moiety; seed region; post-seed region; 3'-end region; 3'-terminal dinucleotide; 3'-end cap; GC content; long GC stretch;

pattern of modifications of sugars, bases or internucleotidic linkages; format or any structural element thereof, and/or any other structural element or modification described herein; and in some embodiments, the present disclosure pertains to multimers of any such oligonucleotides.

GC Content of an Oligonucleotide

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides can have any GC content, wherein the GC content of an oligonucleotide is such that the oligonucleotide is capable of directing a decrease in the expression and/or level of a target gene or its gene product.

In some embodiments, the GC content of an oligonucleotide is such that the oligonucleotide is capable of directing a decrease in the expression and/or level of a target gene or its gene product.

In some embodiments, the GC content of a RNAi agent is such that the RNAi agent is capable of directing RNA interference of a specific target transcript in a sequence-specific manner.

In some embodiments, an oligonucleotide has a high GC-content.

In some embodiments, an oligonucleotide capable of directing a decrease in the expression and/or level of a target gene or its gene product has a high GC-content.

In some embodiments, a single-stranded RNAi agent has a high GC-content.

Data presented herein shows that ssRNAi agents, including those having formats disclosed herein, can have a high GC content.

In some cases, a single-stranded RNAi agent can have a higher GC content than a double-stranded RNAi agent. For example, U.S. Pat. No. 7,507,811 to Khvorova et al. report criteria for designing double stranded RNAi agents. This patent reports that: rationally designed double-stranded siRNA can be identified by maximizing one or more of the following criteria, including a low GC content, preferably between about 30-52%. The patent also reports that: GC content may be important for easement of the unwinding of double stranded siRNA duplex, and that duplex unwinding has been shown to be crucial for siRNA functionality in vivo. See also Reynolds et al. 2004 Nature Biotech. 22: 326-330, which also reports the range of 30-52% for GC content for dsRNAi.

However, unwinding of a duplex of an antisense and sense strand is not required for single-stranded RNAi agent functionality, as a single-stranded RNAi agent lacks a sense strand.

Data shown herein demonstrates efficacious ssRNAi agents with GC content higher than 52%. The present disclosure shows that efficacious single-stranded RNAi agents with GC content of up to 74% are capable of directing RNA interference in vitro.

The increase in range of suitable GC content for single-stranded RNAi compared to double-stranded RNAi allows the exploration of a greater number of potential target sequences. Thus, potential target sequences in a higher GC content range may be explored for use in single-stranded RNAi agents than for double-stranded RNAi agents.

As non-limiting examples:

Non-limiting examples of efficacious single-stranded RNAi agents with a GC content of 74% were constructed and were found to be capable of directing RNA interference against a target gene in Cos7 cells in vitro (data not shown).

Non-limiting examples of efficacious single-stranded RNAi agents with a GC content of 70% were were constructed and were found to be capable of directing RNA interference against a target gene in Cos7 cells in vitro (data not shown).

Non-limiting examples of efficacious single-stranded RNAi agents with a GC content of 62% include: WV-4017, Table 4C; WV-4016, Table 4C; WV-3137, Table 32; WV-1831, Table 12; WV-1830, Table 12; WV-1829, Table 12; WV-1828, Table 12; WV-1277, Table 12; and WV-1275, Table 12.

Non-limiting examples of efficacious single-stranded RNAi agents with a GC content of 57% include: WV-4275, Tables 7A and 4D; WV-4274, Tables 7A and 4D; WV-4269, Table 4D; WV-4015, Table 4C; WV-4014, Table 4C; WV-4009, Table 4B; WV-4007, Table 4B; WV-2146, Table 3B; WV-2112, Table 3A; WV-2148, Table 3C; and WV-2113, Table 3A.

Additional efficacious ssRNAi agents disclosed herein have a range of GC content down to 32%.

Non-limiting examples of efficacious single-stranded RNAi agents with a GC content of 52% include: WV-4273, Table 4D; WV-4272, Table 4D; WV-4271, Table 4D; WV-4270, Table 4D; WV-4013, Table 4C; WV-4012, Table 4C; WV-4011, Table 4B; WV-4010, Table 4B; WV-3762, Table 4A; WV-3761, Table 4A; WV-2147, Table 3B; and WV-2149, Table 3C.

Non-limiting examples of efficacious single-stranded RNAi agents with a GC content of 48% include: WV-3069, Table 25; WV-2820, Table 26; WV-2157, Table 24; WV-2156, Table 24; WV-2111, Table 21; and WV-6763, Table 38.

Non-limiting examples of efficacious single-stranded RNAi agents with a GC content of 44% include: WV-7469, Table 69B; WV-7468, Table 69A; WV-7466, Table 69A; WV-7465, Table 69A; WV-7464, Table 68; and WV-7462, Table 68.

Non-limiting examples of efficacious single-stranded RNAi agents with a GC content of 43% include: WV-6766, Tables 40 and 41; WV-5296, Table 37; WV-5292, Table 37; WV-5288, Table 37; and WV-4161, Tables 40 and 41.

Non-limiting examples of efficacious single-stranded RNAi agents with a GC content of 40% include: WV-2134, Table 18; and WV-4064, Table 67.

Non-limiting examples of efficacious single-stranded RNAi agents with a GC content of 38% include: WV-3242, Table 36; WV-5297, Table 36; WV-5293, Table 36; and WV-5289, Table 36; in addition to many other efficacious ssRNAi agents disclosed herein.

Non-limiting examples of efficacious single-stranded RNAi agents with a GC content of 36% include: WV-2152, Table 29C; and WV-2114, Table 29C.

Non-limiting examples of efficacious single-stranded RNAi agents with a GC content of 35% include: WV-2714, Table 20; WV-5291, Table 36; WV-6765, Table 39; WV-6764, Table 39; and WV-5299, Table 36.

Non-limiting examples of efficacious single-stranded RNAi agents with a GC content of 33% include: WV-4051, Table 66; and WV-2699, Table 22.

Non-limiting examples of efficacious single-stranded RNAi agents with a GC content of 32% include: WV-2153, Table 29.

Thus, the present disclosure describes efficacious single-stranded RNAi agents with a GC content of from 70% to 33%.

In some embodiments of a single-stranded RNAi agent, the single-stranded RNAi agent has a GC content of about 32% to about 74%. In some embodiments of a single-stranded RNAi agent, the single-stranded RNAi agent has a GC content of about 32% to about 70%. In some embodiments of a single-stranded RNAi agent, the single-stranded RNAi agent has a GC content of at least 32%. In some embodiments of a single-stranded RNAi agent, the single-stranded RNAi agent has a GC content of up to about 74%. In some embodiments of a single-stranded RNAi agent, the single-stranded RNAi agent has a GC content of up to about 70%. In some embodiments of a single-stranded RNAi agent, the single-stranded RNAi agent has a GC content of up to about 62%. In some embodiments of a single-stranded RNAi agent, the single-stranded RNAi agent has a GC content of up to about 61%. In some embodiments of a single-stranded RNAi agent, the single-stranded RNAi agent has a GC content of up to about 57%. In some embodiments of a single-stranded RNAi agent, the single-stranded RNAi agent has a GC content of up to about 52%. In some embodiments of a single-stranded RNAi agent, the single-stranded RNAi agent has a GC content of up to about 48%. In some embodiments of a single-stranded RNAi agent, the single-stranded RNAi agent has a GC content of up to about 44%. In some embodiments of a single-stranded RNAi agent, the single-stranded RNAi agent has a GC content of up to about 43%. In some embodiments of a single-stranded RNAi agent, the single-stranded RNAi agent has a GC content of up to about 40%. In some embodiments of a single-stranded RNAi agent, the single-stranded RNAi agent has a GC content of at least about 62%. In some embodiments of a single-stranded RNAi agent, the single-stranded RNAi agent has a GC content of at least about 61%. In some embodiments of a single-stranded RNAi agent, the single-stranded RNAi agent has a GC content of at least about 57%. In some embodiments of a single-stranded RNAi agent, the single-stranded RNAi agent has a GC content of at least about 52%. In some embodiments of a single-stranded RNAi agent, the single-stranded RNAi agent has a GC content of at least about 48%. In some embodiments of a single-stranded RNAi agent, the single-stranded RNAi agent has a GC content of at least about 44%. In some embodiments of a single-stranded RNAi agent, the single-stranded RNAi agent has a GC content of at least about 43%. In some embodiments of a single-stranded RNAi agent, the single-stranded RNAi agent has a GC content of at least about 40%. In some embodiments of a single-stranded RNAi agent, the single-stranded RNAi agent has a GC content of at least about 38%. In some embodiments of a single-stranded RNAi agent, the single-stranded RNAi agent has a GC content of at least about 36%. In some embodiments of a single-stranded RNAi agent, the single-stranded RNAi agent has a GC content of at least about 35%. In some embodiments of a single-stranded RNAi agent, the single-stranded RNAi agent has a GC content of at least about 33%. In some embodiments of a single-stranded RNAi agent, the single-stranded RNAi agent has a GC content of at least about 32%. In some embodiments of a single-stranded RNAi agent, the single-stranded RNAi agent has a GC content of up to about 70%. In some embodiments of a single-stranded RNAi agent, the single-stranded RNAi agent has a GC content of up to about 65%. In some embodiments of a single-stranded RNAi agent, the single-stranded RNAi agent has a GC content of up to about 60%. In some embodiments of a single-stranded RNAi agent, the single-stranded RNAi agent has a GC content of up to about 55%. In some embodiments of a single-stranded RNAi agent, the single-stranded RNAi agent has a GC content of up to about 50%. In some embodiments of a single-stranded RNAi agent, the single-stranded RNAi agent has a GC content of up to about 45%. In some embodiments of a single-stranded RNAi agent, the single-stranded RNAi agent has a GC content of up to about 40%. In some embodiments of a single-stranded RNAi agent, the single-stranded RNAi agent has a GC content of up to about 35%. In some embodiments of a single-stranded RNAi agent, the single-stranded RNAi agent has a GC content of at least about 65%. In some embodiments of a single-stranded RNAi agent, the single-stranded RNAi agent has a GC content of at least about 60%. In some embodiments of a single-stranded RNAi agent, the single-stranded RNAi agent has a GC content of at least about 55%. In some embodiments of a single-stranded RNAi agent, the single-stranded RNAi agent has a GC content of at least about 50%. In some embodiments of a single-stranded RNAi agent, the single-stranded RNAi agent has a GC content of at least about 45%. In some embodiments of a single-stranded RNAi agent, the single-stranded RNAi agent has a GC content of at least about 40%. In some embodiments of a single-stranded RNAi agent, the single-stranded RNAi agent has a GC content of at least about 35%. In some embodiments of a single-stranded RNAi agent, the single-stranded RNAi agent has a GC content of at least about 30%. In some embodiments of a single-stranded RNAi agent, the single-stranded RNAi agent has a GC content of between about 50% and 60%. In some embodiments of a single-stranded RNAi agent, the single-stranded RNAi agent has a GC content of between about 45% and 60%. In some embodiments of a single-stranded RNAi agent, the single-stranded RNAi agent has a GC content of between about 55% and 60%. In some embodiments of a single-stranded RNAi agent, the single-stranded RNAi agent has a GC content of between about 40% and 60%. In some embodiments of a single-stranded RNAi agent, the single-stranded RNAi agent has a GC content of between about 35% and 60%. In some embodiments of a single-stranded RNAi agent, the single-stranded RNAi agent has a GC content of between about 50% and 65%. In some embodiments of a single-stranded RNAi agent, the single-stranded RNAi agent has a GC content of between about 45% and 65%. In some embodiments of a single-stranded RNAi agent, the single-stranded RNAi agent has a GC content of between about 40% and 65%. In some embodiments of a single-stranded RNAi agent, the single-stranded RNAi agent has a GC content of between about 35% and 65%. In some embodiments of a single-stranded RNAi agent, the single-stranded RNAi agent has a GC content of between about 65% and 74%. In some embodiments of a single-stranded RNAi agent, the single-stranded RNAi agent has a GC content of between about 60% and 74%. In some embodiments of a single-stranded RNAi agent, the single-stranded RNAi agent has a GC content of between about 55% and 74%. In some embodiments of a single-stranded RNAi agent, the single-stranded RNAi agent has a GC content of between about 50% and 74%. In some embodiments of a single-stranded RNAi agent, the single-stranded RNAi agent has a GC content of between about 45% and 74%. In some embodiments of a single-stranded RNAi agent, the single-stranded RNAi agent has a GC content of between about 40% and 74%. In some embodiments of a single-stranded RNAi agent, the single-stranded RNAi agent has a GC content of between about 35% and 74%. In some embodiments of a single-stranded RNAi agent, the single-stranded RNAi agent has a GC content of between about 32% and 74%. In some embodiments of a single-stranded RNAi agent, the single-stranded RNAi agent has a GC content of up to 70%. In some embodiments of a single-stranded RNAi agent, the single-stranded RNAi agent has a GC content of up to 62%. In some embodiments of a single-stranded RNAi agent, the single-stranded RNAi agent has a GC content of up to 61%. In some embodiments of a single-stranded RNAi agent, the single-stranded RNAi agent has a GC content of up to 57%. In some embodiments of a single-stranded RNAi agent, the single-stranded RNAi agent has a GC content of up to 52%. In some embodiments of a single-stranded RNAi agent, the single-stranded RNAi agent has a GC content of up to 48%. In some embodiments of a single-stranded RNAi agent, the single-stranded RNAi agent has a GC content of up to 44%. In some embodiments of a single-stranded RNAi agent, the single-stranded RNAi agent has a GC content of up to 43%. In some embodiments of a single-stranded RNAi agent, the single-stranded RNAi agent has a GC content of up to 40%. In some embodiments of a single-stranded RNAi agent, the single-stranded RNAi agent has a GC content of at least 62%. In some embodiments of a single-stranded RNAi agent, the single-stranded RNAi agent has a GC content of at least 61%. In some embodiments of a single-stranded RNAi agent, the single-stranded RNAi agent has a GC content of at least 57%. In some embodiments of a single-stranded RNAi agent, the single-stranded RNAi agent has a GC content of at least 52%. In some embodiments of a single-stranded RNAi agent, the single-stranded RNAi agent has a GC content of at least 48%. In some embodiments of a single-stranded RNAi agent, the single-stranded RNAi agent has a GC content of at least 44%. In some embodiments of a single-stranded RNAi agent, the single-stranded RNAi agent has a GC content of at least 43%. In some embodiments of a single-stranded RNAi agent, the single-stranded RNAi agent has a GC content of at least 40%. In some embodiments of a single-stranded RNAi agent, the single-stranded RNAi agent has a GC content of at least 38%. In some embodiments of a single-stranded RNAi agent, the single-stranded RNAi agent has a GC content of at least 36%. In some embodiments of a single-stranded RNAi agent, the single-stranded RNAi agent has a GC content of at least 35%. In some embodiments of a single-stranded RNAi agent, the single-stranded RNAi agent has a GC content of at least 33%. In some embodiments of a single-stranded RNAi agent, the single-stranded RNAi agent has a GC content of at least 32%. In some embodiments of a single-stranded RNAi agent, the single-stranded RNAi agent has a GC content of up to 70%. In some embodiments of a single-stranded RNAi agent, the single-stranded RNAi agent has a GC content of up to 65%. In some embodiments of a single-stranded RNAi agent, the single-stranded RNAi agent has a GC content of up to 60%. In some embodiments of a single-stranded RNAi agent, the single-stranded RNAi agent has a GC content of up to 55%. In some embodiments of a single-stranded RNAi agent, the single-stranded RNAi agent has a GC content of up to 50%. In some embodiments of a single-stranded RNAi agent, the single-stranded RNAi agent has a GC content of up to 45%. In some embodiments of a single-stranded RNAi agent, the single-stranded RNAi agent has a GC content of up to 40%. In some embodiments of a single-stranded RNAi agent, the single-stranded RNAi agent has a GC content of up to 35%. In some embodiments of a single-stranded RNAi agent, the single-stranded RNAi agent has a GC content of at least 65%. In some embodiments of a single-stranded RNAi agent, the single-stranded RNAi agent has a GC content of at least 60%. In some embodiments of a single-stranded RNAi agent, the single-stranded RNAi agent has a GC content of at least 55%. In some embodiments of a single-stranded RNAi agent, the single-stranded RNAi agent has a GC content of at least 50%. In some embodiments of a single-stranded RNAi agent, the single-stranded RNAi agent has a GC content of at least 45%. In some embodiments of a single-stranded RNAi agent, the single-stranded RNAi agent has a GC content of at least 40%. In some embodiments of a single-stranded RNAi agent, the single-stranded RNAi agent has a GC content of at least 35%. In some embodiments of a single-stranded RNAi agent, the single-stranded RNAi agent has a GC content of at least 30%. In some embodiments of a single-stranded RNAi agent, the single-stranded RNAi agent has a GC content of between 50% and 60%. In some embodiments of a single-stranded RNAi agent, the single-stranded RNAi agent has a GC content of between 45% and 60%. In some embodiments of a single-stranded RNAi agent, the single-stranded RNAi agent has a GC content of between 55% and 60%. In some embodiments of a single-stranded RNAi agent, the single-stranded RNAi agent has a GC content of between 40% and 60%. In some embodiments of a single-stranded RNAi agent, the single-stranded RNAi agent has a GC content of between 35% and 60%. In some embodiments of a single-stranded RNAi agent, the single-stranded RNAi agent has a GC content of between 50% and 65%. In some embodiments of a single-stranded RNAi agent, the single-stranded RNAi agent has a GC content of between 45% and 65%. In some embodiments of a single-stranded RNAi agent, the single-stranded RNAi agent has a GC content of between 40% and 65%. In some embodiments of a single-stranded RNAi agent, the single-stranded RNAi agent has a GC content of between 35% and 65%. In some embodiments of a single-stranded RNAi agent, the single-stranded RNAi agent has a GC content of between 65% and 74%. In some embodiments of a single-stranded RNAi agent, the single-stranded RNAi agent has a GC content of between 60% and 74%. In some embodiments of a single-stranded RNAi agent, the single-stranded RNAi agent has a GC content of between 55% and 74%. In some embodiments of a single-stranded RNAi agent, the single-stranded RNAi agent has a GC content of between 50% and 74%. In some embodiments of a single-stranded RNAi agent, the single-stranded RNAi agent has a GC content of between 45% and 74%. In some embodiments of a single-stranded RNAi agent, the single-stranded RNAi agent has a GC content of between 40% and 70%. In some embodiments of a single-stranded RNAi agent, the single-stranded RNAi agent has a GC content of between 35% and 70%. In some embodiments of a single-stranded RNAi agent, the single-stranded RNAi agent has a GC content of between 32% and 70%.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any GC content, including, but not limited to, 32-74%, described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any GC content described herein or known in the art in combination with any other structural element or modification described herein, including but not limited to, base sequence or portion thereof, sugar, base; internucleotidic linkage; stereochemistry or pattern thereof; additional chemical moiety, including but not limited to, a targeting moiety, lipid moiety, a GalNAc moiety, etc.; 5'-end structure; 5'-end region; 5' nucleotide moiety; seed region; post-seed region; 3'-end region; 3'-terminal dinucleotide; 3'-end cap; length; long GC stretch; pattern of modifications of sugars, bases or internucleotidic linkages; format or any structural element thereof, and/or any other structural element or modification described herein; and in some embodiments, the present disclosure pertains to multimers of any such oligonucleotides.

An Oligonucleotide Having Long GC Stretches

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides can have any length of the longest GC stretch, wherein the length of the longest GC stretch of an oligonucleotide is such that the oligonucleotide is capable of directing a decrease in the expression and/or level of a target gene or its gene product.

In some embodiments, the length of the longest GC stretch of an oligonucleotide is such that the oligonucleotide is capable of directing a decrease in the expression and/or level of a target gene or its gene product.

In some embodiments, the length of the longest GC stretch of a RNAi agent is such that the RNAi agent is capable of directing RNA interference of a specific target transcript in a sequence-specific manner.

In some embodiments, a single-stranded RNAi agent has a long GC stretch, wherein a GC stretch is defined herein as a sequence of bases wherein every base is either a G or C or a variant of G or C. In some embodiments, a single-stranded RNAi agent has a GC stretch of at least 6 nt (e.g., 6 bases in a row are G or C or a variant of G or C), 7 nt, 8 nt, 9 nt, 10 nt, 11 nt, 12 nt, or 13 nt.

Data presented herein shows that ssRNAi agents, including those having formats disclosed herein, can have a long GC stretch. In some cases, a single-stranded RNAi agent can have a longer GC stretch than a double-stranded RNAi agent.

For example, Naito et al. 2004 Nucl. Acids Res. 32: W124-W129 reported that: the rules indicate that highly effective RNAi occurs in mammalian cells and chick embryos by (double-stranded) siRNA that satisfies several conditions at the same time, including the absence of any GC stretch over 9 bp in length.

Without wishing to be bound by any particular theory, the present disclosure notes that a long GC stretch can increase the overall GC content of a RNAi agent, and, as noted above, U.S. Pat. No. 7,507,811 to Khvorova et al. reports that: rationally designed double-stranded siRNA can be identified by maximizing one or more of the following criteria, including a low GC content, preferably between about 30-52%. See also Reynolds et al. 2004 Nature Biotech. 22: 326-330, which also reports the range of 30-52% for GC content for dsRNAi.

The present disclosure notes that efficacious single-stranded RNAi agents can be constructed which have GC stretches greater than 9 nt in length.

As non-limiting examples, efficacious single-stranded RNAi agents which were constructed and found to be capable of directing RNAi interference against a target gene in Cos7 cells in vitro have a GC stretch of 11 nt (data not shown).

Thus, the present disclosure shows that single-stranded RNAi agents can comprise a long GC stretch.

Without wishing to be bound by any particular theory, the disclosure notes that the fact that a single-stranded RNAi agent, as shown herein, is less constrained by maximum GC content and maximum GC stretch lengths allows the exploration of a greater number of possible mRNA sequences as potential targets for single-stranded RNAi agents than double-stranded RNAi agents.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any long GC stretch described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any long GC stretch described herein or known in the art in combination with any other structural element or modification described herein, including but not limited to, base sequence or portion thereof, sugar, base; internucleotidic linkage; stereochemistry or pattern thereof; additional chemical moiety, including but not limited to, a targeting moiety, lipid, a GalNAc moiety, etc.; 5'-end structure; 5'-end region; 5' nucleotide moiety; seed region; post-seed region; 3'-end region; 3'-terminal dinucleotide; 3'-end cap; length; GC content; pattern of modifications of sugars, bases or internucleotidic linkages; format or any structural element thereof, and/or any other structural element or modification described herein; and in some embodiments, the present disclosure pertains to multimers of any such oligonucleotides.

5'-End of an Oligonucleotide, Including a Single-Stranded RNAi Agent

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides can comprise any 5'-end region, 5'-end structure, 5'-end group, 5'-nucleoside, or 5'-nucleotide described herein or known in the art.

In some embodiments, the structure of the 5'-end of an oligonucleotide is such that the oligonucleotide is capable of directing a decrease in the expression and/or level of a target gene or its gene product.

In some embodiments, the structure of the 5'-end of a RNAi agent is such that the RNAi agent is capable of directing RNA interference of a specific target transcript in a sequence-specific manner.

In some embodiments, a provided oligonucleotide can comprise any 5'-end region, 5'-end structure, 5'-end group, 5'-end nucleoside, or 5'-end nucleotide described herein or known in the art. In some embodiments, a provided oligonucleotide capable of directing RNase H-mediated knockdown can comprise any 5'-end region, 5'-end structure, 5'-end group, 5'-end nucleoside, or 5'-end nucleotide described herein or known in the art. In some embodiments, a provided oligonucleotide capable of directing RNA interference can comprise any 5'-end region, 5'-end structure, 5'-end group, 5'-end nucleoside, or 5'-end nucleotide described herein or known in the art. In some embodiments, a provided oligonucleotide capable of directing RNA interference and RNase H-mediated knockdown can comprise any 5'-end region, 5'-end structure, 5'-end group, 5'-end nucleoside, or 5'-end nucleotide described herein or known in the art.

Among other things, the present disclosure recognizes that 5'-end structures of oligonucleotides, optionally in combination with additional features in accordance with the present disclosure, can provide unexpected advantages. In some embodiments, the present disclosures provides 5'-end groups (corresponding to 5'-HO—CH$_2$— of ribose found in natural RNA (or deoxyribose found in natural DNA)) that can surprisingly improve one or more properties and/or activities (e.g., stability, activity, manufacture cost, etc.) of oligonucleotides.

In some embodiments, 5'-OH groups of provided oligonucleotides are unmodified, i.e., they exist as free —OH. In some embodiments, a 5'-end group is 5'-HO—CH$_2$—. Among other things, the present disclosure demonstrates that a provided oligonucleotide with free 5'-OH groups can achieve properties and/or activities (e.g., stability, RNAi activity when used as ss-RNAi agent, etc.) comparable to an otherwise identical oligonucleotide comprising 5'-phosphate (or derivatives thereof) groups, despite reports in the literature that certain activities, e.g., RNAi activity, require presence of 5'-phosphate groups.

In some embodiments, a 5'-end group comprises no phosphorus atom. In some embodiments, a 5'-end group comprises no phosphate groups, or derivatives or bioisosteres thereof. In some embodiments, a 5'-end group comprises no acidic groups. In some embodiments, a 5'-end group comprises no carboxyl groups. In some embodiments, a 5'-end comprises no phosphorus atom or carboxyl groups. In some embodiments, a 5'-end group is 5'-HO—CH$_2$—. Among other things, the present disclosure demonstrates that provided oligonucleotides with no 5'-phosphates or derivatives or bioisosteres thereof can surprisingly achieve activities comparable to oligonucleotides that have 5'-phosphates but are otherwise identical, for example, in knockdown of mRNA levels of target genes, through RNAi pathways.

In some embodiments, a 5'-nucleoside unit of a provided oligonucleotide (which includes the sugar and nucleobase moieties but not the internucleotidic linkage between the 5'-nucleoside unit and the second nucleoside unit from the 5'-end) comprises no phosphate group, or derivatives or bioisosteres thereof. In some embodiments, a 5'-nucleoside unit comprises no phosphorus atom. In some embodiments, a 5'-nucleoside comprises no acidic groups. In some embodiments, a 5'-nucleoside unit comprises no —COOH groups or a salt form thereof.

In some embodiments, a 5'-end group is or comprises a phosphate group, or a derivative or a bioisostere thereof. In some embodiments, a 5'-nucleoside unit comprises a 5'-group which is a phosphate group, or a derivative or a bioisostere thereof. As appreciated by a person having ordinary skill in the art, a number of such groups are known in the art and can be utilized in accordance with the present disclosure.

In some embodiments, a 5'-end group is —CH$_2$—O—P(O)(OH)—(OH) or a salt form thereof.

In some embodiments, a provided 5'-nucleoside unit has the structure of formula 5-I:

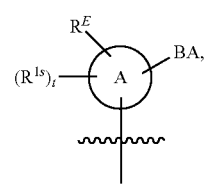

5-I or a salt form thereof, wherein:

R$^E$ is a 5'-end group;

BA is an optionally substituted group selected from C$_{1-30}$ cycloaliphatic, C$_{6-30}$ aryl, C$_{5-30}$ heteroaryl having 1-10 heteroatoms independently selected from oxygen, nitrogen, sulfur, phosphorus and silicon, C$_{3-30}$ heterocyclyl having 1-10 heteroatoms independently selected from oxygen, nitrogen, sulfur, phosphorus, boron and silicon, a natural nucleobase moiety, and a modified nucleobase moiety;

each R$^{1s}$ is independently —F, —Cl, —Br, —I, —CN, —N$_3$, —NO, —NO$_2$, -L-R', -L-OR', —OR', —SR', —N(R')$_2$, —O-L-OR', —O-L-SR', or —O-L-N(R')$_2$;

t is 0-20;

Ring A is an optionally substituted 3-20 membered monocyclic, bicyclic or polycyclic ring having 0-10 heteroatoms independently selected from independently selected from oxygen, nitrogen, sulfur, phosphorus and silicon;

L is a covalent bond, or a bivalent, optionally substituted, linear or branched group selected from a C$_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —5—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with $Cy^L$;

each $Cy^L$ is independently an optionally substituted tetravalent group selected from a $C_{3-20}$ cycloaliphatic ring, a $C_{6-20}$ aryl ring, a 5-20 membered heteroaryl ring having 1-10 heteroatoms independently selected from oxygen, nitrogen, sulfur, phosphorus and silicon, and a 3-20 membered heterocyclyl ring having 1-10 heteroatoms independently selected from oxygen, nitrogen, sulfur, phosphorus, boron and silicon;

each R' is independently —R, —C(O)R, —C(O)OR, or —S(O)$_2$R; and each R is independently —H, or an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon, or two R groups are optionally and independently taken together to form a covalent bond, or:

two or more R groups on the same atom are optionally and independently taken together with the atom to form an optionally substituted, 3-30 membered monocyclic, bicyclic or polycyclic ring having, in addition to the atom, 0-10 heteroatoms independently selected from oxygen, nitrogen, sulfur, phosphorus and silicon; or two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms independently selected from oxygen, nitrogen, sulfur, phosphorus and silicon.

In some embodiments, a 5'-end group $R^E$ has the structure of —C($R^{5s}$)$_3$ or a salt form thereof, wherein each variable is independently as described in the present disclosure. In some embodiments, a provided 5'-nucleoside unit has the structure of

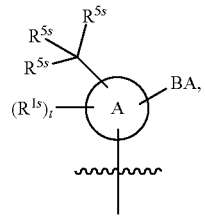

wherein each variable is independently as described in the present disclosure. In some embodiments, a provided 5'-nucleoside unit has the structure of formula 5-I-1:

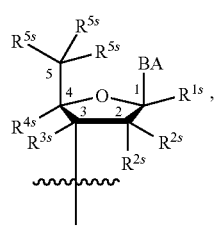

5-I-1 or a salt form thereof, wherein:

BA is an optionally substituted group selected from $C_{1-30}$ cycloaliphatic, $C_{6-30}$ aryl, $C_{5-30}$ heteroaryl having 1-10 heteroatoms independently selected from oxygen, nitrogen, sulfur, phosphorus and silicon, $C_{3-30}$ heterocyclyl having 1-10 heteroatoms independently selected from oxygen, nitrogen, sulfur, phosphorus, boron and silicon, a natural nucleobase moiety, and a modified nucleobase moiety;

each of $R^{1s}$, $R^{2s}$, $R^{3s}$, $R^{4s}$ and $R^{5s}$ is independently $R^s$;

each $R^s$ is independently —F, —Cl, —Br, —I, —CN, —N$_3$, —NO, —NO$_2$, -L-R', -L-OR', -L-SR', -L-N(R')$_2$, —O-L-OR', —O-L-SR', or —O-L-N(R')$_2$;

L is a covalent bond, or a bivalent, optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with $Cy^L$;

each $Cy^L$ is independently an optionally substituted tetravalent group selected from a $C_{3-20}$ cycloaliphatic ring, a $C_{6-20}$ aryl ring, a 5-20 membered heteroaryl ring having 1-10 heteroatoms independently selected from oxygen, nitrogen, sulfur, phosphorus and silicon, and a 3-20 membered heterocyclyl ring having 1-10 heteroatoms independently selected from oxygen, nitrogen, sulfur, phosphorus, boron and silicon;

each R' is independently —R, —C(O)R, —C(O)OR, or —S(O)$_2$R; and each R is independently —H, or an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon, or two R groups are optionally and independently taken together to form a covalent bond, or: two or more R groups on the same atom are optionally and independently taken together with the atom to form an optionally substituted, 3-30 membered monocyclic, bicyclic or polycyclic ring having, in addition to the atom, 0-10 heteroatoms independently selected from oxygen, nitrogen, sulfur, phosphorus and silicon; or two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms independently selected from oxygen, nitrogen, sulfur, phosphorus and silicon.

In some embodiments, L is $L^{5s}$, wherein $L^{5s}$ is a covalent bond, or a bivalent, optionally substituted, linear or branched $C_{1-30}$ aliphatic group wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, or —C(O)O—; and one or more carbon atoms are optionally and independently replaced with $Cy^L$.

In some embodiments, the 5'-end group, —C(R$^{5s}$)$_3$, has the structure of —C(R')$_2$-L-OR', wherein each variable is independently as described in the present disclosure. In some embodiments, —C(R$^{5s}$)$_3$ has the structure of —C(R')$_2$-L-OH, wherein each variable is independently as described in the present disclosure. In some embodiments, —C(R$^{5s}$)$_3$ has the structure of —C(R')$_2$-L-OH, wherein each variable is independently as described in the present disclosure, wherein —C(R$^{5s}$)$_3$ comprises no phosphorus atom. In some embodiments, —C(R$^{5s}$)$_3$ has the structure of —C(R')$_2$-L-OH, wherein each variable is independently as described in the present disclosure, wherein —C(R$^{5s}$)$_3$ comprises no phosphorus atom or acidic groups. In some embodiments, —C(R$^{5s}$)$_3$ has the structure of —C(R')$_2$-L-OH, wherein each variable is independently as described in the present disclosure, wherein —C(R$^{5s}$)$_3$ comprises no phosphorus atom or carboxylic acid groups. In some embodiments, —C(R$^{5s}$)$_3$ is —CH$_2$OH.

In some embodiments, a 5'-end group $R^E$ has the structure of -L-$P^{DB}$ or a salt form thereof, wherein L is independently as described in the present disclosure, and $P^{DB}$ is a phosphate group, or a derivative or a bioisostere thereof. In some embodiments, a 5'-end group $R^E$ has the structure of —CH$_2$—$P^{DB}$ or a salt form thereof, wherein L is independently as described in the present disclosure, and $P^{DB}$ is a phosphate group, or a derivative or a bioisostere thereof. In some embodiments, $P^{DB}$ is —OP(O)(OR)$_2$ or a salt form thereof, wherein each R is independently as described in the present disclosure. In some embodiments, $P^{DB}$ is —OP(O)(OR)(H) or a salt form thereof, wherein each R is independently as described in the present disclosure. In some embodiments, $P^{DB}$ is —OP(O)(OR)(SR) or a salt form thereof, wherein each R is independently as described in the present disclosure. In some embodiments, $P^{DB}$ is —OP(O)(OH)(OR) or a salt form thereof, wherein R is as described in the present disclosure. In some embodiments, $P^{DB}$ is —OP(O)(SH)(OR) or a salt form thereof, wherein R is as described in the present disclosure. In some embodiments, R is —H. In some embodiments, R is optionally substituted $C_{1-6}$ aliphatic. In some embodiments, R is optionally substituted $C_{1-6}$ alkyl. In some embodiments, R is $C_{1-6}$ alkyl. In some embodiments, R is n-propyl. In some embodiments, $P^{DB}$ is —OP(O)(OH)(OCH$_2$CH$_2$CH$_3$) or a salt form thereof. In some embodiments, $P^{DB}$ is —OP(O)(SH)(OCH$_2$CH$_2$CH$_3$) or a salt form thereof.

In some embodiments, $P^{DB}$ is —OP(O)(XR)—X-L-X—P(O)(XR)$_2$ or a salt form thereof, wherein each variable is independently as described in the present disclosure. In some embodiments, $P^{DB}$ is —OP(O)(XH)—X-L-X—P(O)(XH)(XR) or a salt form thereof, wherein each variable is independently as described in the present disclosure. In some embodiments, $P^{DB}$ is —OP(O)(XR)—X-L-X—P(O)(XR)(R) or a salt form thereof, wherein each variable is independently as described in the present disclosure. In some embodiments, $P^{DB}$ is —OP(O)(XH)—X-L-X—P(O)(XH)(R) or a salt form thereof, wherein each variable is independently as described in the present disclosure. In some embodiments, $P^{DB}$ is —OP(O)(XH)—X-L-X—P(O)(XH)(H) or a salt form thereof, wherein each variable is independently as described in the present disclosure. In some embodiments, X is O or S. In some embodiments, $P^{DB}$ is —OP(O)(XR)—O-L-O—P(O)(XR)$_2$ or a salt form thereof, wherein each variable is independently as described in the present disclosure. In some embodiments, $P^{DB}$ is —OP(O)(XR)—O-L-O—P(O)(XR)(R) or a salt form thereof, wherein each variable is independently as described in the present disclosure. In some embodiments, $P^{DB}$ is —OP(O)(XR)—O-L-O—P(O)(XR)$_2$ or a salt form thereof, wherein each variable is independently as described in the present disclosure. In some embodiments, $P^{DB}$ is —OP(O)(SR)—O-L-O—P(O)(XR)$_2$ or a salt form thereof, wherein each variable is independently as described in the present disclosure. In some embodiments, $P^{DB}$ is —OP(O)(OR)—O-L-O—P(O)(XR)$_2$ or a salt form thereof, wherein each variable is independently as described in the present disclosure. In some embodiments, $P^{DB}$ is —OP(O)(OH)—O-L-O—P(O)(XR)$_2$ or a salt form thereof, wherein each variable is independently as described in the present disclosure. In some embodiments, $P^{DB}$ is —OP(O)(OH)—O-L-O—P(O)(OR)(XR) or a salt form thereof, wherein each variable is independently as described in the present disclosure. In some embodiments, $P^{DB}$ is —OP(O)(OH)—O-L-O—P(O)(OH)(XR) or a salt form thereof, wherein each variable is independently as described in the present disclosure. In some embodiments, $P^{DB}$ is —OP(O)(OH)—O-L-O—P(O)(OH)(OR) or a salt form thereof, wherein each variable is independently as described in the present disclosure. In some embodiments, $P^{DB}$ is —OP(O)(OH)—O-L-O—P(O)(OH)(SR) or a salt form thereof, wherein each variable is independently as described in the present disclosure. In some embodiments, $P^{DB}$ is —OP(O)(OH)—O-L-O—P(O)(OH)(R) or a salt form thereof, wherein each variable is independently as described in the present disclosure. In some embodiments, $P^{DB}$ is —OP(O)(OH)—O-L-O—P(O)(OH)(H) or a salt form thereof, wherein each variable is independently as described in the present disclosure. In some embodiments, $P^{DB}$ is —OP(O)(SH)—O-L-O—P(O)

(XR)$_2$ or a salt form thereof, wherein each variable is independently as described in the present disclosure. In some embodiments, P$^{DB}$ is —OP(O)(SH)—O-L-O—P(O)(OR)(XR) or a salt form thereof, wherein each variable is independently as described in the present disclosure. In some embodiments, P$^{DB}$ is —OP(O)(SH)—O-L-O—P(O)(OH)(XR) or a salt form thereof, wherein each variable is independently as described in the present disclosure. In some embodiments, P$^{DB}$ is —OP(O)(SH)—O-L-O—P(O)(OH)(OR) or a salt form thereof, wherein each variable is independently as described in the present disclosure. In some embodiments, P$^{DB}$ is —OP(O)(SH)—O-L-O—P(O)(OH)(SR) or a salt form thereof, wherein each variable is independently as described in the present disclosure. In some embodiments, P$^{DB}$ is —OP(O)(SH)—O-L-O—P(O)(OH)(R) or a salt form thereof, wherein each variable is independently as described in the present disclosure. In some embodiments, P$^{DB}$ is —OP(O)(SH)—O-L-O—P(O)(OH)(H) or a salt form thereof, wherein each variable is independently as described in the present disclosure. In some embodiments, L is a bivalent optionally substituted C$_{1-10}$ aliphatic group. In some embodiments, L is bivalent optionally substituted C$_{1-10}$ alkylene. In some embodiments, L is bivalent C$_{1-10}$ alkylene. In some embodiments, L is —CH$_2$C(CH$_3$)$_2$CH$_2$—. In some embodiments, P$^{DB}$ is —OP(O)(SH)—O—CH$_2$C(CH$_3$)$_2$CH$_2$—O—P(O)(OH)$_2$ or a salt form thereof. In some embodiments, P$^{DB}$ is —OP(O)(SH)—O—CH$_2$C(CH$_3$)$_2$CH$_2$—O—P(O)(OH)(SH) or a salt form thereof. In some embodiments, P$^{DB}$ is —OP(O)(SH)—O—CH$_2$C(CH$_3$)$_2$CH$_2$—O—P(O)(OH)(SH) or a salt form thereof.

In some embodiments, a 5'-end group R$^E$ has the structure of —CH$_2$—OP(O)(OR)$_2$ or a salt form thereof, wherein each R is independently as described in the present disclosure. In some embodiments, a 5'-end group R$^E$ has the structure of —CH$_2$—OP(O)(SR)$_2$ or a salt form thereof, wherein each R is independently as described in the present disclosure. In some embodiments, a 5'-end group R$^E$ has the structure of —CH$_2$—OP(O)(OR)(SR) or a salt form thereof, wherein each R is independently as described in the present disclosure. In some embodiments, a 5'-end group R$^E$ has the structure of —CH$_2$—OP(O)(OR)(R) or a salt form thereof, wherein each R is independently as described in the present disclosure. In some embodiments, a 5'-end group R$^E$ has the structure of —CH$_2$—OP(O)(OH)$_2$ or a salt form thereof. In some embodiments, a 5'-end group R$^E$ has the structure of —CH$_2$—OP(O)(OH)(SH) or a salt form thereof. In some embodiments, a 5'-end group R$^E$ has the structure of —CH$_2$—OP(O)(OH)H or a salt form thereof.

In some embodiments, a 5'-OH is not phosphorylated. In some embodiments, a 5'-end group R$^E$ has the structure of —C(R$^{5s}$)$_2$OH or a salt form thereof, wherein each variable is independently as described in the present disclosure. In some embodiments, a provided 5'-nucleoside unit has the structure of

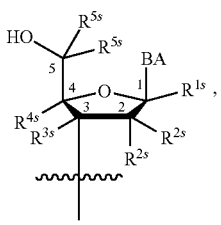

or a salt form thereof, wherein each variable is independently as described in the present disclosure. In some embodiments, a provided 5'-nucleoside unit has the structure of

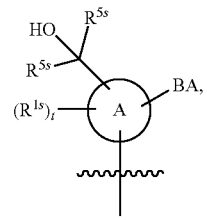

wherein each variable is independently as described in the present disclosure. In some embodiments, a 5'-end group R$^E$ has the structure of —C(R)$_2$OH, wherein each variable is independently as described in the present disclosure. In some embodiments, a provided 5'-nucleoside unit has the structure of

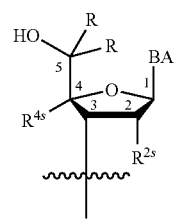

or a salt form thereof, wherein each variable is independently as described in the present disclosure. In some embodiments, a 5'-end group R$^E$ has the structure of —CH$_2$OH, wherein each variable is independently as described in the present disclosure. In some embodiments, a provided 5'-nucleoside unit has the structure of

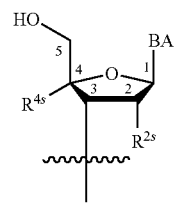

or a salt form thereof, wherein each variable is independently as described in the present disclosure. In some embodiments, each R is —H. In some embodiments, R$^{2s}$ and R$^{4s}$ are taken together with their intervening atoms to form a ring as described in the present disclosure. In some embodiments, R$^{2s}$ is —F or —OR, and R$^{4s}$ is —H. In some embodiments, R$^{2s}$ is —F, and R$^{4s}$ is —H. In some embodiments, R$^{2s}$ is —OR, and R$^{4s}$ is —H. In some embodiments, both R$^{2s}$ and R$^{2s}$ are H. In some embodiments, a provided 5'-nucleoside unit has the structure of

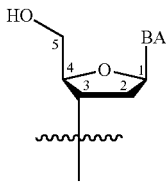

or a salt form thereof, wherein each variable is independently as described in the present disclosure. In some embodiments, BA is an optionally substituted pyrimidine nucleobase. In some embodiments, BA is optionally substituted cytosine. In some embodiments, BA is optionally substituted thymine. In some embodiments, BA is optionally substituted uracil. In some embodiments, BA is optionally substituted

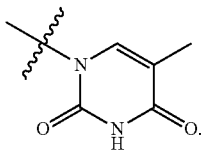 [SMILES: *n1cc(C)c(=O)[nH]c1=O]

In some embodiments, BA is

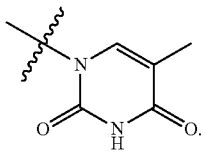 [SMILES: *n1cc(C)c(=O)[nH]c1=O]

In some embodiments, a 5'-end group $R^E$ has the structure of -L-$R^{5s}$ or a salt form thereof, wherein each variable is independently as described in the present disclosure. In some embodiments, $R^E$ is —CH$_2$OCH$_3$. In some embodiments, $R^E$ is —CH$_2$F. In some embodiments, $R^E$ is —CH$_2$OH. In some embodiments, $R^E$ is —CH$_3$. In some embodiments, a provided 5'-nucleoside unit has the structure of

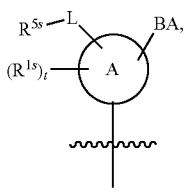

wherein each variable is independently as described in the present disclosure. In some embodiments, a provided 5'-nucleoside unit has the structure of formula 5-I-2:

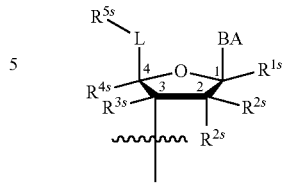

5-I-2 or a salt form thereof, wherein each variable is independently as described in the present disclosure. In some embodiments, a provided 5'-nucleoside unit has the structure of

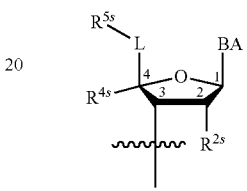

or a salt form thereof.

In some embodiments, a provided 5'-nucleoside unit has the structure of

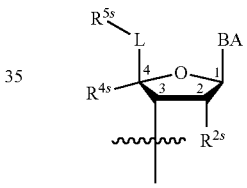

or a salt form thereof. In some embodiments, $R^{2s}$ and $R^{4s}$ are taken together with their intervening atoms to form a ring as described in the present disclosure. In some embodiments, $R^{2s}$ is —F or —OR, and $R^{4s}$ is —H. In some embodiments, $R^{2s}$ is —F, and $R^{4s}$ is —H. In some embodiments, $R^{2s}$ is —OR, and $R^{4s}$ is —H. In some embodiments, both $R^{2s}$ and $R^{2s}$ are H. In some embodiments, a provided 5'-nucleoside unit has the structure of

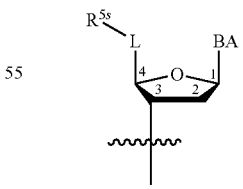

or a salt form thereof. In some embodiments, BA is an optionally substituted pyrimidine nucleobase. In some embodiments, BA is optionally substituted cytosine. In some embodiments, BA is optionally substituted thymine. In some embodiments, BA is optionally substituted uracil. In some embodiments, BA is optionally substituted In some embodiments, BA is

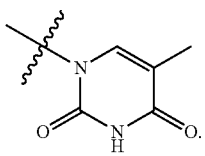 [SMILES: *n1cc(C)c(=O)[nH]c1=O]

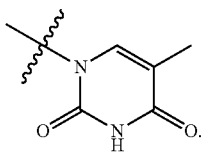 [SMILES: *n1cc(C)c(=O)[nH]c1=O]

In some embodiments, a 5'-end group $R^E$ has the structure of -L-$P^{5s}$-L-$R^{5s}$ or a salt form thereof, wherein $P^5$s is a group having the structure of formula I:

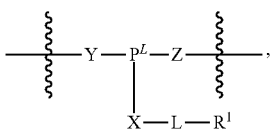

I or a salt form thereof, and each variable is independently as described in the present disclosure. In some embodiments, $R^E$ is -(E)-CH=CH—$P^{DB}$. In some embodiments, $R^E$ is -(E)-CH=CH—P(O)(XR)$_2$ or a salt form thereof. In some embodiments, $R^E$ is -(E)-CH=CH—P(O)(OH)$_2$ or a salt form thereof. In some embodiments, $R^E$ is -(E)-CH=CH—P(O)(OH)(SH) or a salt form thereof. In some embodiments, a provided 5'-nucleoside unit has the structure of

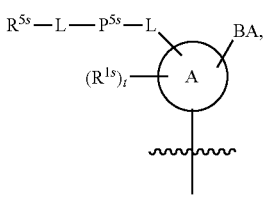

wherein each variable is independently as described in the present disclosure. In some embodiments, a provided 5'-nucleoside unit has the structure of formula 5-I:

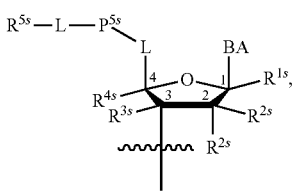

5-III or a salt form thereof, wherein each variable is independently as described in the present disclosure. In some embodiments, $R^E$ is —Z—P(O)(XR$^1$)—Y—$R^{5s}$ or a salt form thereof, wherein each variable is independently as described in the present disclosure. In some embodiments, $R^E$ is —Z—P(O)(OR$^1$)—Y—$R^{5s}$ or a salt form thereof, wherein each variable is independently as described in the present disclosure. In some embodiments, a provided 5'-nucleoside unit has the structure of

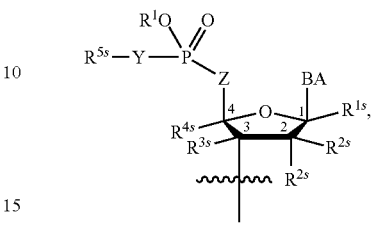

or a salt form thereof. In some embodiments, $R^E$ is —Z—P(O)(OR')—Y—H or a salt form thereof, wherein each variable is independently as described in the present disclosure. In some embodiments, a provided 5'-nucleoside unit has the structure of

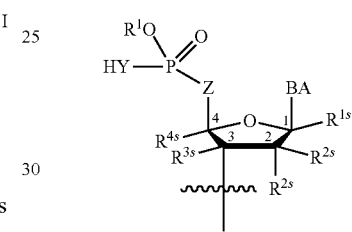

or a salt form thereof. In some embodiments, $R^E$ is —Z—P(O)(OH)—X—H or a salt form thereof, wherein each variable is independently as described in the present disclosure. In some embodiments, a provided 5'-nucleoside unit has the structure of

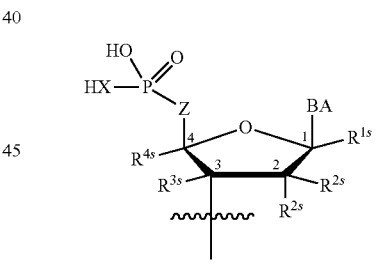

or a salt form thereof. In some embodiments, a provided 5'-nucleoside unit has the structure of

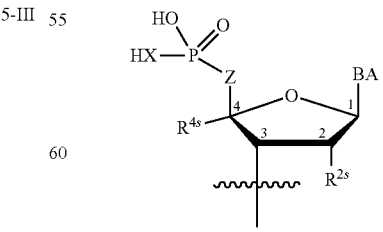

or a salt form thereof. In some embodiments, $R^E$ is —C(R)$_2$—O—P(O)(OH)—X—H or a salt form thereof, wherein each variable is independently as described in the present disclosure. In some embodiments, $R^E$ is —CHR—O—P(O)(OH)—X—H or a salt form thereof, wherein each variable is independently as described in the present disclosure. In some embodiments, R is optionally substituted $C_{1-6}$ aliphatic. In some embodiments, R is optionally substituted $C_{1-6}$ alkyl. In some embodiments, R is $C_{1-6}$ halo-alkyl. In some embodiments, R is $C_{1-6}$ alkyl. In some embodiments, R is methyl. In some embodiments, $R^E$ is —CH(CH$_3$)—O—P(O)(OH)—X—H or a salt form thereof, wherein each variable is independently as described in the present disclosure. In some embodiments, $R^E$ is —(R)—CH(CH$_3$)—O—P(O)(OH)—X—H or a salt form thereof, wherein each variable is independently as described in the present disclosure. In some embodiments, $R^E$ is —(S)—CH(CH$_3$)—O—P(O)(OH)—X—H or a salt form thereof, wherein each variable is independently as described in the present disclosure. In some embodiments, a provided 5'-nucleoside unit has the structure of

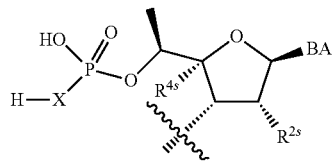

or a salt form thereof. In some embodiments, a provided 5'-nucleoside unit has the structure of

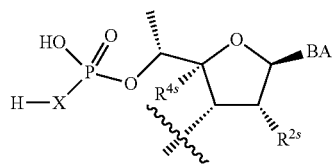

or a salt form thereof. In some embodiments, $R^{2s}$ and $R^{4s}$ are taken together with their intervening atoms to form a ring as described in the present disclosure. In some embodiments, $R^{2s}$ is —F or —OR, and $R^{4s}$ is —H. In some embodiments, $R^{2s}$ is —F, and $R^{4s}$ is —H. In some embodiments, $R^{2s}$ is —OR, and $R^{4s}$ is —H. In some embodiments, both $R^{2s}$ and $R^{2s}$ are H. In some embodiments, a provided 5'-nucleoside unit has the structure of

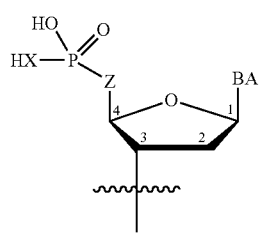

or a salt form thereof. In some embodiments, a provided 5'-nucleoside unit has the structure of

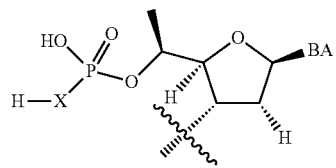

or a salt form thereof. In some embodiments, a provided 5'-nucleoside unit has the structure of

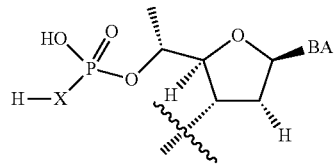

or a salt form thereof. In some embodiments, BA is an optionally substituted pyrimidine nucleobase. In some embodiments, BA is optionally substituted cytosine. In some embodiments, BA is optionally substituted thymine. In some embodiments, BA is optionally substituted uracil. In some embodiments, BA is optionally substituted

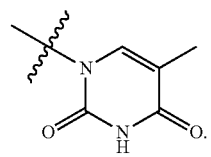 [SMILES: *n1cc(C)c(=O)[nH]c1=O]

In some embodiments, BA is

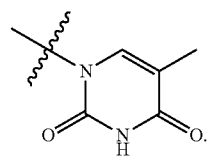 [SMILES: *n1cc(C)c(=O)[nH]c1=O]

In some embodiments, a provided 5'-nucleoside unit has the structure of

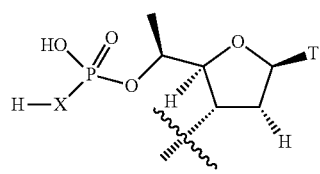

or a salt form thereof. In some embodiments, a provided 5'-nucleoside unit has the structure of

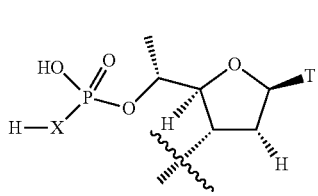

or a salt form thereof. In some embodiments, X is O. In some embodiments, X is S. In some embodiments, $R^E$ is —(R)—CH(CH$_3$)—O—P(O)(OH)—S—H or a salt form thereof. In some embodiments, $R^E$ is —(R)—CH(CH$_3$)—O—P(O)(OH)—O—H or a salt form thereof. In some embodiments, $R^E$ is —(S)—CH(CH$_3$)—O—P(O)(OH)—S—H or a salt form thereof. In some embodiments, $R^E$ is —(S)—CH(CH$_3$)—O—P(O)(OH)—O—H or a salt form thereof. In some embodiments, a provided 5'-nucleoside unit has the structure of

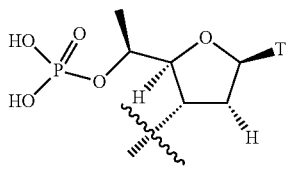

or a salt form thereof. In some embodiments, a provided 5'-nucleoside unit has the structure of

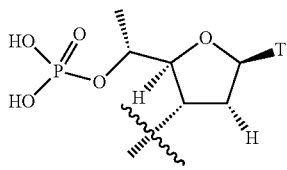

or a salt form thereof.

As readily appreciated by a person having ordinary skill in the art, provided compounds, e.g., oligonucleotides, or partial structures thereof, e.g., 5'-end structures, internucleotidic linkages, etc. of oligonucleotides, may partially, sometimes predominantly, exist as one or more salt forms thereof at certain pH, e.g., physiological pH, for example, due to one or more acidic and/or basic moieties therein. In some embodiments, a provided 5'-nucleoside unit may partially, sometimes predominately, exist as one or more its salt forms. For example, depending on pH,

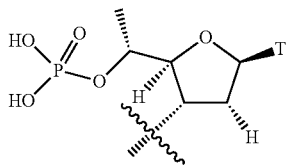

may exist as

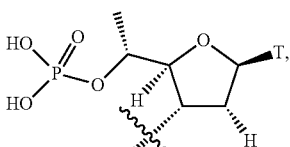

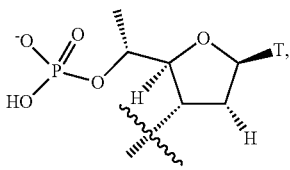

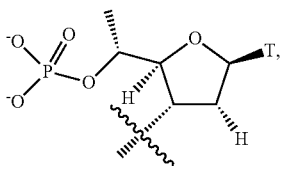

or any combinations thereof. Unless explicitly specified otherwise, all salt forms are included when provided compounds or structures are recited.

In some embodiments, $R^E$ is -L-P(O)(XR)$_2$ or a salt form thereof. In some embodiments, $R^E$ is -L-P(O)(XR)$_2$ or a salt form thereof, wherein each X is independently —O—, —S—, or a covalent bond. In some embodiments, $R^E$ is -L-P(O)(OR)$_2$ or a salt form thereof. In some embodiments, $R^E$ is -L-P(O)(OR)(SR) or a salt form thereof. In some embodiments, $R^E$ is -L-P(O)(OR)(R) or a salt form thereof. In some embodiments, L is a covalent bond, or a bivalent, optionally substituted, linear or branched C$_{1-6}$ aliphatic, wherein one or more methylene units are optionally and independently replaced with —O—, —S— or —N(R')—. In some embodiments, $R^E$ is -L-R$^{5s}$. In some embodiments, $R^E$ is —X-L-R. In some embodiments, $R^E$ is

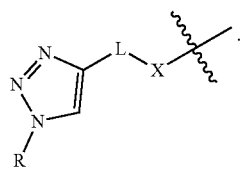

In some embodiments, X in $R^E$ is —C(R)$_2$—. In some embodiments, X is —O—. In some embodiments, X is —S—. In some embodiments, X is —N(R)—. In some embodiments, L comprises an optionally substituted, bivalent or multivalent

group. In some embodiments, L comprises an optionally substituted

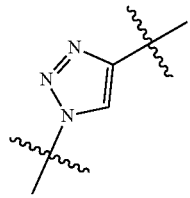 [SMILES: *c1cn(*)nn1]

group. In some embodiments, L comprises a

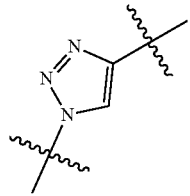 [SMILES: *c1cn(*)nn1]

group. In some embodiments, R is independently —H, or an optionally substituted group selected from $C_{1-10}$ alkyl, $C_{1-10}$ allyl, and $C_{6-14}$ aryl. In some embodiments, R is —H. In some embodiments, $R^E$ is optionally substituted

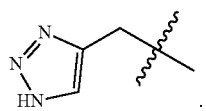 [SMILES: *Cc1c[nH]nn1 ; "."]

In some embodiments, $R^E$ is

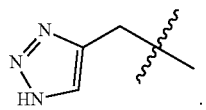 [SMILES: *Cc1c[nH]nn1 ; "."]

Many phosphate derivatives and/or bioisosteres, and 5'-nucleoside units are described in literature and can be utilized in accordance with the present disclosure, for example, some such structures are described in, e.g., US 2016-0194349; US 2016-0186175; US 20130323836, etc. In some embodiments, a provided 5'-nucleoside unit has the structure of

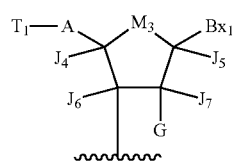

as part of formula Ic, or

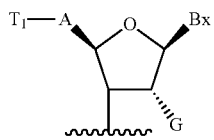

as part of formula IId, or

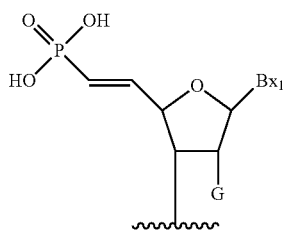

as part of formula IIe, or

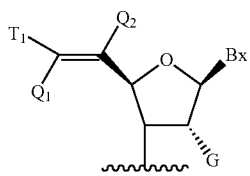

as part of formula Ib, in US 2016-0186185, which also describes other suitable structures and more specific examples. In some embodiments, a 5'-phosphate derivative has the structure of

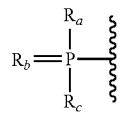

in US 2016-0186185, which also describes other suitable structures and more specific examples. In some embodiments, a provided 5'-nucleoside unit is the nucleoside as described in formula (1)

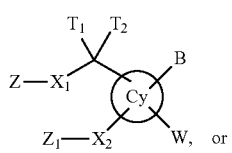

(1)

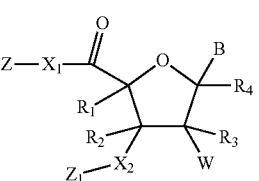

(2)

formula (2), or formula (3)

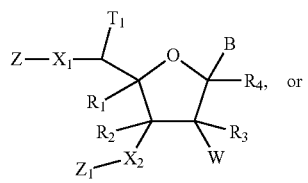
(3)

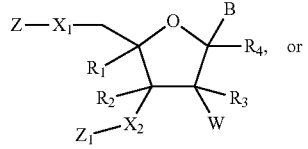
(4)

formula (4) in WO 2011/133871, which also describes other suitable structures and more specific examples. In some embodiments, a provided 5'-nucleoside unit is

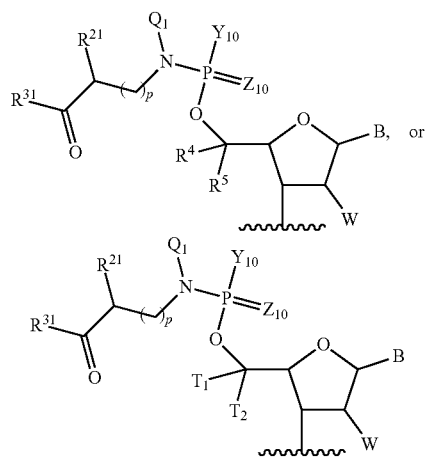

(as part of formula 1-a), or

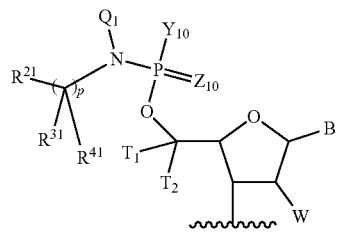

(as part of formula 1-b), or

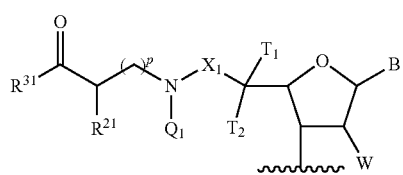

(as part of formula 1-c), or

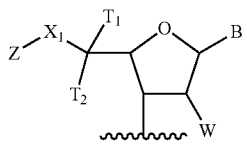

(as part of formula 1-d) in WO 2011/133871, which also describes other suitable structures and more specific examples. In some embodiments, a provided 5'-nucleoside unit is

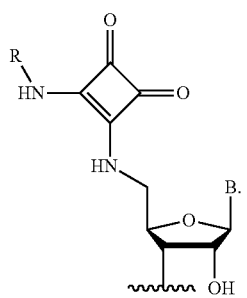

In some embodiments, a provided 5'-nucleoside unit is selected from:

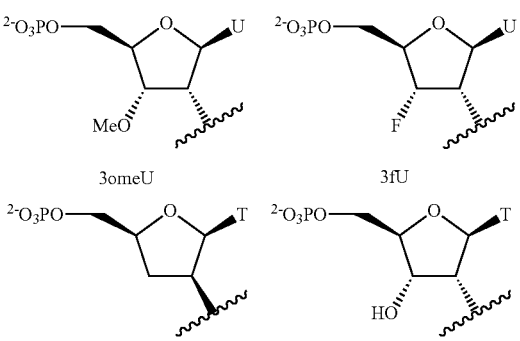

3omeU     3fU

3daraT     3rT

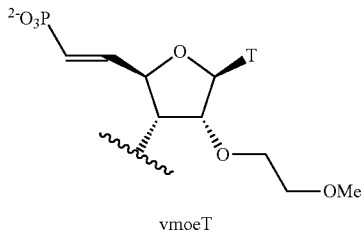

vmoeT

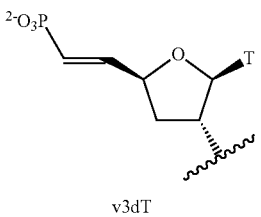

v3dT

In some embodiments, a provided 5'-nucleoside unit is selected from:
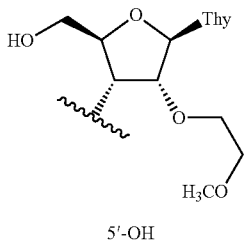
5'-OH
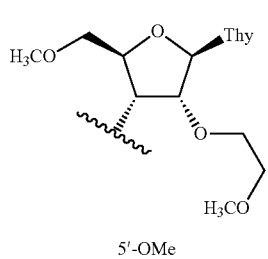
5'-OMe
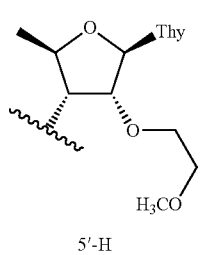  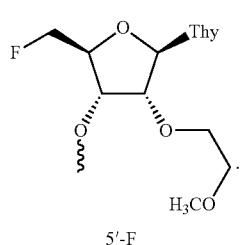
5'-H        5'-F
In some embodiments, a provided 5'-nucleoside unit is selected from:
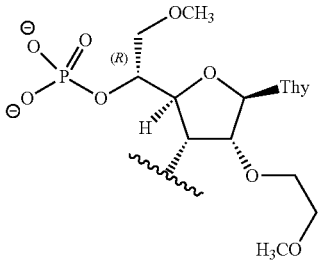
(R)-5'-MeOMe-P
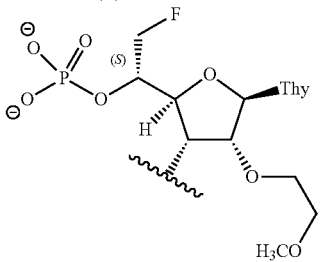
(S)-5'-F-Me-P
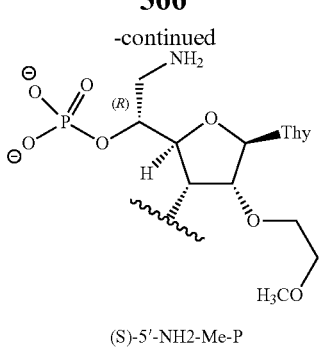
(S)-5'-NH2-Me-P
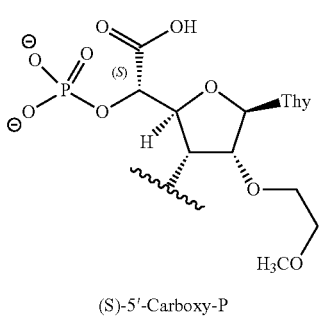
(S)-5'-Carboxy-P
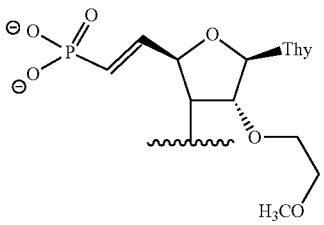
(E)-5'-VP
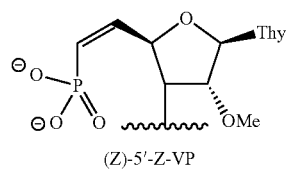
(Z)-5'-Z-VP
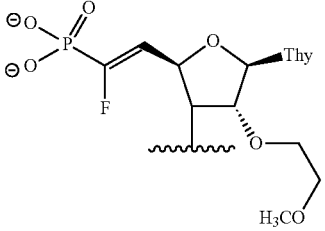
(E)-5'-F-VP
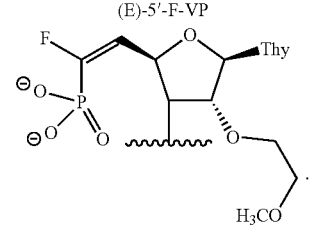
(Z)-5'-F-VP 367
-continued
368
-continued
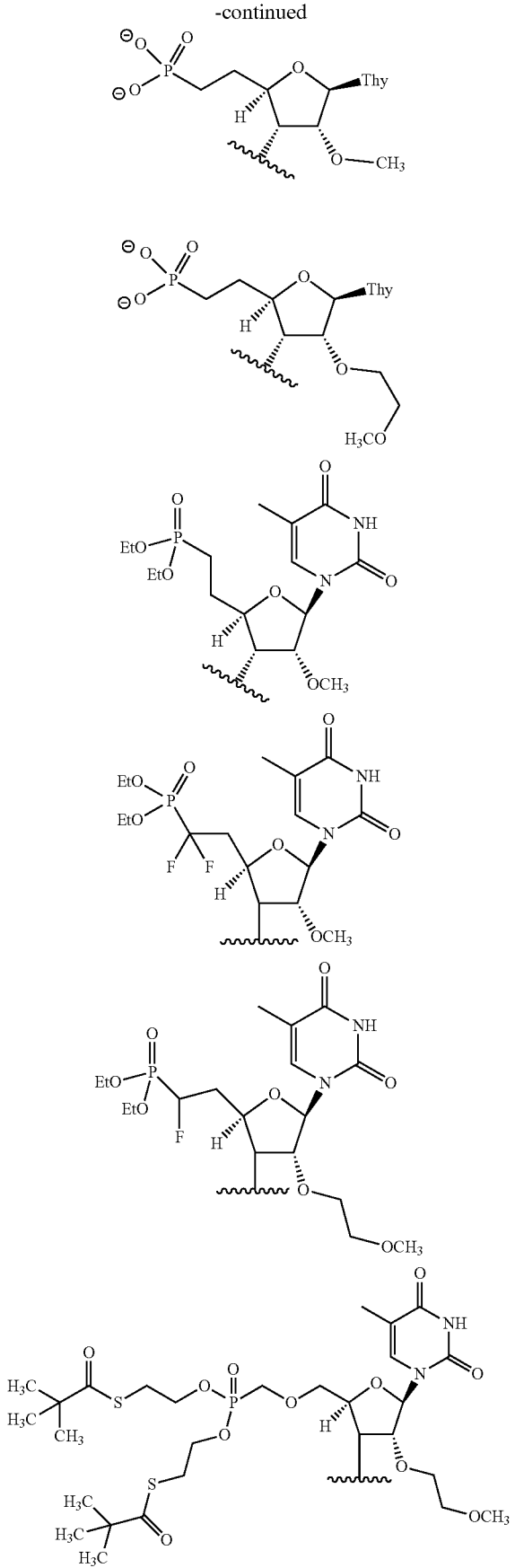
In some embodiments, a provided 5'-nucleoside unit is selected from:

-continued

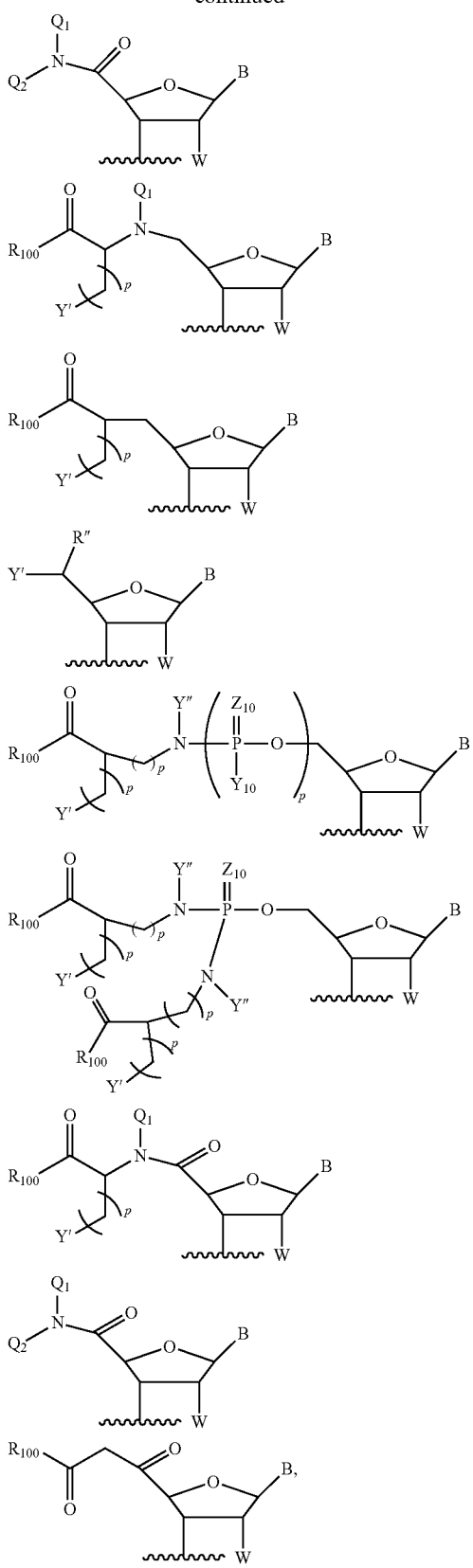

as described in US 20130323836, which also describes other suitable structures and more specific examples.

In some embodiments, a provided 5'-nucleoside unit is selected from:

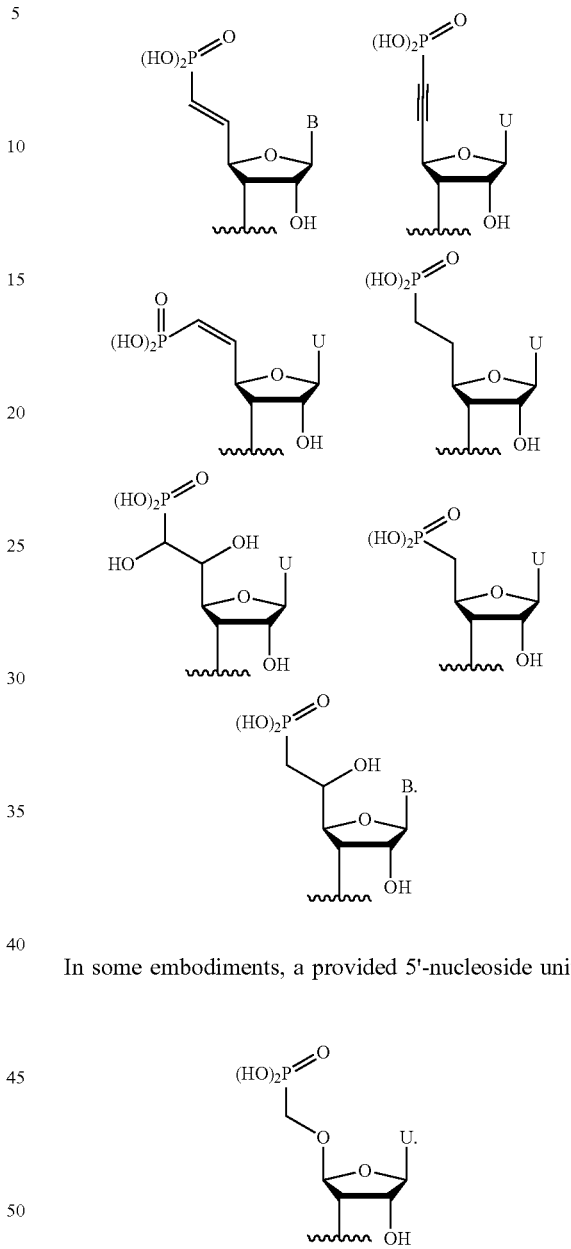

In some embodiments, a provided 5'-nucleoside unit is (structure shown)

In some embodiments, a 5' end group $R^E$, or a 5'-nucleoside unit, is described in, for example, Allerson et al. 2005 J. Med. Chem. 48: 901-04; Lima et al. 2012 Cell 150: 883-894; Prakash et al. 2015 Nucl. Acids Res. 43: 2993-3011; and/or Prakash et al. 2016 Bioorg. Med. Chem. Lett. 26: 26: 2817-2820, for example, T-VP, T-PO, etc.

Bridged Morpholinos and cyclohexenyl nucleotides and nucleosides are described in, for example, US patent application publication 2016-0186175, which can be utilized in accordance with the present disclosure.

In some embodiments, PX0- has the structure of A-B—, wherein -B- is an internucleotidic linker and A is a 5'-nucleoside unit described in the present disclosure.

In some embodiments, a 5' end structure, e.g., PX0, or PX0-N1-PX1, has a structure selected from:

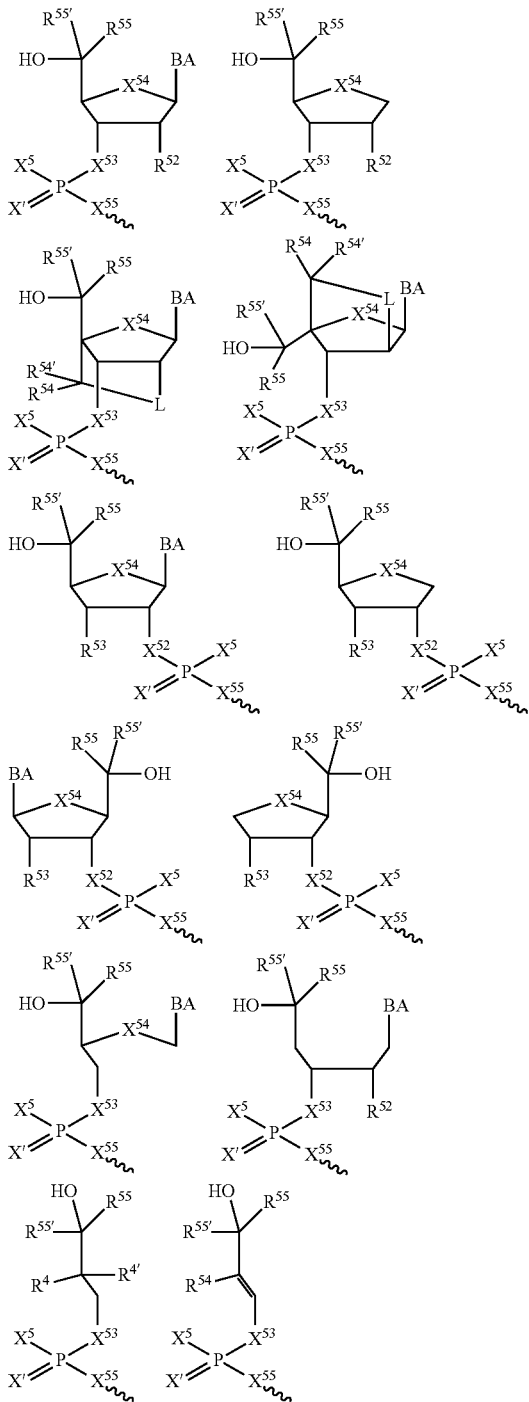

wherein:
X' is O or Se;
X⁵ is -L-R¹;
R¹ is R, halogen, —CN, —NO₂, —Si(R)₃, —OR, —SR, or —N(R)₂;
each of $X^{52}$, $X^{53}$, $X^{54}$ and $X^{55}$ is independently —O—, —S—, —N(-L-R¹)—, —N(R$^{TD}$), or L;
each of $R^{52}$, $R^{53}$, $R^{54}$, $R^{54'}$, $R^{55}$, and $R^{55'}$ is independently R¹, —OR¹, —SR¹, or —N(R¹)₂;

BA is an optionally substituted group selected from $C_{1-30}$ cycloaliphatic, $C_{6-30}$ aryl, $C_{5-30}$ heteroaryl having 1-10 heteroatoms independently selected from oxygen, nitrogen, sulfur, phosphorus and silicon, $C_{3-30}$ heterocyclyl having 1-10 heteroatoms independently selected from oxygen, nitrogen, sulfur, phosphorus, boron and silicon, a natural nucleobase moiety, and a modified nucleobase moiety;

L is a covalent bond, or a bivalent, optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡—, —C(R')₂—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)₂—, —S(O)₂N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')₃]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')₃]O—; and one or more carbon atoms are optionally and independently replaced with Cy$^L$;

each Cy$^L$ is independently an optionally substituted tetravalent group selected from a $C_{3-20}$ cycloaliphatic ring, a $C_{6-20}$ aryl ring, a 5-20 membered heteroaryl ring having 1-10 heteroatoms independently selected from oxygen, nitrogen, sulfur, phosphorus and silicon, and a 3-20 membered heterocyclyl ring having 1-10 heteroatoms independently selected from oxygen, nitrogen, sulfur, phosphorus, boron and silicon;

R$^{TD}$ is a targeting moiety, R$^{CD}$, or R$^{LD}$;
R$^{CD}$ is a moiety comprises one or more carbohydrate or bicyclic ketal moiety;
each R' is independently —R, —C(O)R, —C(O)OR, or —S(O)₂R; and
each R is independently —H, or an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon, or two R groups are optionally and independently taken together to form a covalent bond, or:

two or more R groups on the same atom are optionally and independently taken together with the atom to form an optionally substituted, 3-30 membered monocyclic, bicyclic or polycyclic ring having, in addition to the atom, 0-10 heteroatoms independently selected from oxygen, nitrogen, sulfur, phosphorus and silicon; or two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms independently selected from oxygen, nitrogen, sulfur, phosphorus and silicon.

In some embodiments, R$^{TD}$ is R$^{LD}$, wherein R$^{LD}$ is independently as described in the present disclosure. In some embodiments, R$^{TD}$ is R$^{CD}$, wherein R$^{CD}$ is independently as described in the present disclosure.

In some embodiments, $R^{CD}$ is an optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with $Cy^L$. In some embodiments, $R^{CD}$ is an optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are independently replaced with a monosaccharide, disaccharide or polysaccharide moiety. In some embodiments, $R^{CD}$ is an optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are independently replaced with a GalNac moiety.

In some embodiments, a 5'-nucleotidic unit is selected from:

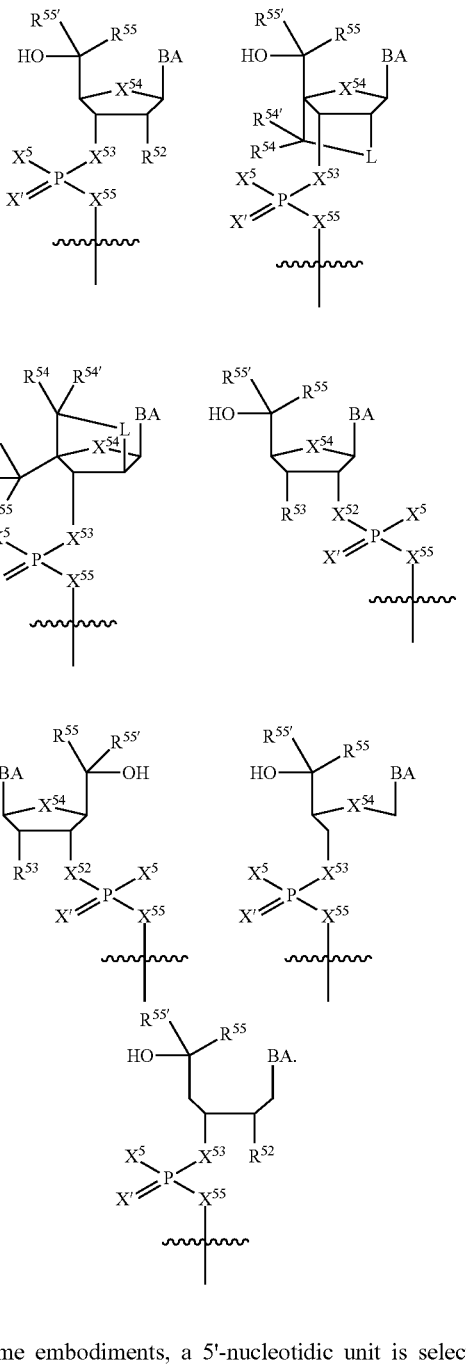

In some embodiments, a 5'-nucleotidic unit is selected from:

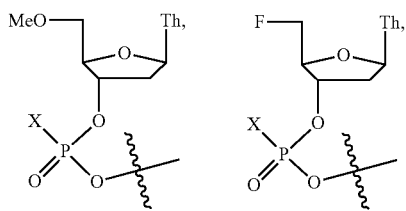

-continued

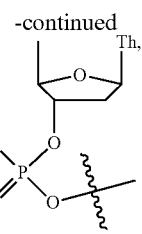

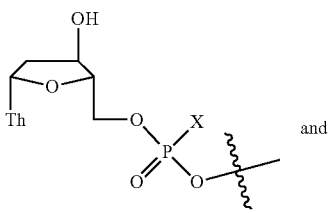
and

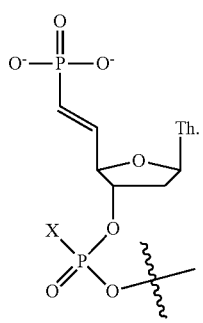

Example embodiments of variables are extensively described in the present disclosure. For structures with two or more variables, unless otherwise specified, each variable can independently be any embodiment described herein.

In some embodiments, BA is optionally substituted $C_{1-30}$ cycloaliphatic. In some embodiments, BA is optionally substituted $C_{6-30}$ aryl. In some embodiments, BA is optionally substituted $C_{3-30}$ heterocyclyl. In some embodiments, BA is optionally substituted $C_{5-30}$ heteroaryl. In some embodiments, BA is an optionally substituted natural base moiety. In some embodiments, BA is an optionally substituted modified base moiety. BA is an optionally substituted group selected from $C_{1-30}$ cycloaliphatic, $C_{6-30}$ aryl, $C_{3-30}$ heterocyclyl, and $C_{5-30}$ heteroaryl. In some embodiments, BA is an optionally substituted group selected from $C_{1-30}$ cycloaliphatic, $C_{6-30}$ aryl, $C_{3-30}$ heterocyclyl, $C_{5-30}$ heteroaryl, and a natural nucleobase moiety.

In some embodiments, BA is connected to a sugar ring, e.g., Ring A, through an aromatic ring. In some embodiments, BA is connected to a sugar ring through a heteroatom. In some embodiments, BA is connected to a sugar ring through a ring heteroatom of an aromatic ring. In some embodiments, BA is connected to a sugar ring through a ring nitrogen atom of an aromatic ring.

In some embodiments, BA is a natural nucleobase moiety. In some embodiments, BA is an optionally substituted natural nucleobase moiety. In some embodiments, BA is a substituted natural nucleobase moiety. In some embodiments, BA is natural nucleobase A, T, C, or G. In some embodiments, BA is an optionally substituted group selected from natural nucleobases A, T, C, and G.

In some embodiments, BA is an optionally substituted group, which group is formed by removing a —H from

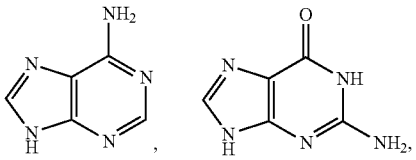

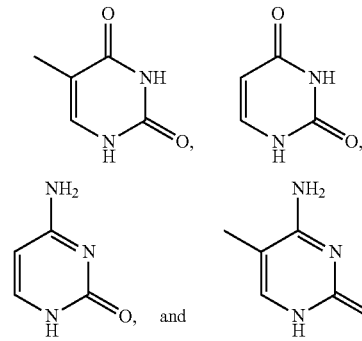

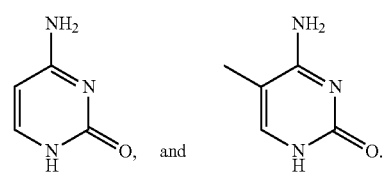

In some embodiments, BA is an optionally substituted group which group is selected from

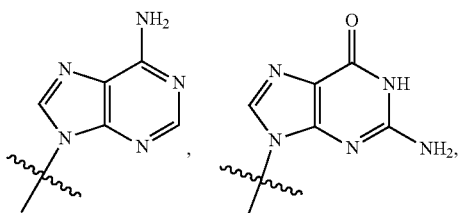

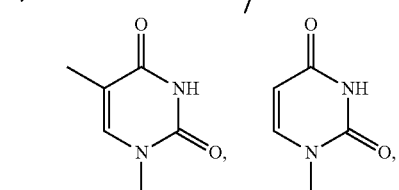

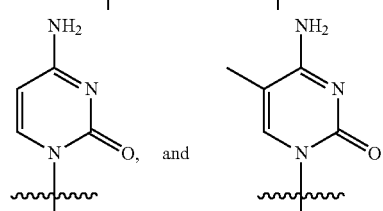

In some embodiments, BA is an optionally substituted group, which group is formed by removing a —H from

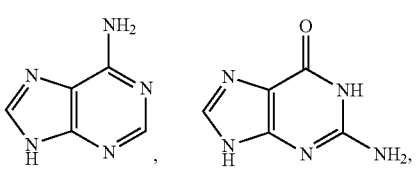

-continued

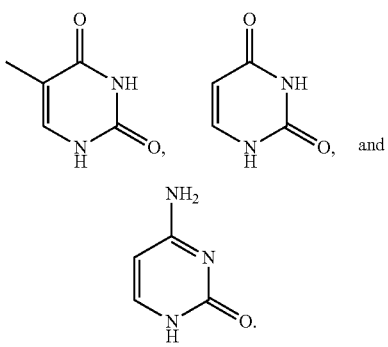

In some embodiments, BA is an optionally substituted group which group is selected from

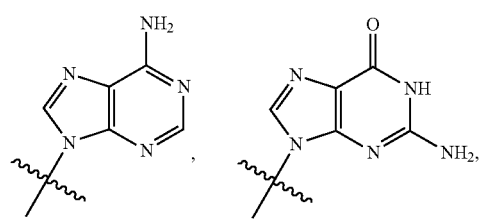

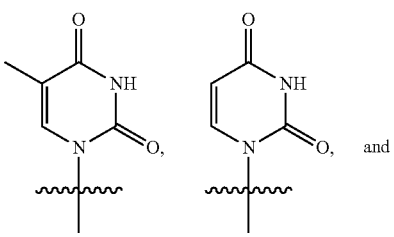

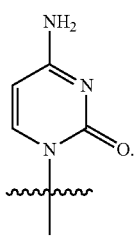

In some embodiments, BA of the 5'-end nucleoside unit is an optionally substituted group, which group is formed by removing a —H from

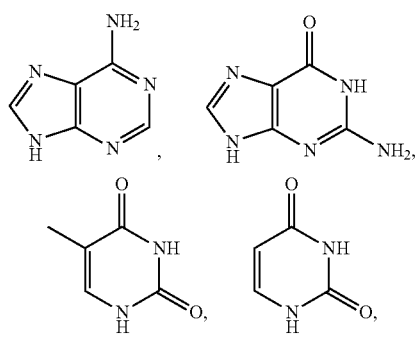

-continued

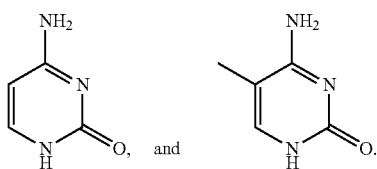

In some embodiments, BA of the 5'-end nucleoside unit is an optionally substituted group which group is selected from

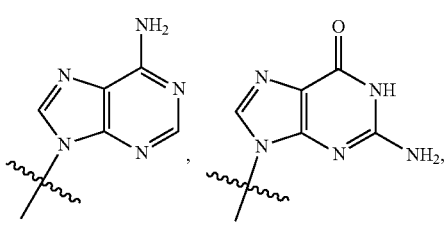

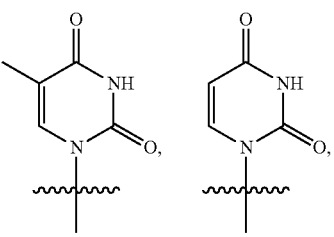

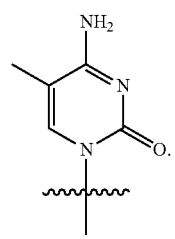

In some embodiments, BA of the 5'-end nucleoside unit is an optionally substituted group, which group is formed by removing a —H from

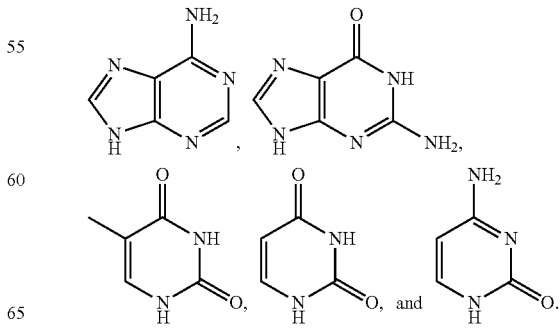

In some embodiments, BA of the 5'-end nucleoside unit is an optionally substituted group which group is selected from

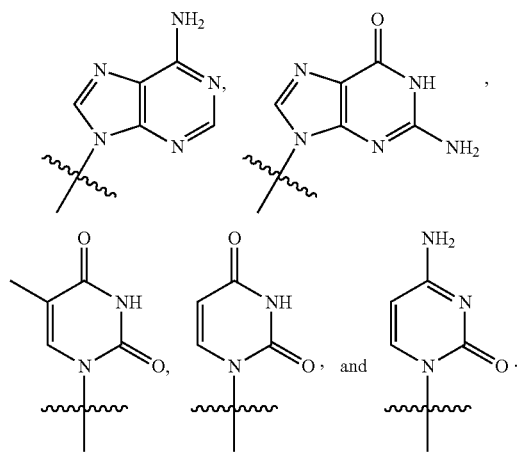

In some embodiments, BA of the 5'-end nucleoside unit is optionally substituted

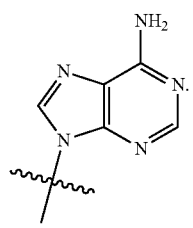 [SMILES: *n1cnc2c(N)ncnc21]

In some embodiments, BA of the 5'-end nucleoside unit is optionally substituted

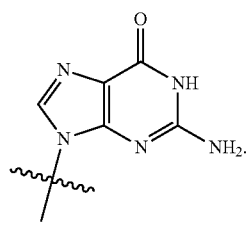 [SMILES: *n1cnc2c(=O)[nH]c(N)nc21]

In some embodiments, BA of the 5'-end nucleoside unit is optionally substituted

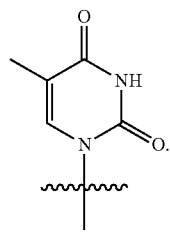 [SMILES: *n1cc(C)c(=O)[nH]c1=O]

In some embodiments, BA of the 5'-end nucleoside unit is optionally substituted

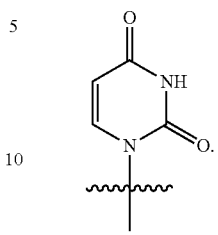

In some embodiments, BA of the 5'-end nucleoside unit is optionally substituted

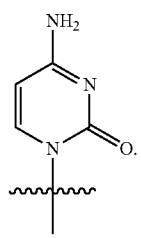

In some embodiments, BA of the 5'-end nucleoside unit is

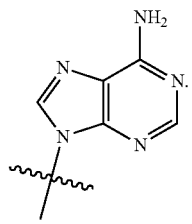 [SMILES: *n1cnc2c(N)ncnc21]

In some embodiments, BA of the 5'-end nucleoside unit is

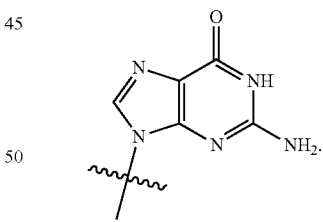

In some embodiments, BA of the 5'-end nucleoside unit is

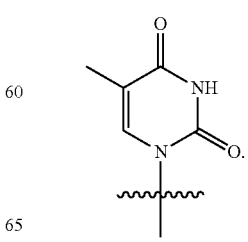

In some embodiments, BA of the 5'-end nucleoside unit is

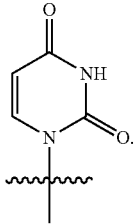

In some embodiments, BA of the 5'-end nucleoside unit is

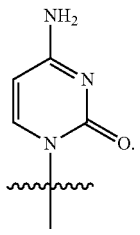 [SMILES: *n1ccc(N)nc1=O]

In some embodiments, BA is

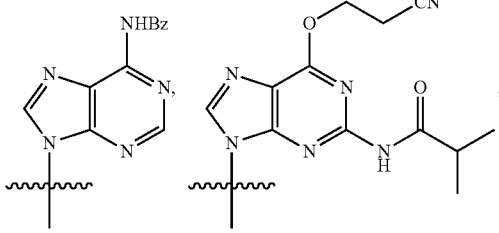

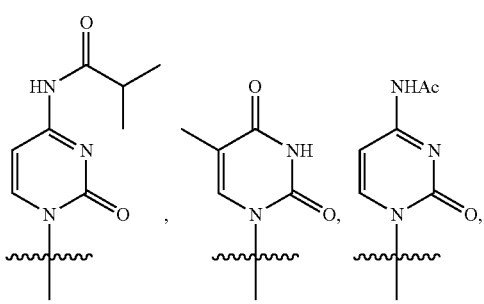

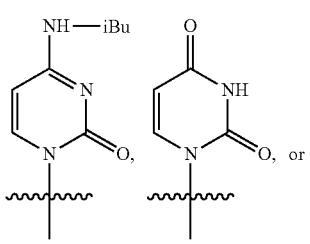

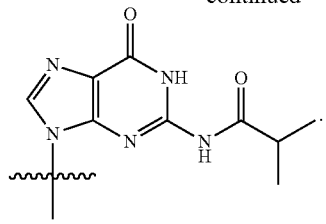

In some embodiments, BA is

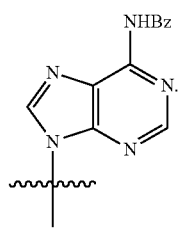

In some embodiments, BA is

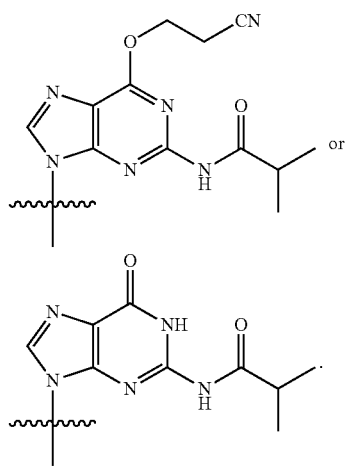

In some embodiments, BA is an optionally substituted purine base residue. In some embodiments, BA is a protected purine base residue. In some embodiments, BA is an optionally substituted adenine residue. In some embodiments, BA is a protected adenine residue. In some embodiments, BA is an optionally substituted guanine residue. In some embodiments, BA is a protected guanine residue. In some embodiments, provided technologies provide surprisingly improved yields and/or purity for preparation of purine phosphoramidites, which can be particularly challenging to prepare and often suffer from low yields and/or purity.

In some embodiments, BA is a protected base residue as used in oligonucleotide preparation. In some embodiments, BA is a base residue illustrated in US 2011/0294124, US 2015/0211006, US 2015/0197540, and WO 2015/107425, each of which is incorporated herein by reference.

Those skilled in the art appreciate that a variety of modified nucleobases are suitable for use in accordance with the present disclosure. Example modified bases include but are not limited to those limited in WO/2011/005761, WO/2013/012758, WO/2014/012081, WO/2015/107425, WO/2010/064146, WO/2014/010250, WO/2011/108682, WO/2012/039448, and WO/2012/073857, the modified nucleobases of each of which are hereby incorporated by reference.

In some embodiments, BA is a substituted nucleobase so that the phosphoramidite is properly protected with one or more protecting groups and can be used for oligonucleotide synthesis. Suitable protecting groups for nucleobases are widely known in the art, including those useful for oligonucleotide synthesis, and can be used in accordance with the present disclosure. In some embodiments, a protecting group is acetyl ($A^c$), phenylacetyl, benzoyl (Bz), isobutyryl (iBu), phenoxyacetyl (Pac), isopropyl-Pac, tertbutyl-Pac, alkyl-Pac, dimethylformamidine (DMF), or dialkylformamidine. In some embodiments, a protecting group is phthalimido, 9-fluorenylmethoxycarbonyl (FMOC), triphenylmethylsulfenyl, t-BOC, 4,4'-dimethoxytrityl (DMTr), 4-methoxytrityl (MMTr), 9-phenylxanthin-9-yl (Pixyl), trityl (Tr), or 9-(p-methoxyphenyl)xanthin-9-yl (MOX). For additional suitable protecting groups, see Green and Wuts, Protective Groups in Organic Synthesis, 2nd Ed., John Wiley & Sons, New York, 1991, and WO/2011/005761, WO/2013/012758, WO/2014/012081, WO/2015/107425, WO/2010/064146, WO/2014/010250, WO/2011/108682, WO/2012/039448, and WO/2012/073857.

In some embodiments, $R^E$ is a 5'-end group as described in the present disclosure. In some embodiments, $R^E$ contains no more than 5, 6, 7, 8, 9, 10, 11, 12, 13, 14, 15, 16, 17, 18, 19, 20, 21, 22, 23, 24, 25, 30, 40, 50, 60, 70, 80, 90, or 100 carbon atoms and heteroatoms. In some embodiments, when counting the number of carbon atoms and heteroatoms, an all-acid form of $R^E$ is used, for example, a mono- or di-salt of —$CH_2OP(O)(OH)_2$ is considered to have 6 carbon atoms and heteroatoms as the all acid form —$CH_2OP(O)(OH)_2$ contains 6 carbon atoms and heteroatoms (1 carbon atom, 4 oxygen atoms and 1 phosphorus atom).

In some embodiments, each $R^s$ is independently —F, —Cl, —Br, —I, —CN, —$N_3$, —NO, —$NO_2$, -L-R', -L-OR', -L-SR', -L-N(R')$_2$, —O-L-OR', —O-L-SR', or —O-L-N(R')$_2$. In some embodiments, 12" is —F. In some embodiments, $R^s$ is —Cl. In some embodiments, $R^s$ is —Br. In some embodiments, $R^s$ is —I. In some embodiments, $R^s$ is —CN. In some embodiments, $R^s$ is -N3. In some embodiments, $R^s$ is —NO. In some embodiments, $R^s$ is —$NO_2$. In some embodiments, $R^s$ is -L-R'. In some embodiments, $R^s$ is -R'. In some embodiments, $R^s$ is -L-OR'. In some embodiments, $R^s$ is —OR'. In some embodiments, $R^s$ is -L-SR'. In some embodiments, $R^s$ is -SR'. In some embodiments, $R^s$ is L-L-N(R')$_2$. In some embodiments, $R^s$ —N(R')$_2$. In some embodiments, $R^s$ is hydrogen.

In some embodiments, $R^s$ at a 2'-position (BA is at 1'-position) is —F. In some embodiments, $R^s$ at a 2'-position is —Cl. In some embodiments, $R^s$ at a 2'-position is —Br. In some embodiments, $R^s$ at a 2'-position is —I. In some embodiments, $R^s$ at a 2'-position is —CN. In some embodiments, $R^s$ at a 2'-position is -$N_3$. In some embodiments, $R^s$ at a 2'-position is -NO. In some embodiments, $R^s$ at a 2'-position is —$NO_2$. In some embodiments, $R^s$ at a 2'-position is -L-R'. In some embodiments, $R^s$ at a 2'-position is -R'. In some embodiments, $R^s$ at a 2'-position is -L-OR'. In some embodiments, $R^s$ at a 2'-position is —OR'. In some embodiments, $R^s$ at a 2'-position is -L-SR'. In some embodiments, $R^s$ at a 2'-position is —SR'. In some embodiments, $R^s$ at a 2'-position is L-L-N(R')$_2$. In some embodiments, $R^s$ at a 2'-position is —N(R')$_2$. In some embodiments, $R^s$ at a 2'-position is —OR', wherein $R^{LD}$ is optionally substituted $C_{1-6}$ aliphatic. In some embodiments, $R^s$ at a 2'-position is —OR', wherein $R^{LD}$ is optionally substituted $C_{1-6}$ alkyl. In some embodiments, $R^s$ at a 2'-position is —OMe. In some embodiments, $R^s$ at a 2'-position is -MOE. In some embodiments, $R^s$ at a 2'-position is hydrogen. In some embodiments, $R^s$ at one 2'-position is hydrogen, and $R^s$ at the other 2'-position is not hydrogen as described herein. In some embodiments, $R^s$ at both 2'-positions are hydrogen. In some embodiments, $R^s$ at one 2'-position is hydrogen, and the other 2'-position is connected to an internucleotidic linkage.

In some embodiments, $R^s$ at a 3'-position (BA is at 1'-position) is —F. In some embodiments, $R^s$ at a 3'-position is —Cl. In some embodiments, $R^s$ at a 3'-position is —Br. In some embodiments, $R^s$ at a 3'-position is —I. In some embodiments, $R^s$ at a 3'-position is —CN. In some embodiments, $R^s$ at a 3'-position is -$N_3$. In some embodiments, $R^s$ at a 3'-position is —NO. In some embodiments, $R^s$ at a 3'-position is —$NO_2$. In some embodiments, $R^s$ at a 3'-position is -L-R'. In some embodiments, $R^s$ at a 3'-position is —R'. In some embodiments, $R^s$ at a 3'-position is -L-OR'. In some embodiments, $R^s$ at a 3'-position is —OR'. In some embodiments, $R^s$ at a 3'-position is -L-SR'. In some embodiments, $R^s$ at a 3'-position is —SR'. In some embodiments, $R^s$ at a 3'-position is L-L-N(R')$_2$. In some embodiments, $R^s$ at a 3'-position is —N(R')$_2$. In some embodiments, $R^s$ at a 3'-position is —OR', wherein $R^{LD}$ is optionally substituted $C_{1-6}$ aliphatic. In some embodiments, $R^s$ at a 3'-position is —OR', wherein $R^{LD}$ is optionally substituted $C_{1-6}$ alkyl. In some embodiments, $R^s$ at a 3'-position is —OMe. In some embodiments, $R^s$ at a 3'-position is -MOE. In some embodiments, $R^s$ at a 3'-position is hydrogen. In some embodiments, $R^s$ at one 3'-position is hydrogen, and $R^s$ at the other 3'-position is not hydrogen as described herein. In some embodiments, $R^s$ at both 3'-positions are hydrogen. In some embodiments, $R^s$ at one 3'-position is hydrogen, and the other 3'-position is connected to an internucleotidic linkage.

In some embodiments, $R^s$ at a 4'-position (BA is at 1'-position) is —F. In some embodiments, $R^s$ at a 4'-position is —Cl. In some embodiments, $R^s$ at a 4'-position is —Br. In some embodiments, $R^s$ at a 4'-position is —I. In some embodiments, $R^s$ at a 4'-position is —CN. In some embodiments, $R^s$ at a 4'-position is —$N_3$. In some embodiments, $R^s$ at a 4'-position is —NO. In some embodiments, $R^s$ at a 4'-position is —$NO_2$. In some embodiments, $R^s$ at a 4'-position is -L-R'. In some embodiments, $R^s$ at a 4'-position is —R'. In some embodiments, $R^s$ at a 4'-position is -L-OR'. In some embodiments, $R^s$ at a 4'-position is —OR'. In some embodiments, $R^s$ at a 4'-position is -L-SR'. In some embodiments, $R^s$ at a 4'-position is —SR'. In some embodiments, $R^s$ at a 4'-position is L-L-N(R')$_2$. In some embodiments, $R^s$ at a 4'-position is —N(R')$_2$. In some embodiments, $R^s$ at a 4'-position is —OR', wherein $R^{LD}$ is optionally substituted $C_{1-6}$ aliphatic. In some embodiments, $R^s$ at a 4'-position is —OR', wherein $R^{LD}$ is optionally substituted $C_{1-6}$ alkyl. In some embodiments, $R^s$ at a 4'-position is —OMe. In some embodiments, $R^s$ at a 4'-position is -MOE. In some embodiments, $R^s$ at a 4'-position is hydrogen. In some embodiments, $R^s$ at one 4'-position is hydrogen, and $R^s$ at the other 4'-position is not hydrogen as described herein. In some embodiments, $R^s$ at both 4'-positions are hydrogen. In some embodiments, $R^s$ at one 4'-position is hydrogen, and the other 4'-position is connected to an internucleotidic linkage. In some embodiments, $R^s$ is $R^{1s}$, $R^{2s}$, $R^{3s}$, $R^{4s}$, or $R^{5s}$ as described in the present disclosure.

In some embodiments, g is O-20. In some embodiments, g is 1-20. In some embodiments, g is 1-5. In some embodiments, g is 1. In some embodiments, g is 2. In some embodiments, g is 3. In some embodiments, g is 4. In some embodiments, g is 5. In some embodiments, g is 6. In some embodiments, g is 7. In some embodiments, g is 8. In some embodiments, g is 9. In some embodiments, g is 10. In some embodiments, g is 11. In some embodiments, g is 12. In some embodiments, g is 13. In some embodiments, g is 14. In some embodiments, g is 15. In some embodiments, g is 16. In some embodiments, g is 17. In some embodiments, g is 18. In some embodiments, g is 19. In some embodiments, g is 20.

In some embodiments,

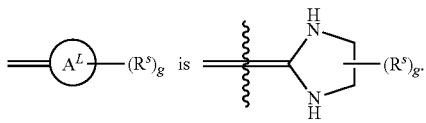

In some embodiments,

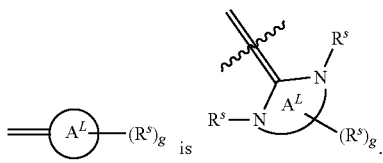

In some embodiments,

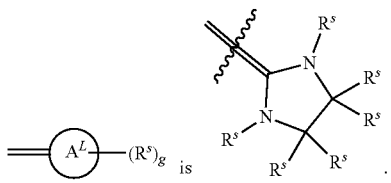

In some embodiments, s is 0-20. In some embodiments, s is 1-20. In some embodiments, s is 1. In some embodiments, s is 2. In some embodiments, s is 3. In some embodiments, s is 4. In some embodiments, s is 5. In some embodiments, s is 6. In some embodiments, s is 7. In some embodiments, s is 8. In some embodiments, s is 9. In some embodiments, s is 10. In some embodiments, s is 11. In some embodiments, s is 12. In some embodiments, s is 13. In some embodiments, s is 14. In some embodiments, s is 15. In some embodiments, s is 16. In some embodiments, s is 17. In some embodiments, s is 18. In some embodiments, s is 19. In some embodiments, s is 20.

In some embodiments, L is a covalent bond, or a bivalent, optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR') O—, —OP(O)(R')O—, —OP(O)(NR')O—, —OP(OR') O—, —OP(SR')O—, —OP(NR')O—, —OP(R')O—, or —OP(OR')[B(R')$_3$]O—; and one or more carbon atoms are optionally and independently replaced with $Cy^L$. In some embodiments, L is a covalent bond, or a bivalent, optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, -Cy-, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S (O)$_2$—, —S(O)$_2$N(R')—, —C(O)S—, —C(O)O—, —P(O) (OR')—, —P(O)(SR')—, —P(O)(R')—, —P(O)(NR')—, —P(S)(OR')—, —P(S)(SR')—, —P(S)(R')—, —P(S) (NR')—, —P(R')—, —P(OR')—, —P(SR')—, —P(NR')—, —P(OR')[B(R')$_3$]—, —OP(O)(OR')O—, —OP(O)(SR') O—, —OP(O)(R')O—, —OP(O)(NR')O—, —OP(OR') O—, —OP(SR')O—, —OP(NR')O—, —OP(R')O—, or —OP(OR')[B(R')$_3$]O—. In some embodiments, L is a covalent bond, or a bivalent, optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—; and one or more carbon atoms are optionally and independently replaced with $Cy^L$. In some embodiments, L is a covalent bond, or a bivalent, optionally substituted, linear or branched group selected from a $C_{1-30}$ aliphatic group and a $C_{1-30}$ heteroaliphatic group having 1-10 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, -Cy-, —C(R')$_2$—, —O—, —S—, —S—S—, —C(O)—, —C(S)—, —C(NR')—, —C(O)N(R')—, —N(R')C(O)N (R')—, —N(R')C(O)O—, —S(O)—, —S(O)$_2$—, —S(O)$_2$N (R')—, —C(O)S—, —C(O)O—. In some embodiments, the aliphatic and/or the heteroaliphatic group is $C_{1-30}$. In some embodiments, L is a covalent bond or an optionally substituted, linear or branched $C_1$-$C_{10}$ aliphatic, wherein one or more methylene units of L are optionally and independently replaced by an optionally substituted group selected from $C_1$-$C_6$ aliphatic moiety, $C_1$-$C_6$ alkenylene, —C≡C—, a $C_1$-$C_6$ heteroaliphatic moiety, —C(R')$_2$—, -Cy-, —B(R')—, —O—, —S—, —S—S—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$— —SC(O)—, —C(O)S—, —OC(O)—, and —C(O)O—. In some embodiments, the aliphatic and the heteroaliphatic group are independently $C_{1-30}$, $C_{1-25}$, $C_{1-20}$, $C_{1-15}$, $C_{1-10}$, $C_{1-9}$, $C_{1-8}$, $C_{1-7}$, $C_{1-6}$, $C_{1-5}$, $C_{1-4}$, $C_{1-3}$, $C_{1-2}$, or $C_1$. In some embodiments, the aliphatic group or the heteroaliphatic group is independently $C_{1-30}$, $C_{1-25}$, $C_{1-20}$, $C_{1-15}$, $C_{1-10}$, $C_{1-9}$, $C_{1-8}$, $C_{1-7}$, $C_{1-6}$, $C_{1-5}$, $C_{1-4}$, $C_{1-3}$, $C_{1-2}$, or $C_1$. In some embodiments, it is $C_1$. In some embodiments, it is $C_2$. In some embodiments, it is $C_3$. In some embodiments, it is $C_4$. In some embodiments, it is $C_5$. In some embodiments, it is $C_6$. In some embodiments, it is $C_7$. In some embodiments, it is $C_8$. In some embodiments, it is $C_9$. In some embodiments, it is $C_{10}$. In some embodiments, it is $C_{15}$. In some embodiments, it is $C_{20}$. In some embodiments, it is $C_{25}$.

In some embodiments, L is —$CH_2$—. In some embodiments, L is —$C(R)_2$—, wherein at least one R is not hydrogen. In some embodiments, L is —CHR—. In some embodiments, R is hydrogen. In some embodiments, L is —CHR—, wherein R is not hydrogen. In some embodiments, C of —CHR— is chiral. In some embodiments, L is —(R)—CHR—, wherein C of —CHR— is chiral. In some embodiments, L is —(S)—CHR—, wherein C of —CHR— is chiral. In some embodiments, R is optionally substituted $C_{1-6}$ aliphatic. In some embodiments, R is optionally substituted $C_{1-6}$ alkyl. In some embodiments, R is optionally substituted $C_{1-5}$ aliphatic. In some embodiments, R is optionally substituted $C_{1-5}$ alkyl. In some embodiments, R is optionally substituted $C_{1-4}$ aliphatic. In some embodiments, R is optionally substituted $C_{1-4}$ alkyl. In some embodiments, R is optionally substituted $C_{1-3}$ aliphatic. In some embodiments, R is optionally substituted $C_{1-3}$ alkyl. In some embodiments, R is optionally substituted $C_2$ aliphatic. In some embodiments, R is optionally substituted methyl. In some embodiments, R is $C_{1-6}$ aliphatic. In some embodiments, R is $C_{1-6}$ alkyl. In some embodiments, R is $C_{1-5}$ aliphatic. In some embodiments, R is $C_{1-5}$ alkyl. In some embodiments, R is $C_{1-4}$ aliphatic. In some embodiments, R is $C_{1-4}$ alkyl. In some embodiments, R is $C_{1-3}$ aliphatic. In some embodiments, R is $C_{1-3}$ alkyl. In some embodiments, R is $C_2$ aliphatic. In some embodiments, R is methyl. In some embodiments, R is $C_{1-6}$ haloaliphatic. In some embodiments, R is $C_{1-6}$ haloalkyl. In some embodiments, R is $C_{1-5}$ haloaliphatic. In some embodiments, R is $C_{1-5}$ haloalkyl. In some embodiments, R is $C_{1-4}$ haloaliphatic. In some embodiments, R is $C_{1-4}$ haloalkyl. In some embodiments, R is $C_{1-3}$ haloaliphatic. In some embodiments, R is $C_{1-3}$ haloalkyl. In some embodiments, R is $C_2$ haloaliphatic. In some embodiments, R is methyl substituted with one or more halogen. In some embodiments, R is —$CF_3$. In some embodiments, L is optionally substituted —CH=CH—. In some embodiments, L is optionally substituted (E)-CH=CH—. In some embodiments, L is optionally substituted (Z)—CH=CH—. In some embodiments, L is In some embodiments, L is -$L^3$-G-. In some embodiments, $L^3$ is optionally substituted —$CH_2$—. In some embodiments, $L^3$ is —$CH_2$—. In some embodiments, L is —C(R)$_2$—, wherein at least one R is not hydrogen. In some embodiments, L is —CHR—. In some embodiments, R is hydrogen. In some embodiments, L is —CHR—, wherein R is not hydrogen. In some embodiments, C of —CHR— is chiral. In some embodiments, L is —(R)—CHR—, wherein C of —CHR— is chiral. In some embodiments, L is —(S)—CHR—, wherein C of —CHR— is chiral. In some embodiments, R is optionally substituted $C_{1-6}$ aliphatic. In some embodiments, R is optionally substituted $C_{1-6}$ alkyl. In some embodiments, R is optionally substituted $C_{1-5}$ aliphatic. In some embodiments, R is optionally substituted $C_{1-5}$ alkyl. In some embodiments, R is optionally substituted $C_{1-4}$ aliphatic. In some embodiments, R is optionally substituted $C_{1-4}$ alkyl. In some embodiments, R is optionally substituted $C_{1-3}$ aliphatic. In some embodiments, R is optionally substituted $C_{1-3}$ alkyl. In some embodiments, R is optionally substituted $C_2$ aliphatic. In some embodiments, R is optionally substituted methyl. In some embodiments, R is $C_{1-6}$ aliphatic. In some embodiments, R is $C_{1-6}$ alkyl. In some embodiments, R is $C_{1-5}$ aliphatic. In some embodiments, R is $C_{1-5}$ alkyl. In some embodiments, R is $C_{1-4}$ aliphatic. In some embodiments, R is $C_{1-4}$ alkyl. In some embodiments, R is $C_{1-3}$ aliphatic. In some embodiments, R is $C_{1-3}$ alkyl. In some embodiments, R is $C_2$ aliphatic. In some embodiments, R is methyl. In some embodiments, R is $C_{1-6}$ haloaliphatic. In some embodiments, R is $C_{1-6}$ haloalkyl. In some embodiments, R is $C_{1-5}$ haloaliphatic. In some embodiments, R is $C_{1-5}$ haloalkyl. In some embodiments, R is $C_{1-4}$ haloaliphatic. In some embodiments, R is $C_{1-4}$ haloalkyl. In some embodiments, R is $C_{1-3}$ haloaliphatic. In some embodiments, R is $C_{1-3}$ haloalkyl. In some embodiments, R is $C_2$ haloaliphatic. In some embodiments, R is methyl substituted with one or more halogen. In some embodiments, R is —$CF_3$. In some embodiments, L is optionally substituted —CH=CH—. In some embodiments, L is optionally substituted (E)-CH=CH—. In some embodiments, L is optionally substituted (Z)—CH=CH—. In some embodiments, L is —C≡C—. In some embodiments, L is -Cy-.

In some embodiments, L is a bivalent, optionally substituted, linear or branched $C_{1-30}$ aliphatic group wherein one or more methylene units are optionally and independently replaced as described in the present disclosure. In some embodiments, L is a bivalent, optionally substituted, linear or branched $C_{1-30}$ heteroaliphatic group having 1-10 heteroatoms wherein one or more methylene units are optionally and independently replaced as described in the present disclosure.

In some embodiments, a heteroaliphatic group in the present disclosure, e.g., of L, R (including any variable that can be R), etc., comprises a

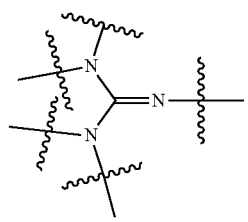 [SMILES: *N=C(N(*)*)N(*)*]

moiety. In some embodiments, =N— is directly bonded to a phosphorus atom. In some embodiments, a heteroaliphatic group comprises a

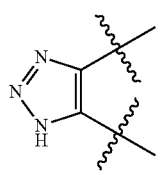 [SMILES: *c1nn[nH]c1*]

moiety. In some embodiments, a heteroaliphatic group comprises a

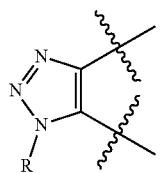

moiety. In some embodiments, such a moiety is directly bonded to a phosphorus atom. In some embodiments, R is optionally substituted $C_{1-6}$ aliphatic. In some embodiments, R is optionally substituted $C_{1-6}$ alkyl. In some embodiments, R is isopropyl.

In some embodiments, $Cy^L$ is an optionally substituted tetravalent group selected from a $C_{3-20}$ cycloaliphatic ring, a $C_{6-20}$ aryl ring, a 5-20 membered heteroaryl ring having 1-10 heteroatoms independently selected from oxygen, nitrogen, sulfur, phosphorus and silicon, and a 3-20 membered heterocyclyl ring having 1-10 heteroatoms independently selected from oxygen, nitrogen, sulfur, phosphorus, boron and silicon (in addition to the four connections it already has). In some embodiments, $Cy^L$ is an optionally substituted $C_{3-20}$ cycloaliphatic ring. In some embodiments, $Cy^L$ is an optionally substituted $C_{6-20}$ aryl ring. In some embodiments, $Cy^L$ is an optionally substituted 5-20 membered heteroaryl ring having 1-10 heteroatoms independently selected from oxygen, nitrogen, sulfur, phosphorus and silicon. In some embodiments, $Cy^L$ is an optionally substituted 3-20 membered heterocyclyl ring having 1-10 heteroatoms independently selected from oxygen, nitrogen, sulfur, phosphorus, boron and silicon. In some embodiments, heteroatoms are selected from oxygen, nitrogen, sulfur and phosphorus. In some embodiments, heteroatoms are selected from oxygen, nitrogen and sulfur. In some embodiments, heteroatoms are selected from oxygen and nitrogen.

In some embodiments, $Cy^L$ is monocyclic. In some embodiments, $Cy^L$ is bicyclic. In some embodiments, $Cy^L$ is polycyclic.

In some embodiments, $Cy^L$ is saturated. In some embodiments, $Cy^L$ is partially unsaturated. In some embodiments, $Cy^L$ is aromatic. In some embodiments, $Cy^L$ is or comprises a saturated ring moiety. In some embodiments, $Cy^L$ is or comprises a partially unsaturated ring moiety. In some embodiments, $Cy^L$ is or comprises an aromatic ring moiety.

In some embodiments, $Cy^L$ is an optionally substituted $C_{3-20}$ cycloaliphatic ring as described in the present disclosure (for example, those described for R but tetravalent). In some embodiments, a ring is an optionally substituted saturated $C_{3-20}$ cycloaliphatic ring. In some embodiments, a ring is an optionally substituted partially unsaturated $C_{3-20}$ cycloaliphatic ring. A cycloaliphatic ring can be of various sizes as described in the present disclosure. In some embodiments, a ring is 3, 4, 5, 6, 7, 8, 9, or 10-membered. In some embodiments, a ring is 3-membered. In some embodiments, a ring is 4-membered. In some embodiments, a ring is 5-membered. In some embodiments, a ring is 6-membered. In some embodiments, a ring is 7-membered. In some embodiments, a ring is 8-membered. In some embodiments, a ring is 9-membered. In some embodiments, a ring is 10-membered. In some embodiments, a ring is an optionally substituted cyclopropyl moiety. In some embodiments, a ring is an optionally substituted cyclobutyl moiety. In some embodiments, a ring is an optionally substituted cyclopentyl moiety. In some embodiments, a ring is an optionally substituted cyclohexyl moiety. In some embodiments, a ring is an optionally substituted cycloheptyl moiety. In some embodiments, a ring is an optionally substituted cyclooctanyl moiety. In some embodiments, a cycloaliphatic ring is a cycloalkyl ring. In some embodiments, a cycloaliphatic ring is monocyclic. In some embodiments, a cycloaliphatic ring is bicyclic. In some embodiments, a cycloaliphatic ring is polycyclic. In some embodiments, a ring is a cycloaliphatic moiety as described in the present disclosure for R with more valences.

In some embodiments, $Cy^L$ is an optionally substituted 6-20 membered aryl ring. In some embodiments, a ring is an optionally substituted trivalent or tetravalent phenyl moiety. In some embodiments, a ring is a tetravalent phenyl moiety. In some embodiments, a ring is an optionally substituted naphthalene moiety. A ring can be of different size as described in the present disclosure. In some embodiments, an aryl ring is 6-membered. In some embodiments, an aryl ring is 10-membered. In some embodiments, an aryl ring is 14-membered. In some embodiments, an aryl ring is monocyclic. In some embodiments, an aryl ring is bicyclic. In some embodiments, an aryl ring is polycyclic. In some embodiments, a ring is an aryl moiety as described in the present disclosure for R with more valences.

In some embodiments, $Cy^L$ is an optionally substituted 5-20 membered heteroaryl ring having 1-10 heteroatoms, e.g., independently selected from oxygen, nitrogen, sulfur, phosphorus and silicon. In some embodiments, $Cy^L$ is an optionally substituted 5-20 membered heteroaryl ring having 1-10 heteroatoms, e.g., independently selected from oxygen, nitrogen, and sulfur. In some embodiments, $Cy^L$ is an optionally substituted 5-6 membered heteroaryl ring having 1-4 heteroatoms, e.g., independently selected from oxygen, nitrogen, and sulfur. In some embodiments, $Cy^L$ is an optionally substituted 5-membered heteroaryl ring having 1-4 heteroatoms, e.g., independently selected from oxygen, nitrogen, and sulfur. In some embodiments, $Cy^L$ is an optionally substituted 6-membered heteroaryl ring having 1-4 heteroatoms, e.g., independently selected from oxygen, nitrogen, and sulfur. In some embodiments, as described in the present disclosure, heteroaryl rings can be of various sizes and contain various numbers and/or types of heteroatoms. In some embodiments, a heteroaryl ring contains no more than one heteroatom. In some embodiments, a heteroaryl ring contains more than one heteroatom. In some embodiments, a heteroaryl ring contains no more than one type of heteroatom. In some embodiments, a heteroaryl ring contains more than one type of heteroatoms. In some embodiments, a heteroaryl ring is 5-membered. In some embodiments, a heteroaryl ring is 6-membered. In some embodiments, a heteroaryl ring is 8-membered. In some embodiments, a heteroaryl ring is 9-membered. In some embodiments, a heteroaryl ring is 10-membered. In some embodiments, a heteroaryl ring is monocyclic. In some embodiments, a heteroaryl ring is bicyclic. In some embodiments, a heteroaryl ring is polycyclic. In some embodiments, a heteroaryl ring is a nucleobase moiety, e.g., A, T, C, G, U, etc. In some embodiments, a ring is a heteroaryl moiety as described in the present disclosure for R with more valences. In some embodiments, as in linkers described in the present disclosure, $Cy^L$ is In some embodiments, $Cy^L$ is a 3-20 membered heterocyclyl ring having 1-10 heteroatoms independently selected from oxygen, nitrogen, sulfur, phosphorus and silicon. In some embodiments, $Cy^L$ is a 3-20 membered heterocyclyl ring having 1-10 heteroatoms independently selected from oxygen, nitrogen, and sulfur. In some embodiments, a heterocyclyl ring is saturated. In some embodiments, a heterocyclyl ring is partially unsaturated. A heterocyclyl ring can be of various sizes as described in the present disclosure. In some embodiments, a ring is 3, 4, 5, 6, 7, 8, 9, or 10-membered. In some embodiments, a ring is 3-membered. In some embodiments, a ring is 4-membered. In some embodiments, a ring is 5-membered. In some embodiments, a ring is 6-membered. In some embodiments, a ring is 7-membered. In some embodiments, a ring is 8-membered. In some embodiments, a ring is 9-membered. In some embodiments, a ring is 10-membered. Heterocyclyl rings can contain various numbers and/or types of heteroatoms. In some embodiments, a heterocyclyl ring contains no more than one heteroatom. In some embodiments, a heterocyclyl ring contains more than one heteroatom. In some embodiments, a heterocyclyl ring contains no more than one type of heteroatom. In some embodiments, a heterocyclyl ring contains more than one type of heteroatoms. In some embodiments, a heterocyclyl ring is monocyclic. In some embodiments, a heterocyclyl ring is bicyclic. In some embodiments, a heterocyclyl ring is polycyclic. In some embodiments, a ring is a heterocyclyl moiety as described in the present disclosure for R with more valences.

As readily appreciated by a person having ordinary skill in the art, many suitable ring moieties are extensively described in and can be used in accordance with the present disclosure, for example, those described for R (which may have more valences for $Cy^L$).

In some embodiments, $Cy^L$ is a sugar moiety in a nucleic acid. In some embodiments, $Cy^L$ is an optionally substituted furanose moiety. In some embodiments, $Cy^L$ is a pyranose moiety. In some embodiments, $Cy^L$ is an optionally substituted furanose moiety found in DNA. In some embodiments, $Cy^L$ is an optionally substituted furanose moiety found in RNA. In some embodiments, $Cy^L$ is an optionally substituted 2'-deoxyribofuranose moiety. In some embodiments, $Cy^L$ is an optionally substituted ribofuranose moiety. In some embodiments, substitutions provide sugar modifications as described in the present disclosure. In some embodiments, an optionally substituted 2'-deoxyribofuranose moiety and/or an optionally substituted ribofuranose moiety comprise substitution at a 2'-position. In some embodiments, a 2'-position is a 2'-modification as described in the present disclosure. In some embodiments, a 2'-modification is —F. In some embodiments, a 2'-modification is —OR, wherein R is as described in the present disclosure. In some embodiments, R is not hydrogen. In some embodiments, $Cy^L$ is a modified sugar moiety, such as a sugar moiety in LNA, alpha-L-LNA or GNA. In some embodiments, $Cy^L$ is a modified sugar moiety, such as a sugar moiety in ENA. In some embodiments, $Cy^L$ is a terminal sugar moiety of an oligonucleotide, connecting an internucleotidic linkage and a nucleobase. In some embodiments, $Cy^L$ is a terminal sugar moiety of an oligonucleotide, for example, when that terminus is connected to a solid support optionally through a linker. In some embodiments, $Cy^L$ is a sugar moiety connecting two internucleotidic linkages and a nucleobase. Example sugars and sugar moieties are extensively described in the present disclosure.

In some embodiments, $Cy^L$ is a nucleobase moiety. In some embodiments, a nucleobase is a natural nucleobase, such as A, T, C, G, U, etc. In some embodiments, a nucleobase is a modified nucleobase. In some embodiments, $Cy^L$ is optionally substituted nucleobase moiety selected from A, T, C, G, U, and 5mC. Example nucleobases and nucleobase moieties are extensively described in the present disclosure.

In some embodiments, two $Cy^L$ moieties are bonded to each other, wherein one $Cy^L$ is a sugar moiety and the other is a nucleobase moiety. In some embodiments, such a sugar moiety and nucleobase moiety forms a nucleoside moiety. In some embodiments, a nucleoside moiety is natural. In some embodiments, a nucleoside moiety is modified. In some embodiments, $Cy^L$ is an optionally substituted natural nucleoside moiety selected from adenosine, 5-methyluridine, cytidine, guanosine, uridine, 5-methylcytidine, 2'-deoxyadenosine, thymidine, 2'-deoxycytidine, 2'-deoxyguanosine, 2'-deoxyuridine, and 5-methyl-2'-deoxycytidine. Example nucleosides and nucleosides moieties are extensive described in the present disclosure.

Ring $A^L$ can be either be monovalent, bivalent or polyvalent. In some embodiments, Ring $A^L$ is monovalent (e.g., when g is 0 and no substitution). In some embodiments, Ring $A^L$ is bivalent. In some embodiments, Ring $A^L$ is polyvalent. In some embodiments, Ring $A^L$ is bivalent and is -Cy-. In some embodiments, Ring $A^L$ is an optionally substituted bivalent triazole ring. In some embodiments, Ring $A^L$ is trivalent and is $Cy^L$. In some embodiments, Ring $A^L$ is tetravalent and is $Cy^L$. In some embodiments, Ring $A^L$ is optionally substituted

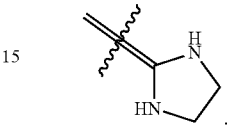

In some embodiments, -Cy- is an optionally substituted tetravalent group selected from a $C_{3-20}$ cycloaliphatic ring, a $C_{6-20}$ aryl ring, a 5-20 membered heteroaryl ring having 1-10 heteroatoms independently selected from oxygen, nitrogen, sulfur, phosphorus and silicon, and a 3-20 membered heterocyclyl ring having 1-10 heteroatoms independently selected from oxygen, nitrogen, sulfur, phosphorus, boron and silicon (in addition to the four connections it already has). In some embodiments, -Cy- is an optionally substituted $C_{3-20}$ cycloaliphatic ring. In some embodiments, -Cy- is an optionally substituted $C_{6-20}$ aryl ring. In some embodiments, -Cy- is an optionally substituted 5-20 membered heteroaryl ring having 1-10 heteroatoms independently selected from oxygen, nitrogen, sulfur, phosphorus and silicon. In some embodiments, -Cy- is an optionally substituted 3-20 membered heterocyclyl ring having 1-10 heteroatoms independently selected from oxygen, nitrogen, sulfur, phosphorus, boron and silicon. In some embodiments, heteroatoms are selected from oxygen, nitrogen, sulfur and phosphorus. In some embodiments, heteroatoms are selected from oxygen, nitrogen and sulfur. In some embodiments, heteroatoms are selected from oxygen and nitrogen.

In some embodiments, -Cy- is optionally substituted bivalent monocyclic, bicyclic or polycyclic $C_{3-20}$ cycloaliphatic. In some embodiments, -Cy- is optionally substituted bivalent monocyclic, bicyclic or polycyclic $C_{6-20}$ aryl. In some embodiments, -Cy- is optionally substituted monocyclic, bicyclic or polycyclic 3-20 membered heterocyclyl ring having 1-5 heteroatoms. In some embodiments, -Cy- is optionally substituted monocyclic, bicyclic or polycyclic 5-20 membered heterocyclyl ring having 1-5 heteroatoms, wherein at least one heteroatom is oxygen. In some embodiments, -Cy- is 3-10 membered. In some embodiments, -Cy- is 3-membered. In some embodiments, -Cy- is 4-membered. In some embodiments, -Cy- is 5-membered. In some embodiments, -Cy- is 6-membered. In some embodiments, -Cy- is 7-membered. In some embodiments, -Cy- is 8-membered. In some embodiments, -Cy- is 9-membered. In some embodiments, -Cy- is 10-membered. In some embodiments, -Cy- is optionally substituted bivalent tetrahydrofuran ring. In some embodiments, -Cy- is an optionally substituted furanose moiety. In some embodiments, -Cy- is an optionally substituted bivalent 5-membered heteroaryl ring having 1-4 heteroatoms. In some embodiments, at least one heteroatom is nitrogen. In some embodiments, each heteroatom is nitrogen. In some embodiments, -Cy- is an optionally substituted bivalent triazole ring. In some embodiments, In some embodiments, -Cy- is optionally substituted

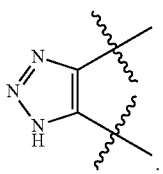

In some embodiments, -Cy- is

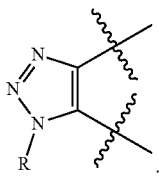

In some embodiments, R is optionally substituted $C_{1-6}$ aliphatic. In some embodiments, R is optionally substituted $C_{1-6}$ alkyl. In some embodiments, R is isopropyl.

In some embodiments, Ring A is an optionally substituted 3-20 membered monocyclic, bicyclic or polycyclic ring having 0-10 heteroatoms independently selected from independently selected from oxygen, nitrogen, sulfur, phosphorus and silicon (in addition to the one or more connections as shown in a structure). In some embodiments, Ring A is an optionally substituted multivalent, monocyclic, bicyclic or polycyclic, saturated, partially unsaturated, or aryl 3-30 membered ring having, in addition to the intervening nitrogen, phosphorus and oxygen atoms, 0-10 heteroatoms independently selected from oxygen, nitrogen, sulfur, phosphorus and silicon. In some embodiments, Ring A is an optionally substituted multivalent, monocyclic, bicyclic or polycyclic, saturated, partially unsaturated, or aryl 3-30 membered ring having, in addition to the intervening nitrogen, phosphorus and oxygen atoms, 0-10 heteroatoms independently selected from oxygen, nitrogen, and sulfur.

In some embodiments, Ring A is an optionally substituted multivalent, monocyclic, bicyclic or polycyclic, saturated, partially unsaturated, or aryl 3-30 membered ring having, in addition to the intervening nitrogen, phosphorus and oxygen atoms, 0 heteroatom.

In some embodiments, Ring A is an optionally substituted multivalent monocyclic saturated 5-7 membered ring having the intervening nitrogen, phosphorus and oxygen atoms and no additional heteroatoms. In some embodiments, Ring A is an optionally substituted multivalent monocyclic saturated 5-membered ring having the intervening nitrogen, phosphorus and oxygen atoms and no additional heteroatoms. In some embodiments, Ring A is an optionally substituted multivalent monocyclic saturated 6-membered ring having the intervening nitrogen, phosphorus and oxygen atoms and no additional heteroatoms. In some embodiments, Ring A is an optionally substituted multivalent monocyclic saturated 7-membered ring having the intervening nitrogen, phosphorus and oxygen atoms and no additional heteroatoms.

In some embodiments, Ring A is an optionally substituted multivalent, bicyclic, saturated, partially unsaturated, or aryl 5-30 membered ring having, in addition to the intervening nitrogen, phosphorus and oxygen atoms, 0-10 heteroatoms independently selected from oxygen, nitrogen, sulfur, phosphorus and silicon. In some embodiments, Ring A is an optionally substituted multivalent, bicyclic, saturated, partially unsaturated, or aryl 5-30 membered ring having, in addition to the intervening nitrogen, phosphorus and oxygen atoms, 0-10 heteroatoms independently selected from oxygen, nitrogen, and sulfur. In some embodiments, Ring A is a multivalent, bicyclic and saturated 8-10 membered bicyclic ring having the intervening nitrogen, phosphorus and oxygen atoms and no additional heteroatoms. In some embodiments, Ring A is a multivalent, bicyclic and saturated 8-membered bicyclic ring having the intervening nitrogen, phosphorus and oxygen atoms and no additional heteroatoms. In some embodiments, Ring A is a multivalent, bicyclic and saturated 9-membered bicyclic ring having the intervening nitrogen, phosphorus and oxygen atoms and no additional heteroatoms. In some embodiments, Ring A is a multivalent, bicyclic and saturated 10-membered bicyclic ring having the intervening nitrogen, phosphorus and oxygen atoms and no additional heteroatoms. In some embodiments, Ring A is bicyclic and comprises a 5-membered ring fused to a 5-membered ring. In some embodiments, Ring A is bicyclic and comprises a 5-membered ring fused to a 6-membered ring. In some embodiments, the 5-membered ring comprises the intervening nitrogen, phosphorus and oxygen atoms as ring atoms. In some embodiments, Ring A comprises a ring system having the backbone structure of

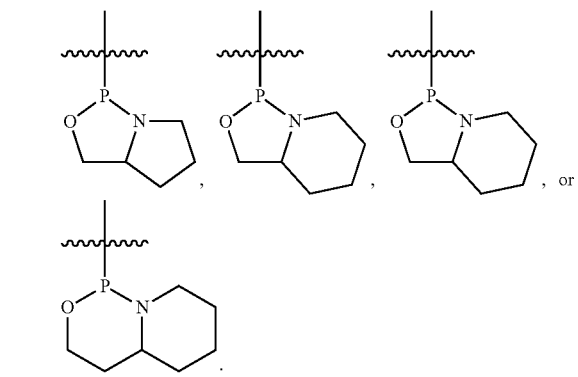

In some embodiments, Ring A is an optionally substituted multivalent, polycyclic, saturated, partially unsaturated, or aryl 3-30 membered ring having, in addition to the intervening nitrogen, phosphorus and oxygen atoms, 0-10 heteroatoms independently selected from oxygen, nitrogen, sulfur, phosphorus and silicon. In some embodiments, Ring A is an optionally substituted multivalent, polycyclic, saturated, partially unsaturated, or aryl 3-30 membered ring having, in addition to the intervening nitrogen, phosphorus and oxygen atoms, 0-10 heteroatoms independently selected from oxygen, nitrogen, and sulfur.

In some embodiments, Ring A is monocyclic, bicyclic or polycyclic and comprises an optionally substituted 5-10 membered monocyclic ring whose ring atoms comprise the intervening nitrogen, phosphorus and oxygen atoms. In some embodiments, Ring A is monocyclic, bicyclic or polycyclic and comprises an optionally substituted 5-9 membered monocyclic ring whose ring atoms comprise the intervening nitrogen, phosphorus and oxygen atoms. In some embodiments, Ring A is monocyclic, bicyclic or polycyclic and comprises an optionally substituted 5-8 membered monocyclic ring whose ring atoms comprise the intervening nitrogen, phosphorus and oxygen atoms. In some embodiments, Ring A is monocyclic, bicyclic or polycyclic and comprises an optionally substituted 5-7 membered monocyclic ring whose ring atoms comprise the intervening nitrogen, phosphorus and oxygen atoms. In some embodiments, Ring A is monocyclic, bicyclic or polycyclic and comprises an optionally substituted 5-6 membered monocyclic ring whose ring atoms comprise the intervening nitrogen, phosphorus and oxygen atoms.

In some embodiments, Ring A is monocyclic, bicyclic or polycyclic and comprises an optionally substituted 5-membered monocyclic ring whose ring atoms comprise the intervening nitrogen, phosphorus and oxygen atoms. In some embodiments, Ring A is monocyclic, bicyclic or polycyclic and comprises an optionally substituted 6-membered monocyclic ring whose ring atoms comprise the intervening nitrogen, phosphorus and oxygen atoms. In some embodiments, Ring A is monocyclic, bicyclic or polycyclic and comprises an optionally substituted 7-membered monocyclic ring whose ring atoms comprise the intervening nitrogen, phosphorus and oxygen atoms. In some embodiments, Ring A is monocyclic, bicyclic or polycyclic and comprises an optionally substituted 8-membered monocyclic ring whose ring atoms comprise the intervening nitrogen, phosphorus and oxygen atoms. In some embodiments, Ring A is monocyclic, bicyclic or polycyclic and comprises an optionally substituted 9-membered monocyclic ring whose ring atoms comprise the intervening nitrogen, phosphorus and oxygen atoms. In some embodiments, Ring A is monocyclic, bicyclic or polycyclic and comprises an optionally substituted 10-membered monocyclic ring whose ring atoms comprise the intervening nitrogen, phosphorus and oxygen atoms.

In some embodiments, Ring A is monocyclic, bicyclic or polycyclic and comprises an optionally substituted 5-membered ring whose ring atoms consist of the intervening nitrogen, phosphorus and oxygen atoms and carbon atoms. In some embodiments, Ring A is monocyclic, bicyclic or polycyclic and comprises an optionally substituted 6-membered ring whose ring atoms consist of the intervening nitrogen, phosphorus and oxygen atoms and carbon atoms. In some embodiments, Ring A is monocyclic, bicyclic or polycyclic and comprises an optionally substituted 7-membered ring whose ring atoms consist of the intervening nitrogen, phosphorus and oxygen atoms and carbon atoms. In some embodiments, Ring A is monocyclic, bicyclic or polycyclic and comprises an optionally substituted 8-membered ring whose ring atoms consist of the intervening nitrogen, phosphorus and oxygen atoms and carbon atoms. In some embodiments, Ring A is monocyclic, bicyclic or polycyclic and comprises an optionally substituted 9-membered ring whose ring atoms consist of the intervening nitrogen, phosphorus and oxygen atoms and carbon atoms. In some embodiments, Ring A is monocyclic, bicyclic or polycyclic and comprises an optionally substituted 10-membered ring whose ring atoms consist of the intervening nitrogen, phosphorus and oxygen atoms and carbon atoms.

In some embodiments, Ring A comprises a ring system having the backbone structure of

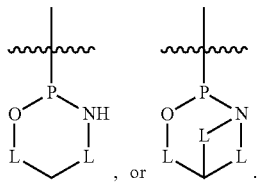

, or

In some embodiments, Ring A is optionally substituted

In some embodiments, Ring A is optionally substituted

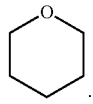

In some embodiments, $L^P$ is an link. In some embodiments, each $L^P$ independently has the structure of formula I. In some embodiments, $L^P$ is a natural phosphate linkage. In some embodiments, $L^P$ is a modified internucleotidic linkage. In some embodiments, $L^P$ is chiral. In some embodiments, $L^P$ is a phosphorothioate diester linkage.

In some embodiments, $P^L$ is P(=W). In some embodiments, $P^L$ is P. In some embodiments, $P^L$ is P→B(R')$_3$.

In some embodiments, W, O or S or Se. In some embodiments, W is O or S. In some embodiments, W is O. In some embodiments, W is S. In some embodiments, W is Se.

In some embodiments, $R^1$ is R, halogen, —CN, —NO$_2$, —Si(R)$_3$, —OR, —SR, or —N(R)$_2$. In some embodiments, $R^1$ is -L-R. In some embodiments, $R^1$ is hydrogen. In some embodiments, $R^1$ is R.

In some embodiments, $R^1$ is halogen, R, or an optionally substituted $C_1$-$C_{50}$ aliphatic wherein one or more methylene units are optionally and independently replaced by an optionally substituted group selected from $C_{1-6}$ alkylene, $C_{1-6}$ alkenylene, —C≡—, a $C_1$-$C_6$ heteroaliphatic moiety, —C(R')$_2$—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—. In some embodiments, $R^1$ is R. In some embodiments, $R^1$ is hydrogen. In some embodiments, $R^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$, -Cy-, —O—, —S—, SS, N(R')—, —C(O)—, —C(S)—, —C(NR')—, —C(O)N(R')—, —N(R')C(O)N(R')—, —N(R')C(O)—, —N(R')C(O)O—, —OC(O)N(W)-, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is halogen, R, or an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(W)—, —N(R')S(O)$_2$—, —SC(O)—, —C(O)S—, —OC(O)—, or —C(O)O—, wherein each variable is independently as defined above and described herein.

In some embodiments, $R^1$ is hydrogen. In some embodiments, $R^1$ is halogen. In some embodiments, $R^1$ is —F. In some embodiments, $R^1$ is —Cl. In some embodiments, $R^1$ is —Br. In some embodiments, $R^1$ is —I.

In some embodiments, $R^1$ is R wherein R is as defined above and described herein.

In some embodiments, $R^1$ is hydrogen. In some embodiments, $R^1$ is an optionally substituted group selected from $C_1$-$C_{50}$ aliphatic, phenyl, carbocyclyl, aryl, heteroaryl, or heterocyclyl.

In some embodiments, $R^1$ is an optionally substituted $C_1$-$C_{50}$ aliphatic. In some embodiments, $R^1$ is an optionally substituted $C_1$-$C_{10}$ aliphatic. In some embodiments, $R^1$ is an optionally substituted $C_1$-$C_6$ aliphatic. In some embodiments, $R^1$ is an optionally substituted $C_1$-$C_6$ alkyl. In some embodiments, $R^1$ is optionally substituted, linear or branched hexyl. In some embodiments, $R^1$ is optionally substituted, linear or branched pentyl. In some embodiments, $R^1$ is optionally substituted, linear or branched butyl. In some embodiments, $R^1$ is optionally substituted, linear or branched propyl. In some embodiments, $R^1$ is optionally substituted ethyl. In some embodiments, $R^1$ is optionally substituted methyl.

In some embodiments, $R^1$ is optionally substituted phenyl. In some embodiments, $R^1$ is substituted phenyl. In some embodiments, $R^1$ is phenyl.

In some embodiments, $R^1$ is optionally substituted carbocyclyl. In some embodiments, $R^1$ is optionally substituted $C_3$-$C_{10}$ carbocyclyl. In some embodiments, $R^1$ is optionally substituted monocyclic carbocyclyl. In some embodiments, $R^1$ is optionally substituted cycloheptyl. In some embodiments, $R^1$ is optionally substituted cyclohexyl. In some embodiments, $R^1$ is optionally substituted cyclopentyl. In some embodiments, $R^1$ is optionally substituted cyclobutyl. In some embodiments, $R^1$ is an optionally substituted cyclopropyl. In some embodiments, $R^1$ is optionally substituted bicyclic carbocyclyl.

In some embodiments, $R^1$ is an optionally substituted $C_1$-$C_{50}$ polycyclic hydrocarbon. In some embodiments, $R^1$ is an optionally substituted $C_1$-$C_{50}$ polycyclic hydrocarbon wherein one or more methylene units are optionally and independently replaced by an optionally substituted $C_1$-$C_6$ alkylene, $C_1$-$C_6$ alkenylene, —C≡C—, —C(R')$_2$, -Cy-, —O—, —S—, —S—S—, N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(W)—, —N(R')S(O)$_2$—, —SC(O)—, —C(O)S—, —OC(O)—, or —C(O)O—, wherein each variable is independently as defined above and described herein. In some embodiments, $R^1$ is optionally substituted

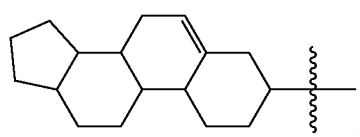

In some embodiments, $R^1$ is

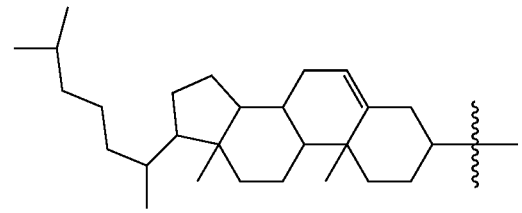

In some embodiments, $R^1$ is optionally substituted

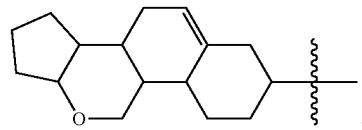

In some embodiments, $R^1$ is an optionally substituted $C_1$-$C_{50}$ aliphatic comprising one or more optionally substituted polycyclic hydrocarbon moieties. In some embodiments, $R^1$ is an optionally substituted $C_1$-$C_{50}$ aliphatic comprising one or more optionally substituted polycyclic hydrocarbon moieties, wherein one or more methylene units are optionally and independently replaced by an optionally substituted $C_1$-$C_6$ alkylene, $C_1$-$C_6$ alkenylene, —C≡C—, —C(R')$_2$, -Cy-, —O—, —S—, SS, N(R')—, —C(O)—, —C(S)—, —C(NR')—, —C(O)N(R')—, —N(R')C(O)N(R')—, —N(R')C(O)—, —N(R')C(O)O—, —OC(O)N(W)-, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is an optionally substituted $C_1$-$C_{50}$ aliphatic comprising one or more optionally substituted

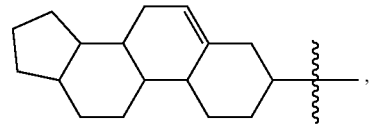

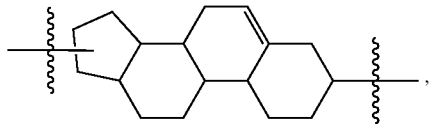

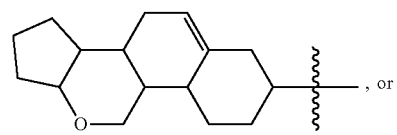

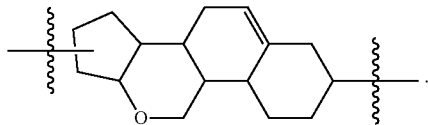

| 399 | 400 |
|---|---|
| In some embodiments, R¹ is | In some embodiments, R¹ is |
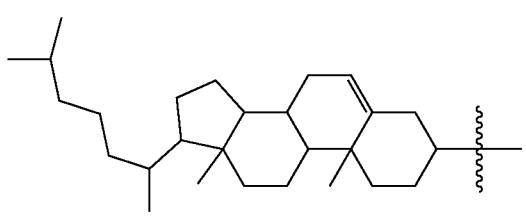
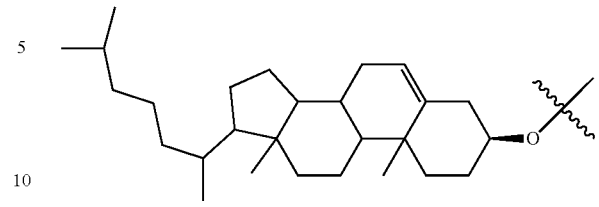
In some embodiments, R¹ is
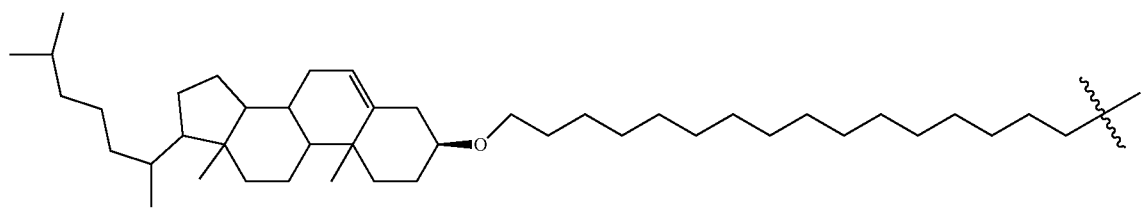 [SMILES: *CCCCCCCCCCCCCCCCO[C@H]1CCC2(C)C(=CCC3C2CCC2(C)C(C(C)CCCC(C)C)CCC32)C1]
In some embodiments, R¹ is
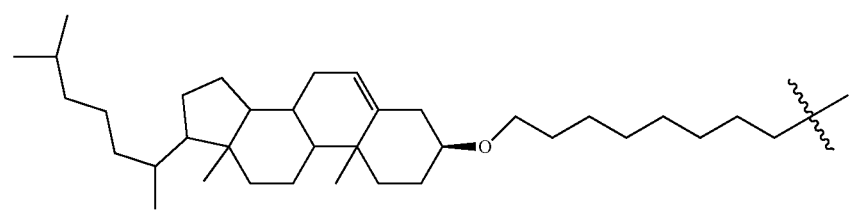 [SMILES: *CCCCCCCCO[C@H]1CCC2(C)C(=CCC3C2CCC2(C)C(C(C)CCCC(C)C)CCC32)C1]
In some embodiments, R¹ is
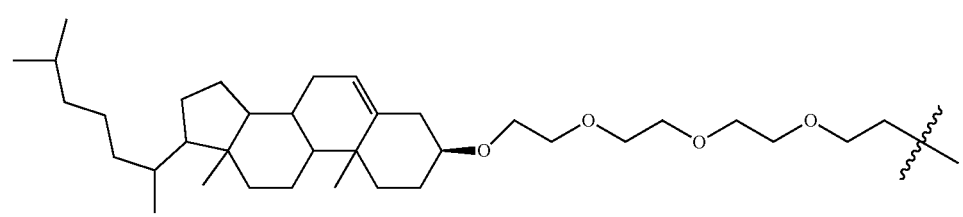 [SMILES: *CCOCCOCCOCCO[C@H]1CCC2(C)C(=CCC3C2CCC2(C)C(C(C)CCCC(C)C)CCC32)C1]

In some embodiments, $R^1$ is an optionally substituted aryl. In some embodiments, $R^1$ is an optionally substituted bicyclic aryl ring.

In some embodiments, $R^1$ is an optionally substituted heteroaryl. In some embodiments, $R^1$ is an optionally substituted 5-6 membered monocyclic heteroaryl ring having 1-3 heteroatoms independently selected from nitrogen, sulfur, and oxygen. In some embodiments, $R^1$ is a substituted 5-6 membered monocyclic heteroaryl ring having 1-3 heteroatoms independently selected from nitrogen, oxygen, and sulfur. In some embodiments, $R^1$ is an unsubstituted 5-6 membered monocyclic heteroaryl ring having 1-3 heteroatoms independently selected from nitrogen, sulfur, and oxygen.

In some embodiments, $R^1$ is an optionally substituted 5 membered monocyclic heteroaryl ring having 1-3 heteroatoms independently selected from nitrogen, sulfur, and oxygen. In some embodiments, $R^1$ is an optionally substituted 6 membered monocyclic heteroaryl ring having 1-3 heteroatoms independently selected from nitrogen, oxygen, and sulfur.

In some embodiments, $R^1$ is an optionally substituted 5-membered monocyclic heteroaryl ring having 1 heteroatom selected from nitrogen, oxygen, and sulfur. In some embodiments, $R^1$ is selected from pyrrolyl, furanyl, and thienyl.

In some embodiments, $R^1$ is an optionally substituted 5-membered heteroaryl ring having 2 heteroatoms independently selected from nitrogen, oxygen, and sulfur. In certain embodiments, $R^1$ is an optionally substituted 5-membered heteroaryl ring having 1 nitrogen atom, and an additional heteroatom selected from sulfur and oxygen. Example $R^1$ groups include optionally substituted pyrazolyl, imidazolyl, thiazolyl, isothiazolyl, oxazolyl or isoxazolyl.

In some embodiments, $R^1$ is a 6-membered heteroaryl ring having 1-3 nitrogen atoms. In other embodiments, $R^1$ is an optionally substituted 6-membered heteroaryl ring having 1-2 nitrogen atoms. In some embodiments, $R^1$ is an optionally substituted 6-membered heteroaryl ring having 2 nitrogen atoms. In certain embodiments, $R^1$ is an optionally substituted 6-membered heteroaryl ring having 1 nitrogen. Example $R^1$ groups include optionally substituted pyridinyl, pyrimidinyl, pyrazinyl, pyridazinyl, triazinyl, or tetrazinyl.

In certain embodiments, $R^1$ is an optionally substituted 8-10 membered bicyclic heteroaryl ring having 1-4 heteroatoms independently selected from nitrogen, oxygen, and sulfur. In some embodiments, $R^1$ is an optionally substituted 5,6-fused heteroaryl ring having 1-4 heteroatoms independently selected from nitrogen, oxygen, and sulfur. In other embodiments, $R^1$ is an optionally substituted 5,6-fused heteroaryl ring having 1-2 heteroatoms independently selected from nitrogen, oxygen, and sulfur. In certain embodiments, $R^1$ is an optionally substituted 5,6-fused heteroaryl ring having 1 heteroatom independently selected from nitrogen, oxygen, and sulfur. In some embodiments, $R^1$ is an optionally substituted indolyl. In some embodiments, $R^1$ is an optionally substituted azabicyclo[3.2.1]octanyl. In certain embodiments, $R^1$ is an optionally substituted 5,6-fused heteroaryl ring having 2 heteroatoms independently selected from nitrogen, oxygen, and sulfur. In some embodiments, $R^1$ is an optionally substituted azaindolyl. In some embodiments, $R^1$ is an optionally substituted benzimidazolyl. In some embodiments, $R^1$ is an optionally substituted benzothiazolyl. In some embodiments, $R^1$ is an optionally substituted benzoxazolyl. In some embodiments, $R^1$ is an optionally substituted indazolyl. In certain embodiments, $R^1$ is an optionally substituted 5,6-fused heteroaryl ring having 3 heteroatoms independently selected from nitrogen, oxygen, and sulfur.

In certain embodiments, $R^1$ is an optionally substituted 6,6-fused heteroaryl ring having 1-4 heteroatoms independently selected from nitrogen, oxygen, and sulfur. In some embodiments, $R^1$ is an optionally substituted 6,6-fused heteroaryl ring having 1-2 heteroatoms independently selected from nitrogen, oxygen, and sulfur. In other embodiments, $R^1$ is an optionally substituted 6,6-fused heteroaryl ring having 1 heteroatom independently selected from nitrogen, oxygen, and sulfur. In some embodiments, $R^1$ is an optionally substituted quinolinyl. In some embodiments, $R^1$ is an optionally substituted isoquinolinyl. According to one aspect, $R^1$ is an optionally substituted 6,6-fused heteroaryl ring having 2 heteroatoms independently selected from nitrogen, oxygen, and sulfur. In some embodiments, $R^1$ is a quinazoline or a quinoxaline.

In some embodiments, $R^1$ is an optionally substituted heterocyclyl. In some embodiments, $R^1$ is an optionally substituted 3-7 membered saturated or partially unsaturated heterocyclic ring having 1-2 heteroatoms independently selected from nitrogen, oxygen, and sulfur. In some embodiments, $R^1$ is a substituted 3-7 membered saturated or partially unsaturated heterocyclic ring having 1-2 heteroatoms independently selected from nitrogen, oxygen, and sulfur. In some embodiments, $R^1$ is an unsubstituted 3-7 membered saturated or partially unsaturated heterocyclic ring having 1-2 heteroatoms independently selected from nitrogen, oxygen, and sulfur.

In some embodiments, $R^1$ is an optionally substituted heterocyclyl. In some embodiments, $R^1$ is an optionally substituted 6 membered saturated or partially unsaturated heterocyclic ring having 1-2 heteroatoms independently selected from nitrogen, oxygen, and sulfur. In some embodiments, $R^1$ is an optionally substituted 6 membered partially unsaturated heterocyclic ring having 2 heteroatoms independently selected from nitrogen, oxygen, and sulfur. In some embodiments, $R^1$ is an optionally substituted 6 membered partially unsaturated heterocyclic ring having 2 oxygen atoms.

In certain embodiments, $R^1$ is a 3-7 membered saturated or partially unsaturated heterocyclic ring having 1-2 heteroatoms independently selected from nitrogen, oxygen, and sulfur. In certain embodiments, $R^1$ is oxiranyl, oxetanyl, tetrahydrofuranyl, tetrahydropyranyl, oxepaneyl, aziridineyl, azetidineyl, pyrrolidinyl, piperidinyl, azepanyl, thiiranyl, thietanyl, tetrahydrothiophenyl, tetrahydrothiopyranyl, thiepanyl, dioxolanyl, oxathiolanyl, oxazolidinyl, imidazolidinyl, thiazolidinyl, dithiolanyl, dioxanyl, morpholinyl, oxathianyl, piperazinyl, thiomorpholinyl, dithianyl, dioxepanyl, oxazepanyl, oxathiepanyl, dithiepanyl, diazepanyl, dihydrofuranonyl, tetrahydropyranonyl, oxepanonyl, pyrolidinonyl, piperidinonyl, azepanonyl, dihydrothiophenonyl, tetrahydrothiopyranonyl, thiepanonyl, oxazolidinonyl, oxazinanonyl, oxazepanonyl, dioxolanonyl, dioxanonyl, dioxepanonyl, oxathiolinonyl, oxathianonyl, oxathiepanonyl, thiazolidinonyl, thiazinanonyl, thiazepanonyl, imidazolidinonyl, tetrahydropyrimidinonyl, diazepanonyl, imidazolidinedionyl, oxazolidinedionyl, thiazolidinedionyl, dioxolanedionyl, oxathiolanedionyl, piperazinedionyl, morpholinedionyl, thiomorpholinedionyl, tetrahydropyranyl, tetrahydrofuranyl, morpholinyl, thiomorpholinyl, piperidinyl, piperazinyl, pyrrolidinyl, tetrahydrothiophenyl, or tetrahydrothiopyranyl. In some embodiments, $R^1$ is an optionally substituted 5 membered saturated or partially unsaturated heterocyclic ring having 1-2 heteroatoms independently selected from nitrogen, oxygen, and sulfur.

In certain embodiments, $R^1$ is an optionally substituted 5-6 membered partially unsaturated monocyclic ring having 1-2 heteroatoms independently selected from nitrogen, oxygen, and sulfur. In certain embodiments, $R^1$ is an optionally substituted tetrahydropyridinyl, dihydrothiazolyl, dihydrooxazolyl, or oxazolinyl group.

In some embodiments, $R^1$ is an optionally substituted 8-10 membered bicyclic saturated or partially unsaturated heterocyclic ring having 1-4 heteroatoms independently selected from nitrogen, oxygen, and sulfur. In some embodiments, $R^1$ is an optionally substituted indolinyl. In some embodiments, $R^1$ is an optionally substituted isoindolinyl. In some embodiments, $R^1$ is an optionally substituted 1, 2, 3, 4-tetrahydroquinoline. In some embodiments, $R^1$ is an optionally substituted 1, 2, 3, 4-tetrahydroisoquinoline.

In some embodiments, $R^1$ is an optionally substituted $C_1$-$C_{10}$ aliphatic wherein one or more methylene units are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—, wherein each variable is independently as defined above and described herein. In some embodiments, $R^1$ is an optionally substituted $C_1$-$C_{10}$ aliphatic wherein one or more methylene units are optionally and independently replaced by an optionally -Cy-, —O—, —S—, —S—S—, N(R')—, —C(O)—, —C(S)—, —C(NR')—, —C(O)N (R')—, —N(R')C(O)N(R')—, —N(R')C(O)—, —N(R')C(O)O—, —OC(O)N(R')—, —S(O)—, —S(O)$_2$—, —S(O)$_2$N (R')—, —N(W)S(O)$_2$—, —OC(O)—, or —C(O)O—, wherein each R' is independently as defined above and described herein. In some embodiments, $R^1$ is an optionally substituted $C_1$-$C_{10}$ aliphatic wherein one or more methylene units are optionally and independently replaced by an optionally -Cy-, —O—, —S—, —S—S—, —N(R')—, —C(O)—, —OC(O)—, or —C(O)O—, wherein each R' is independently as defined above and described herein.

In some embodiments, $R^1$ is

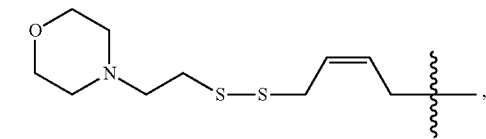

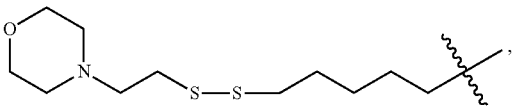

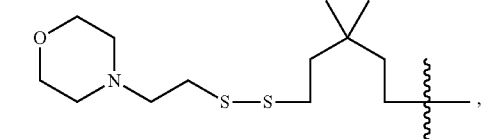

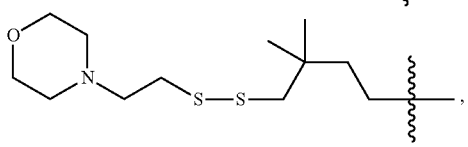

-continued

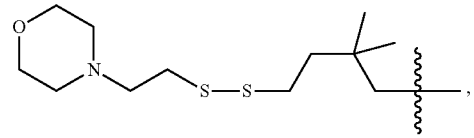

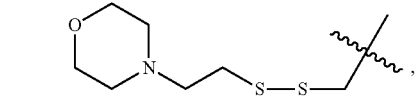

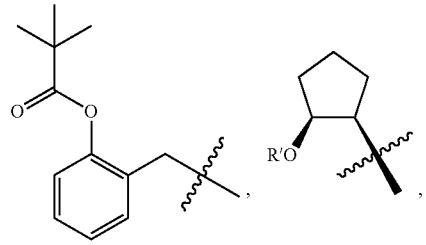

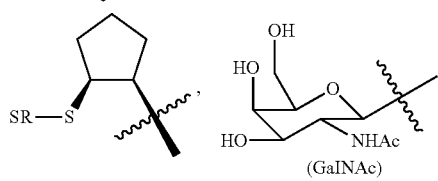

(GalNAc)

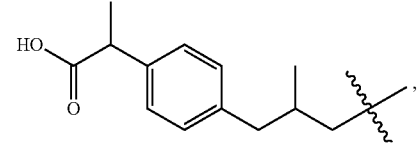

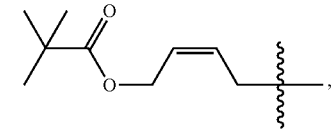

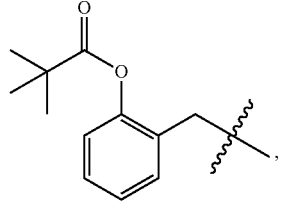

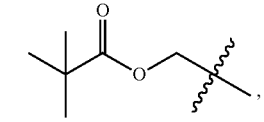

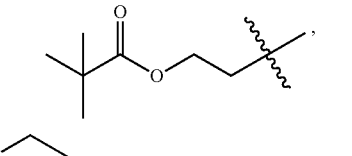

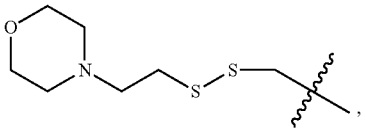

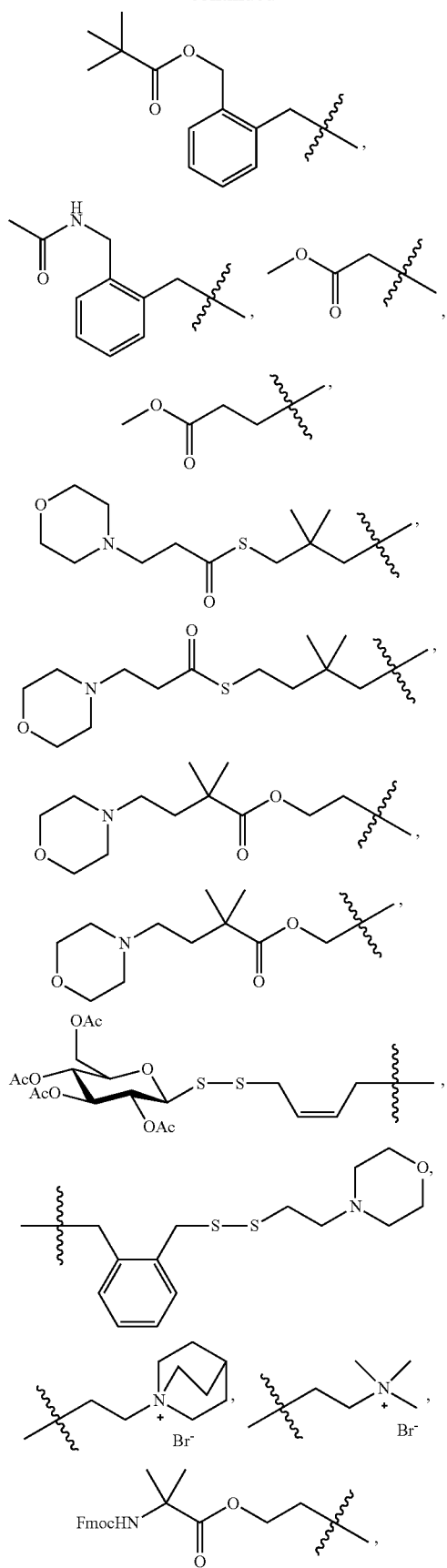
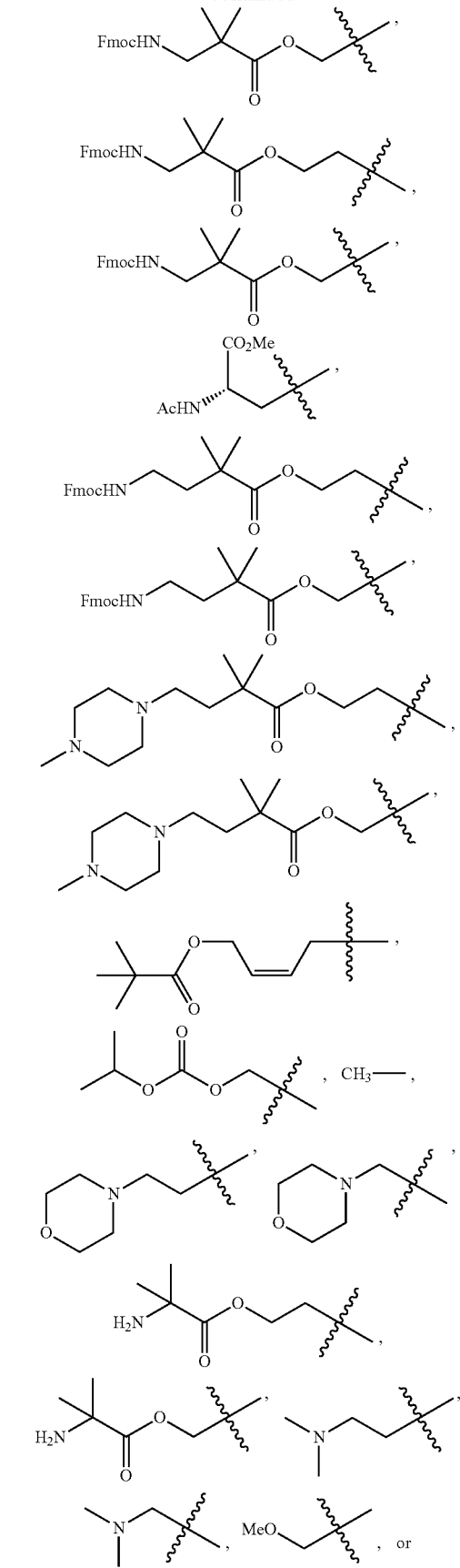

407

-continued

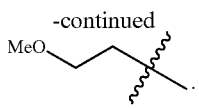

In some embodiments, R¹ is CH₃—,

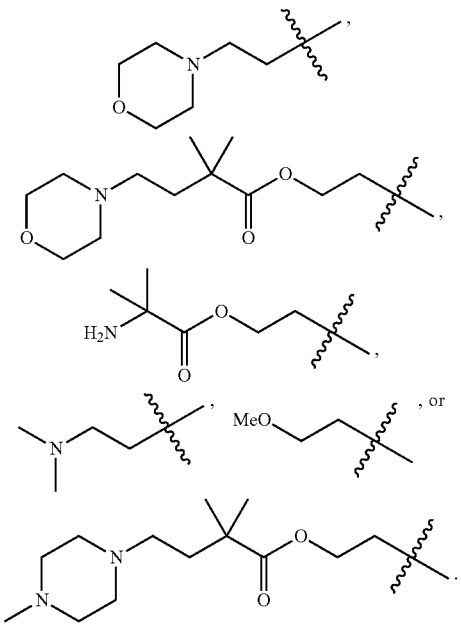

In some embodiments, R¹ comprises a terminal optionally substituted —(CH₂)₂— moiety which is connected to L. Examples of such R¹ groups are depicted below:

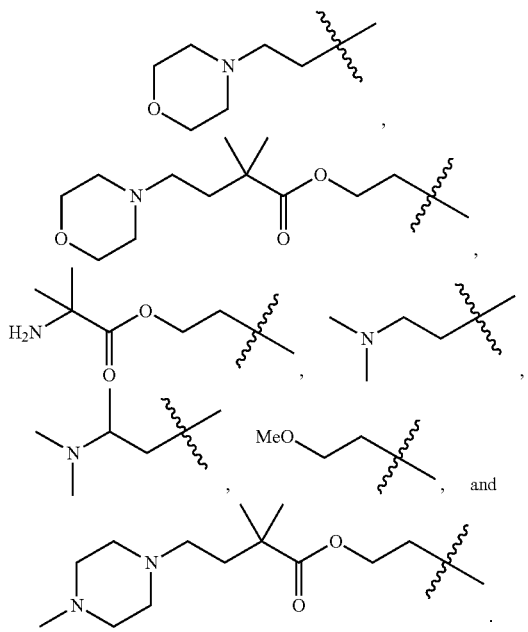

In some embodiments, R¹ comprises a terminal optionally substituted —(CH₂)— moiety which is connected to L. Example such R¹ groups are depicted below:

408

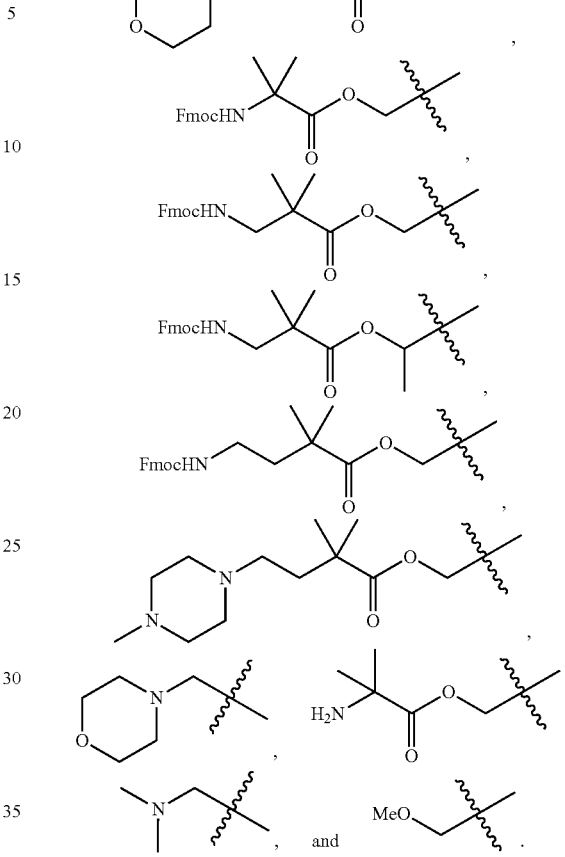

In some embodiments, R¹ is —S—R$^{L2}$, wherein R$^{L2}$ is an optionally substituted C₁-C₉ aliphatic wherein one or more methylene units are optionally and independently replaced by an optionally substituted C₁-C₆ alkylene, C₁-C₆ alkenylene, —C≡C—, —C(R')₂—, -Cy-, —O—, —S—, —S—S—, N(R')—, —C(O)—, —C(S)—, —C(NR')—, —C(O)N(R')—, —N(R')C(O)N(R')—, —N(R')C(O)—, —N(R')C(O)O—, —OC(O)N(W)-, —S(O)—, —S(O)₂—, —S(O)₂N(R')—, —N(R')S(O)₂—, —SC(O)—, —C(O)S—, —OC(O)—, or —C(O)O—, and each of R' and -Cy- is independently as defined above and described herein. In some embodiments, R¹ is —S—R$^{L2}$, wherein the sulfur atom is connected with the sulfur atom in L group.

In some embodiments, R¹ is —C(O)—R$^{L2}$, wherein R$^{L2}$ is an optionally substituted C₁-C₉ aliphatic wherein one or more methylene units are optionally and independently replaced by an optionally substituted C₁-C₆ alkylene, C₁-C₆ alkenylene, —C≡—, —C(R')₂—, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)₂—, —S(O)₂N(R')—, —N(R')S(O)₂—, —SC(O)—, —C(O)S—, —OC(O)—, or —C(O)O—, and each of R' and -Cy- is independently as defined above and described herein. In some embodiments, R¹ is —C(O)—R$^{L2}$, wherein the carbonyl group is connected with G in L group. In some embodiments, R¹ is —C(O)—R$^{L2}$, wherein the carbonyl group is connected with the sulfur atom in L group.

In some embodiments, $R^{L2}$ is optionally substituted $C_1$-$C_9$ aliphatic. In some embodiments, $R^{L2}$ is optionally substituted $C_1$-$C_9$ alkyl. In some embodiments, $R^{L2}$ is optionally substituted $C_1$-$C_9$ alkenyl. In some embodiments, $R^{L2}$ is optionally substituted $C_1$-$C_9$ alkynyl. In some embodiments, $R^{L2}$ is an optionally substituted $C_1$-$C_9$ aliphatic wherein one or more methylene units are optionally and independently replaced by -Cy- or —C(O)—. In some embodiments, $R^{L2}$ is an optionally substituted $C_1$-$C_9$ aliphatic wherein one or more methylene units are optionally and independently replaced by -Cy-. In some embodiments, $R^{L2}$ is an optionally substituted $C_1$-$C_9$ aliphatic wherein one or more methylene units are optionally and independently replaced by an optionally substituted heterocycylene. In some embodiments, $R^{L2}$ is an optionally substituted $C_1$-$C_9$ aliphatic wherein one or more methylene units are optionally and independently replaced by an optionally substituted arylene. In some embodiments, $R^{L2}$ is an optionally substituted $C_1$-$C_9$ aliphatic wherein one or more methylene units are optionally and independently replaced by an optionally substituted heteroarylene. In some embodiments, $R^{L2}$ is an optionally substituted $C_1$-$C_9$ aliphatic wherein one or more methylene units are optionally and independently replaced by an optionally substituted $C_3$-$C_{10}$ carbocyclylene. In some embodiments, $R^{L2}$ is an optionally substituted $C_1$-$C_9$ aliphatic wherein two methylene units are optionally and independently replaced by -Cy- or —C(O)—. In some embodiments, $R^{L2}$ is an optionally substituted $C_1$-$C_9$ aliphatic wherein two methylene units are optionally and independently replaced by -Cy- or —C(O)—. Example $R^{L2}$ groups are depicted below:

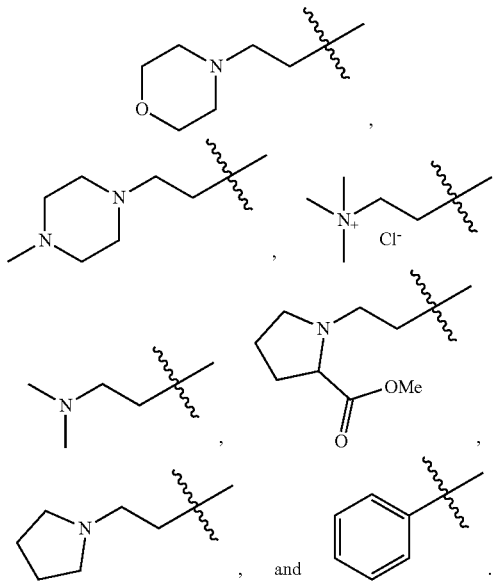

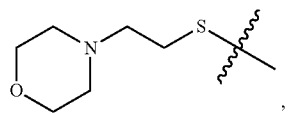

In some embodiments, $R^1$ is hydrogen, or an optionally substituted group selected from

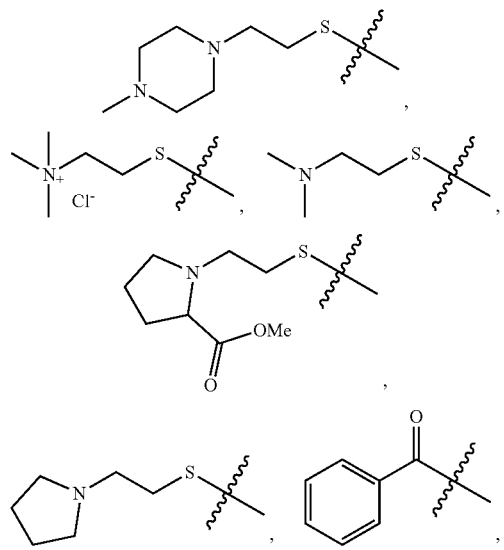

—S—($C_1$-$C_{10}$ aliphatic), $C_1$-$C_{10}$ aliphatic, aryl, $C_1$-$C_6$ heteroalkyl, heteroaryl and heterocyclyl. In some embodiments, $R^1$ is

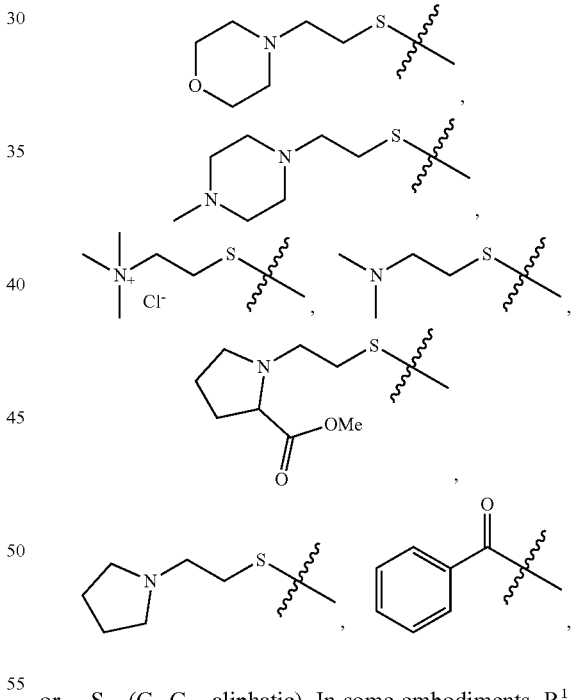

or —S—($C_1$-$C_{10}$ aliphatic). In some embodiments, $R^1$ is

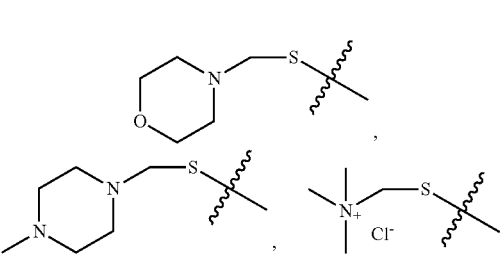

-continued

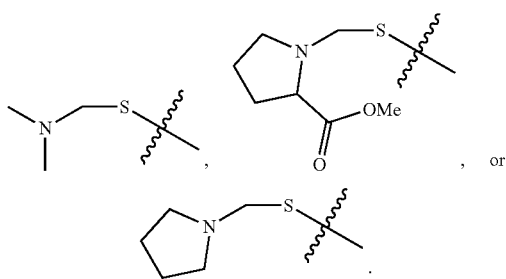

In some embodiments, $R^1$ is an optionally substituted group selected from —S—($C_1$-$C_6$ aliphatic), $C_1$-$C_{10}$ aliphatic, $C_1$-$C_6$ heteroaliphatic, aryl, heterocyclyl and heteroaryl.

In some embodiments, $R^1$ is

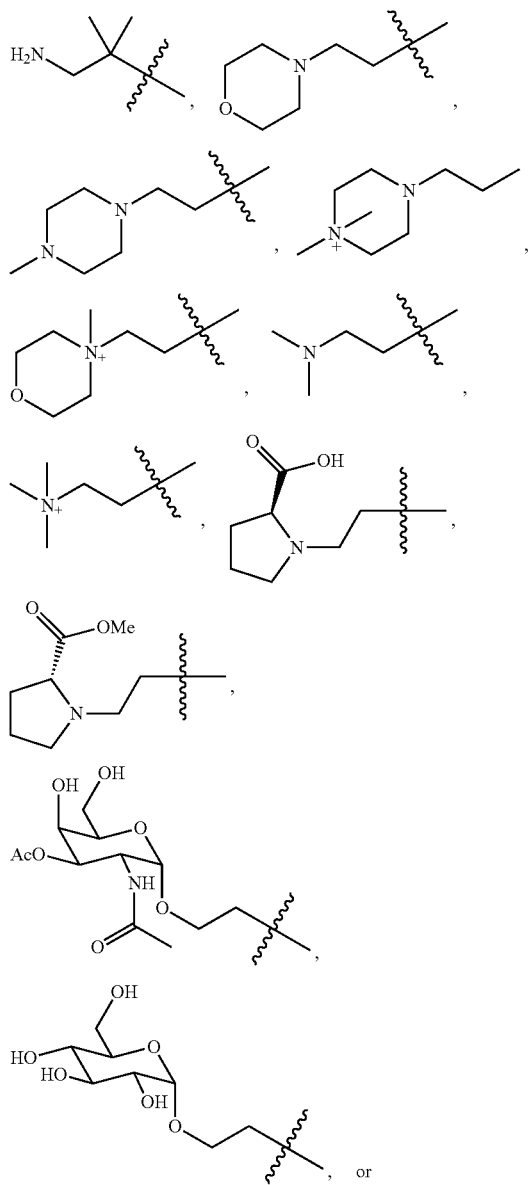

-continued

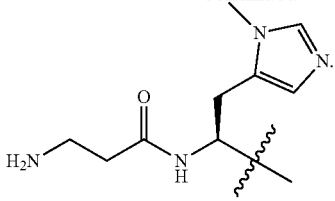

In some embodiments, the sulfur atom in the $R^1$ embodiments described above and herein is connected with the sulfur atom, G, E, or —C(O)— moiety in the L embodiments described above and herein. In some embodiments, the —C(O)— moiety in the $R^1$ embodiments described above and herein is connected with the sulfur atom, G, E, or —C(O)— moiety in the L embodiments described above and herein.

In some embodiments, -L-$R^1$ is any combination of the L embodiments and $R^1$ embodiments described above and herein.

In some embodiments, -L-$R^1$ is -$L^3$-G-$R^1$ wherein each variable is independently as defined above and described herein.

In some embodiments, -L-$R^1$ is -$L^4$-G-$R^1$ wherein each variable is independently as defined above and described herein.

In some embodiments, -L-$R^1$ is -$L^3$-G-S—$R^{L2}$, wherein each variable is independently as defined above and described herein.

In some embodiments, -L-$R^1$ is -$L^3$-G-C(O)—$R^{L2}$, wherein each variable is independently as defined above and described herein.

In some embodiments, -L-$R^1$ is

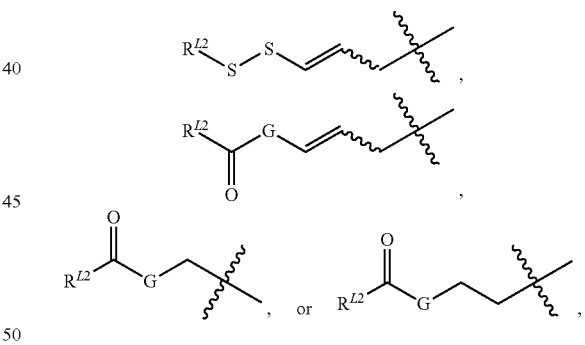

wherein $R^{12}$ is an optionally substituted $C_1$-$C_9$ aliphatic wherein one or more methylene units are optionally and independently replaced by an optionally substituted $C_1$-$C_6$ alkylene, $C_1$-$C_6$ alkenylene, —C≡C—, —C(R')$_2$, -Cy-, —O—, —S—, —S—S—, N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(W)—, —N(R')S(O)$_2$—, —SC(O)—, —C(O)S—, —OC(O)—, or —C(O)O—, and each G is independently as defined above and described herein.

In some embodiments, -L-$R^1$ is —$R^{13}$—S—S—$R^{L2}$, wherein each variable is independently as defined above and described herein. In some embodiments, -L-$R^1$ is —$R^{L3}$—C(O)—S—S—$R^{12}$, wherein each variable is independently as defined above and described herein.

In some embodiments, -L-R¹ has the structure of:

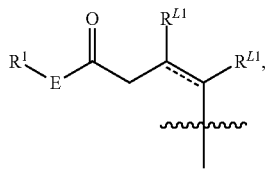

wherein each variable is independently as defined above and described herein.

In some embodiments, -L-R¹ has the structure of:

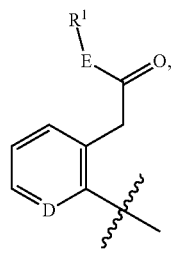

wherein each variable is independently as defined above and described herein.

In some embodiments, -L-R¹ has the structure of:

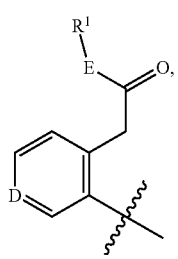

wherein each variable is independently as defined above and described herein.

In some embodiments, -L-R¹ has the structure of:

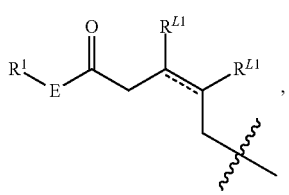

wherein each variable is independently as defined above and described herein.

In some embodiments, -L-R¹ has the structure of:

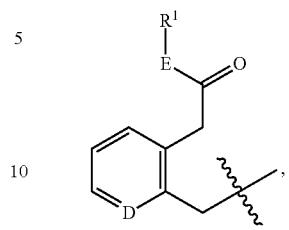

wherein each variable is independently as defined above and described herein.

In some embodiments, -L-R¹ has the structure of:

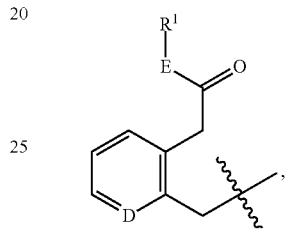

wherein each variable is independently as defined above and described herein.

In some embodiments, -L-R¹ has the structure of:

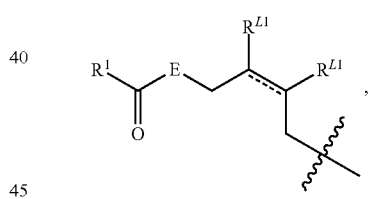

wherein each variable is independently as defined above and described herein.

In some embodiments, -L-R¹ has the structure of:

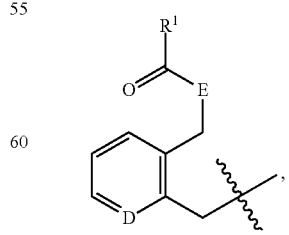

wherein each variable is independently as defined above and described herein.

In some embodiments, -L-R¹ has the structure of:

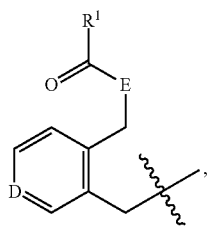

wherein each variable is independently as defined above and described herein.

In some embodiments, -L-R¹ has the structure of:

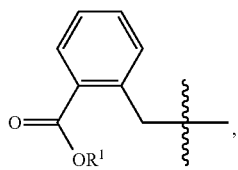

wherein each variable is independently as defined above and described herein.

In some embodiments, -L-R¹ has the structure of:

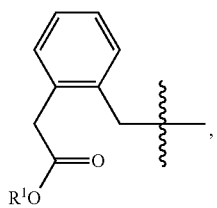

wherein each variable is independently as defined above and described herein.

In some embodiments, -L-R¹ has the structure of:

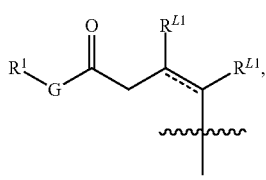

wherein each variable is independently as defined above and described herein.

In some embodiments, -L-R¹ has the structure of:

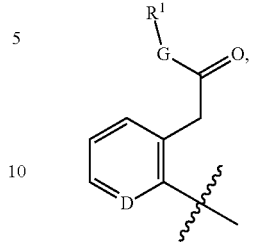

wherein each variable is independently as defined above and described herein.

In some embodiments, -L-R¹ has the structure of:

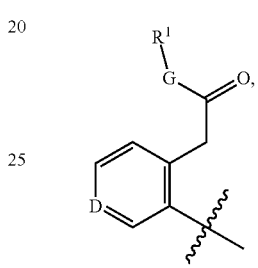

wherein each variable is independently as defined above and described herein.

In some embodiments, -L-R¹ has the structure of:

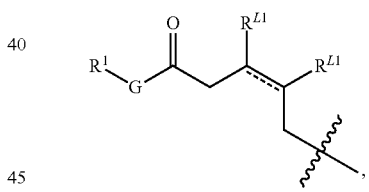

wherein each variable is independently as defined above and described herein.

In some embodiments, -L-R¹ has the structure of:

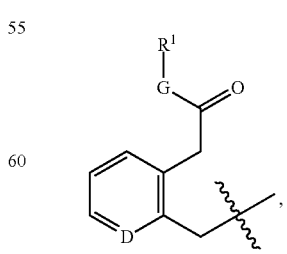

wherein each variable is independently as defined above and described herein.

In some embodiments, -L-R¹ has the structure of:

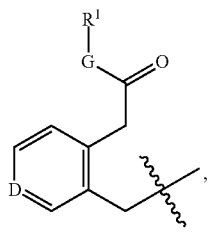

wherein each variable is independently as defined above and described herein.

In some embodiments, -L-R¹ has the structure of:

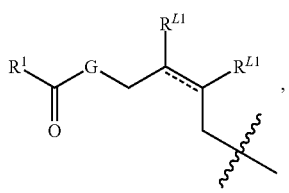

wherein each variable is independently as defined above and described herein.

In some embodiments, -L-R¹ has the structure of:

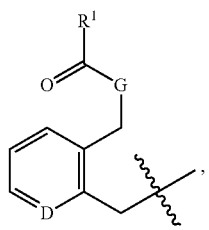

wherein each variable is independently as defined above and described herein.

In some embodiments, -L-R¹ has the structure of:

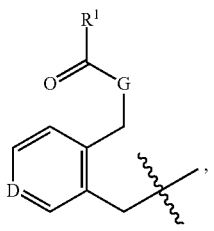

wherein each variable is independently as defined above and described herein.

In some embodiments, -L-R¹ has the structure of:

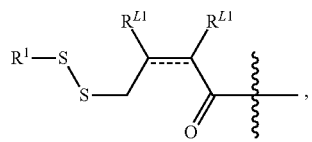

wherein each variable is independently as defined above and described herein.

In some embodiments, L has the structure of:

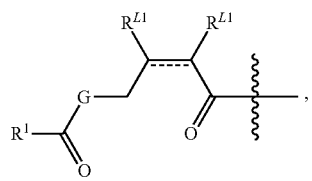

wherein each variable is independently as defined above and described herein.

In some embodiments, —X-L-R¹ has the structure of:

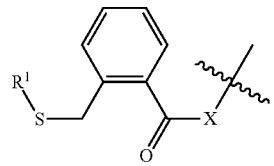

wherein:
the phenyl ring is optionally substituted, and
each of R¹ and X is independently as defined above and described herein.

In some embodiments, -L-R¹ is

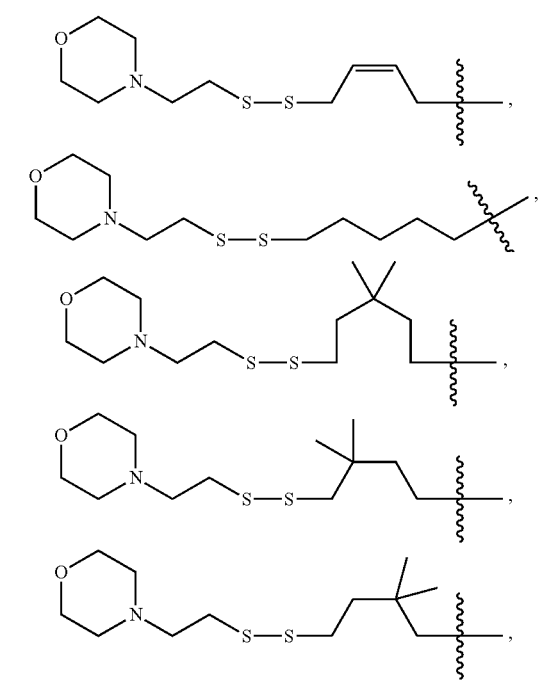

419
-continued
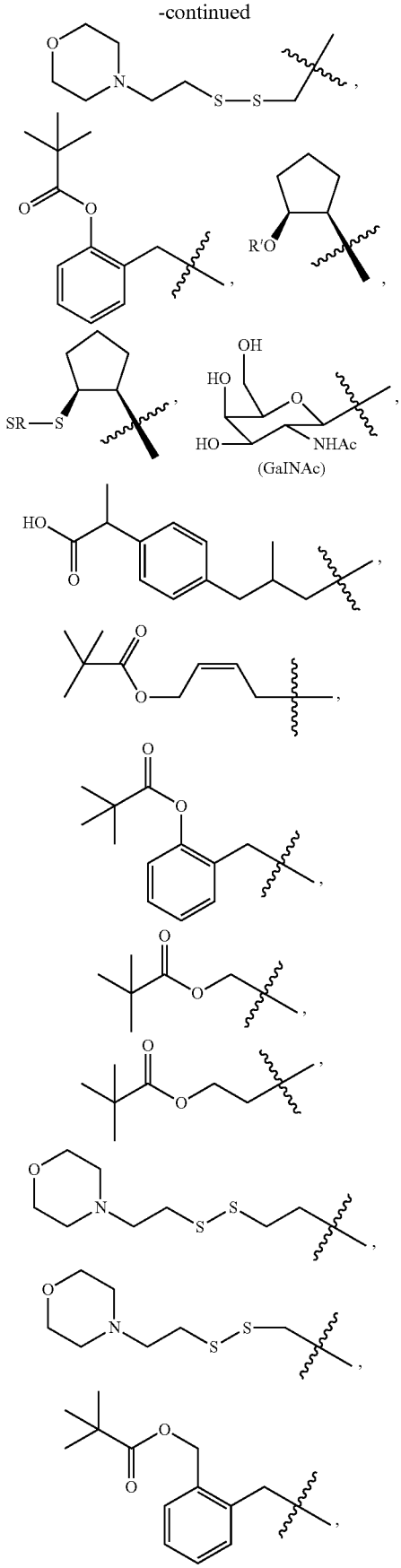
420
-continued
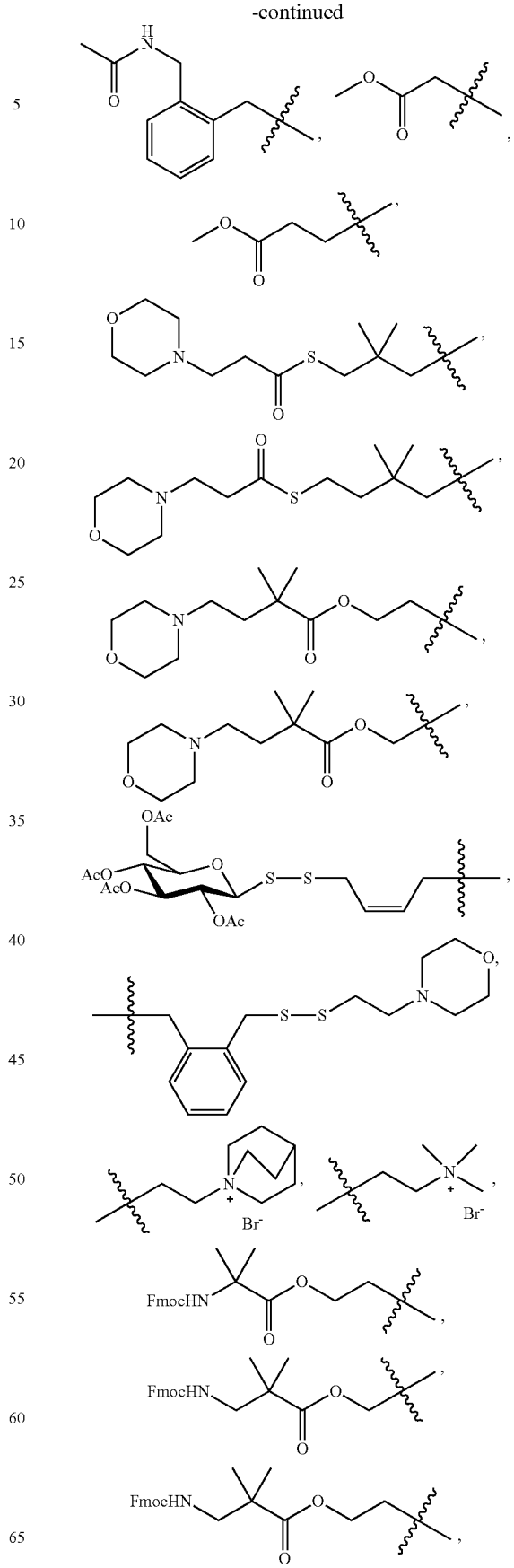

-continued
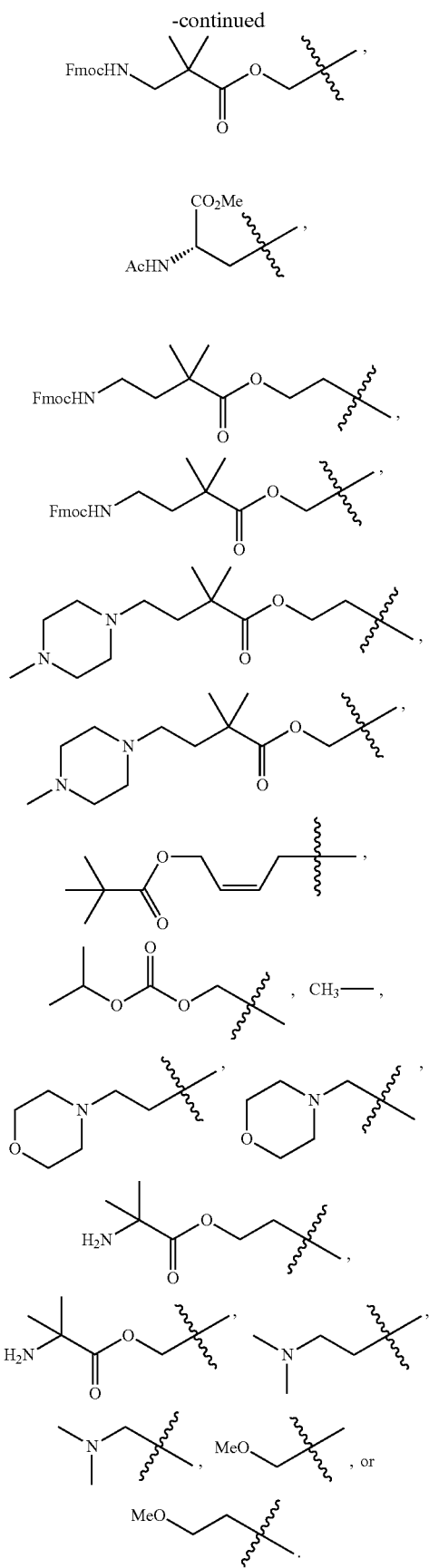
In some embodiments, -L-R¹ is:
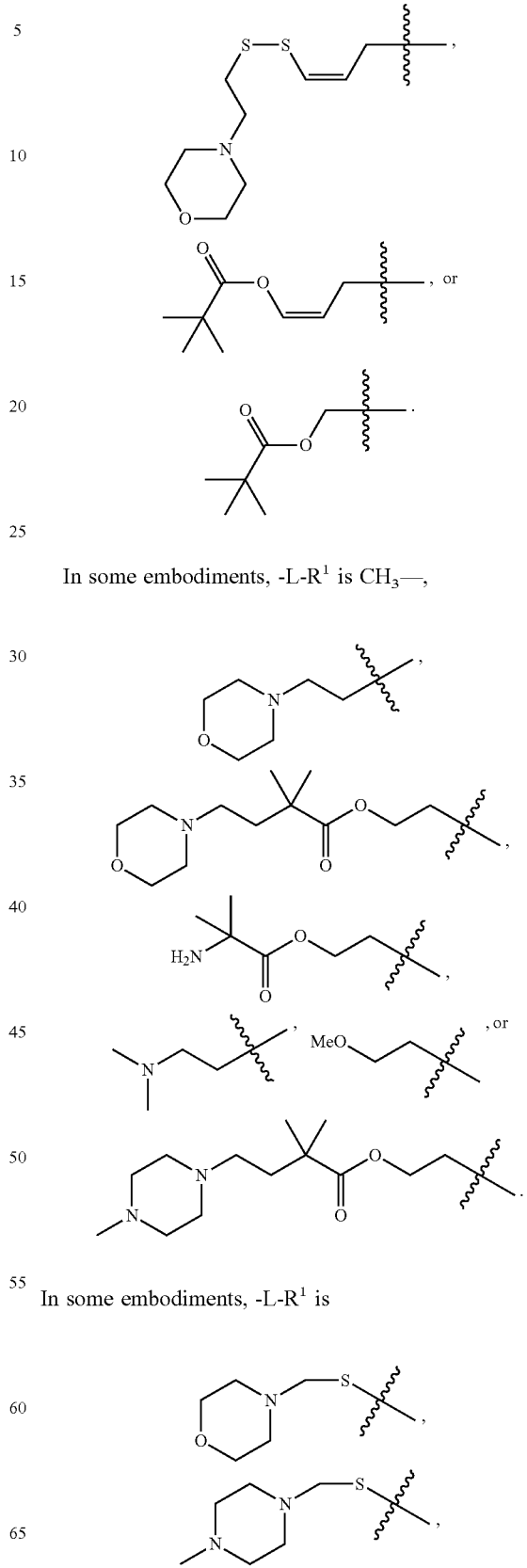
In some embodiments, -L-R¹ is CH₃—,
In some embodiments, -L-R¹ is

423

-continued

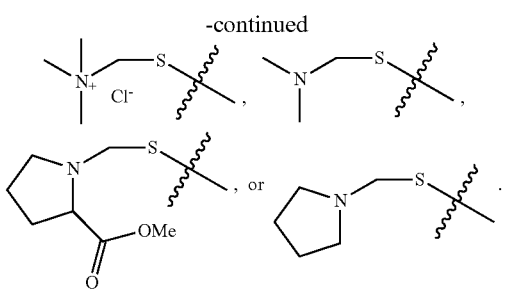

In some embodiments, -L-R¹ comprises a terminal optionally substituted —(CH$_2$)$_2$— moiety which is connected to X. In some embodiments, -L-R¹ comprises a terminal —(CH$_2$)$_2$— moiety which is connected to X. Examples of such -L-R¹ moieties are depicted below:

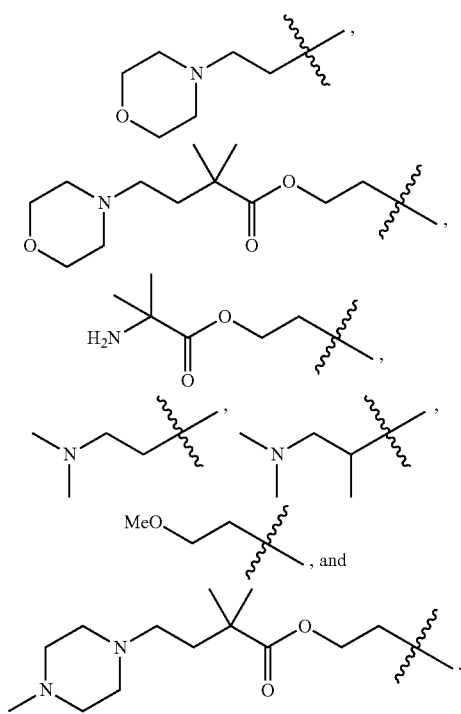

In some embodiments, -L-R¹ comprises a terminal optionally substituted —(CH$_2$)— moiety which is connected to X.

424

In some embodiments, -L-R¹ comprises a terminal —(CH$_2$)— moiety which is connected to X. Examples of such -L-R¹ moieties are depicted below:

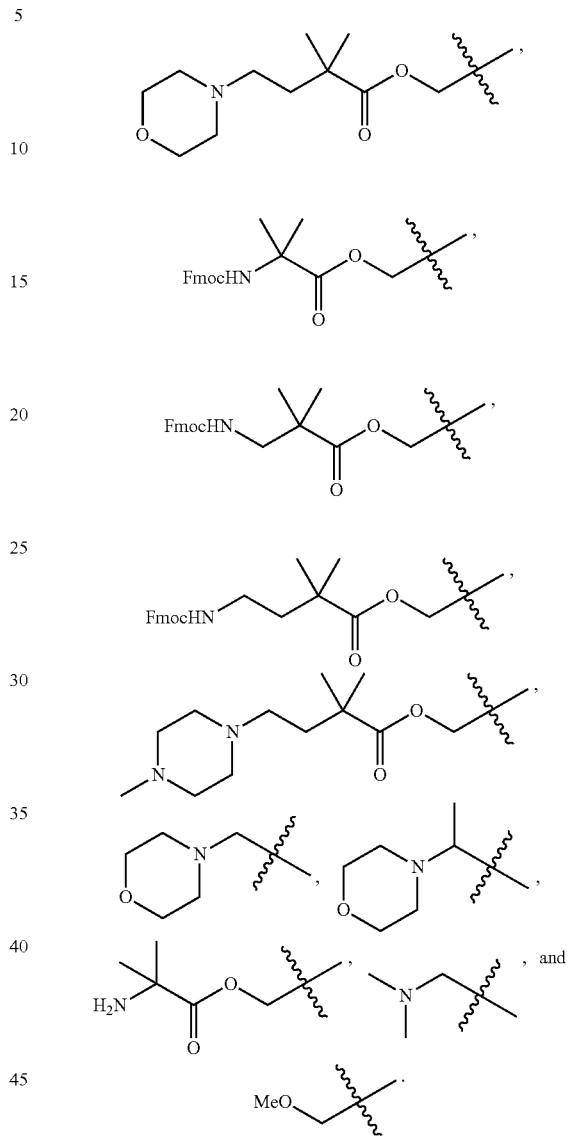

In some embodiments, -L-R¹ is

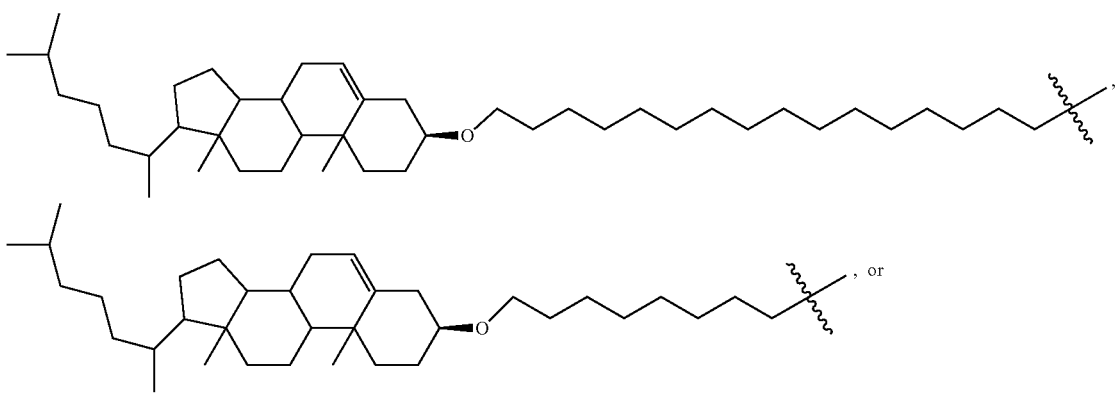

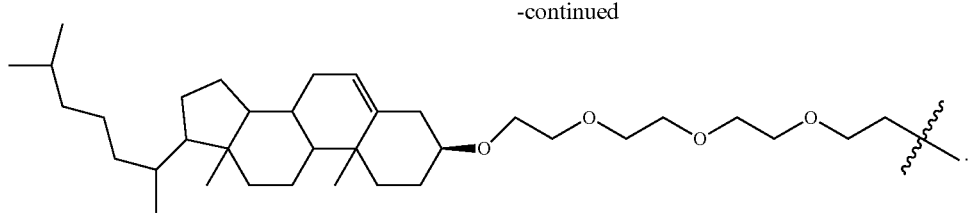
In some embodiments, -L-R¹ is CH₃—,
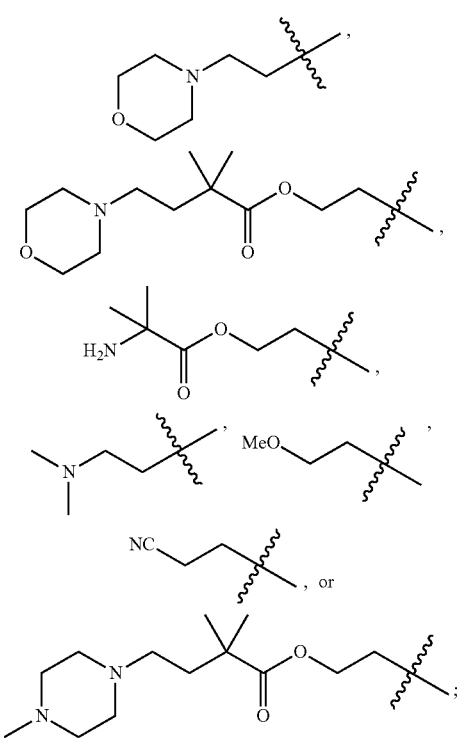
and X is —S—.
In some embodiments, -L-R¹ is CH₃—,
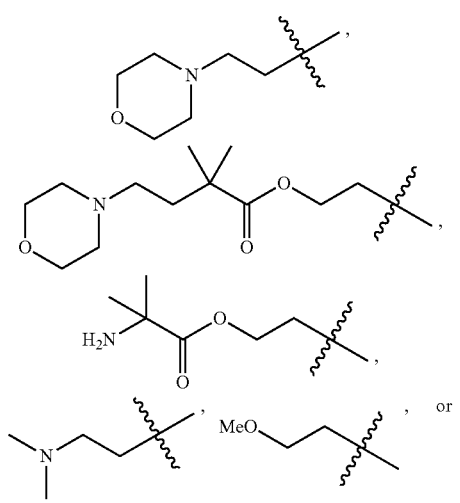
X is —S—, W is O, Y is —O—, and Z is —O—.
In some embodiments, R¹ is
or —S—(C₁-C₁₀ aliphatic).
In some embodiments, R¹ is 427
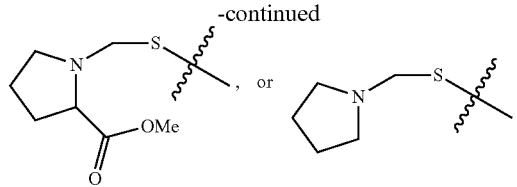
In some embodiments, X is —O— or —S—, and $R^1$ is
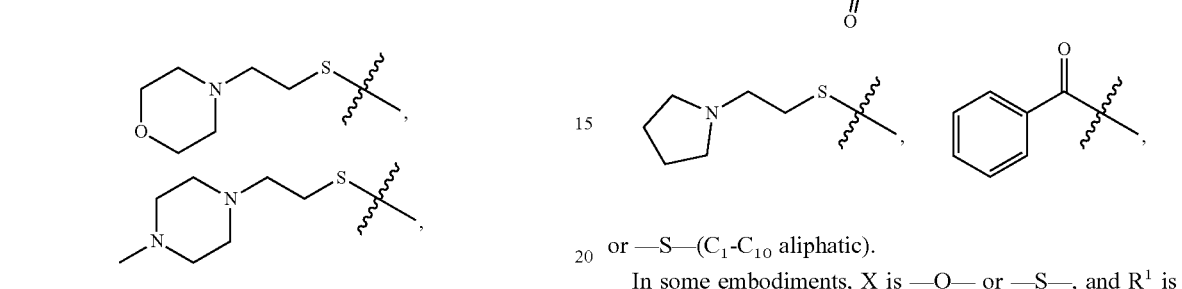
or —S—($C_1$-$C_{10}$ aliphatic).
428
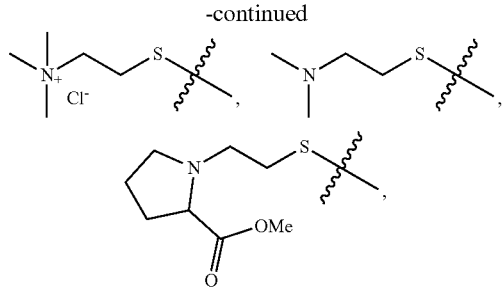
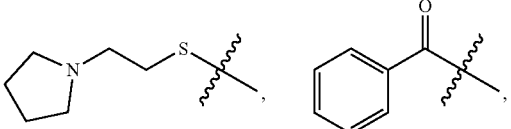
or —S—($C_1$-$C_{10}$ aliphatic).
In some embodiments, X is —O— or —S—, and $R^1$ is
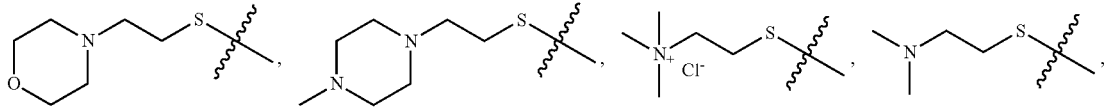
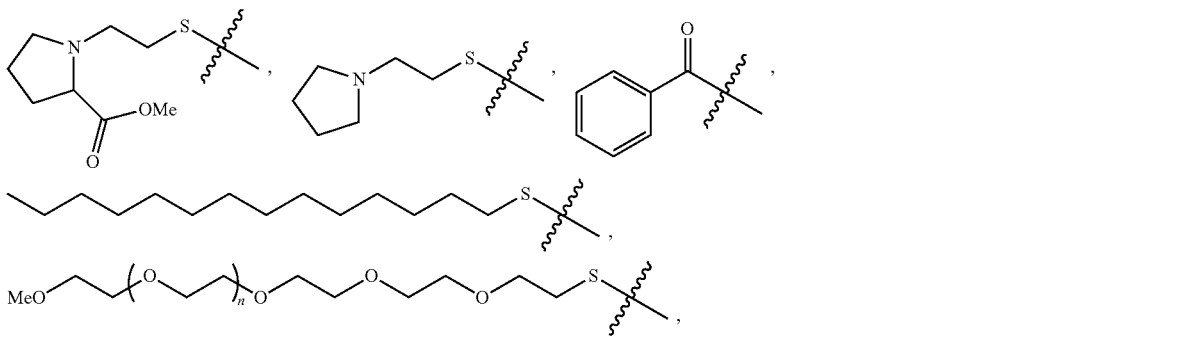
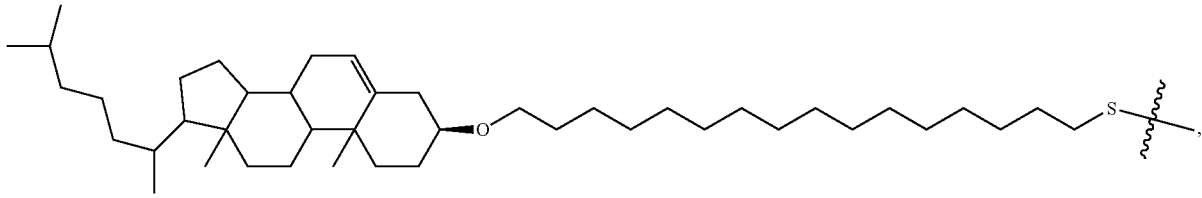
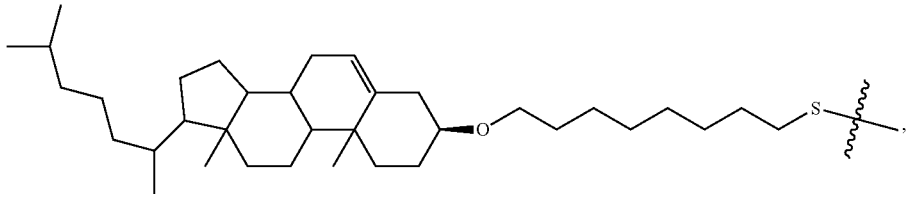
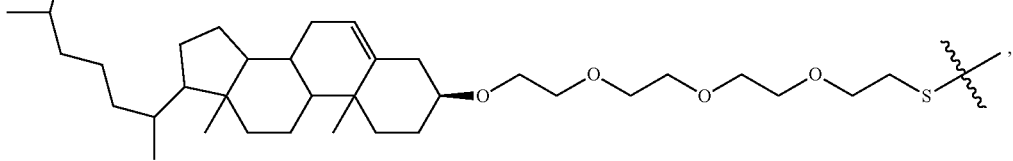
or —S—($C_1$-$C_{50}$ aliphatic).

In some embodiments, L is a covalent bond and -L-R¹ is R¹.
In some embodiments, -L-R¹ is not hydrogen.
In some embodiments, —X-L-R¹ is R¹ is
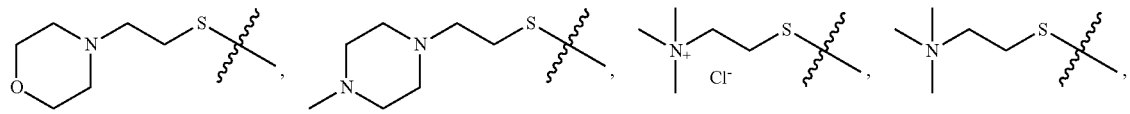
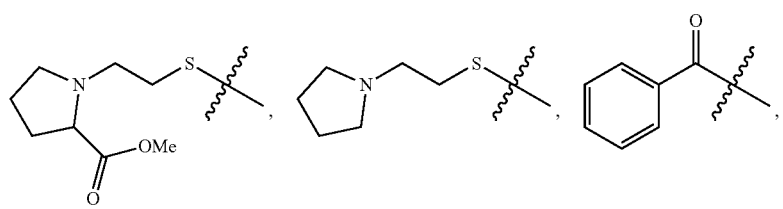
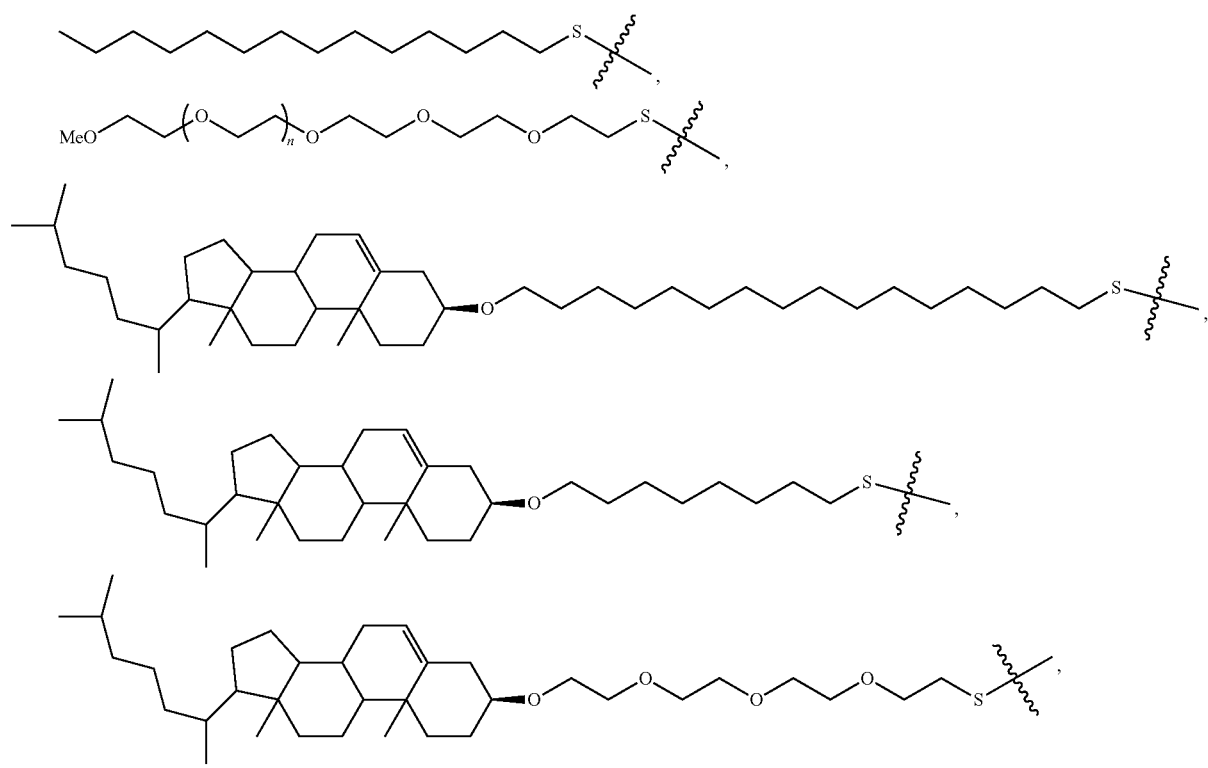
—S—(C$_1$-C$_{10}$ aliphatic) or —S—(C$_1$-C$_{50}$ aliphatic).
In some embodiments, —X-L-R¹ has the structure of
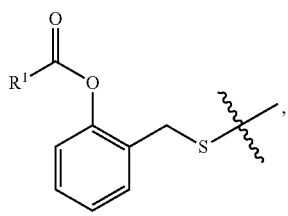
wherein the
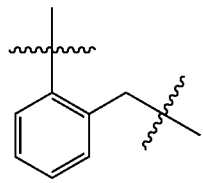 [SMILES: *Cc1ccccc1*]

moiety is optionally substituted. In some embodiments, —X-L-R¹ is

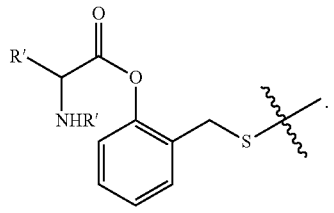

In some embodiments, —X-L-R¹ is

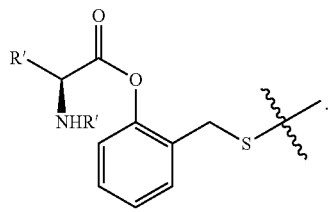

In some embodiments, —X-L-R¹ is

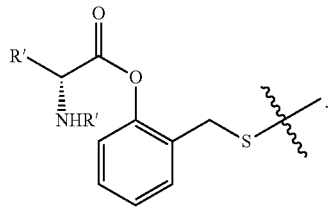

In some embodiments, —X-L-R¹ has the structure of

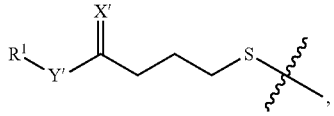

wherein X' is O or S, Y' is —O—, —S— or —NR'—, and the

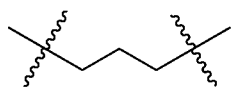 [SMILES: *CCC*]

moiety is optionally substituted. In some embodiments, Y' is —O—, —S— or —NH—. In some embodiments,

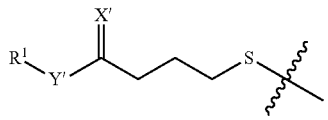

is

-continued

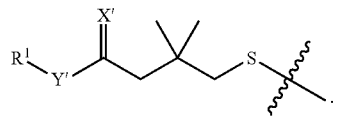

In some embodiments,

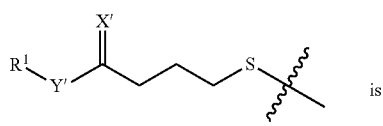

is

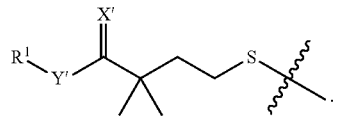

In some embodiments

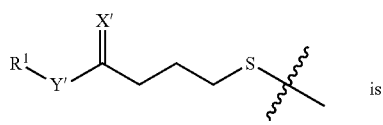

is

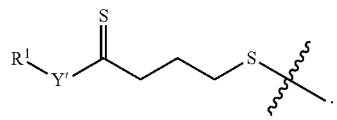

In some embodiments, —X-L-R¹ has the structure of

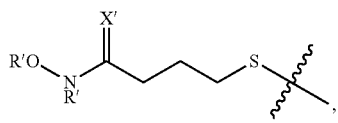

wherein X' is O or S, and the

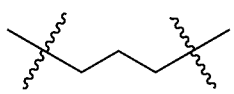 [SMILES: *CCC*]

moiety is optionally substituted. In some embodiments,

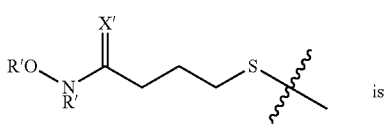

is

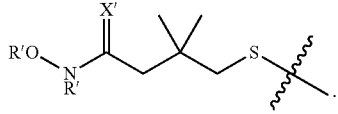

In some embodiments, —X-L-R¹ is

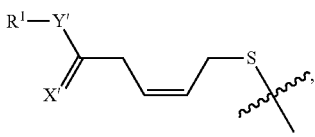

wherein the

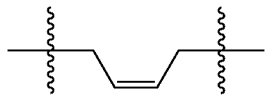 [SMILES: *C/C=C\C*]

is optionally substituted. In some embodiments, —X-L-R¹ is

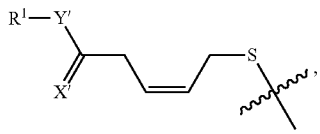

wherein the

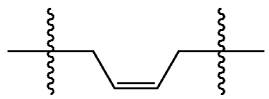

is substituted. In some embodiments, —X-L-R¹ is

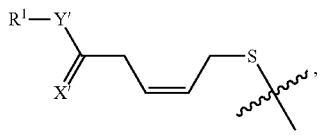

wherein the

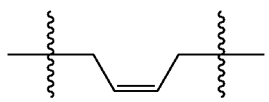

is unsubstituted.

In some embodiments, —X-L-R¹ is R¹—C(O)—S-L$^x$-S—, wherein L$^x$ is an optionally substituted group selected from

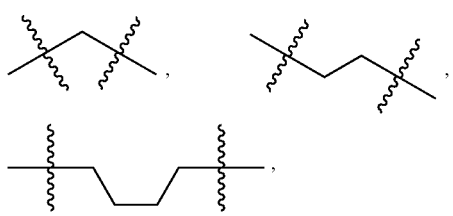

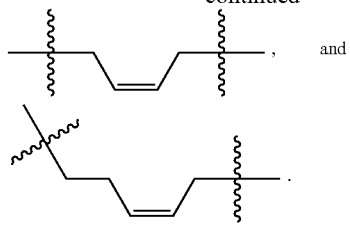

In some embodiments, L$^x$ is

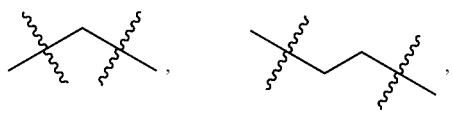

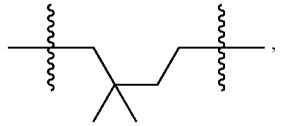

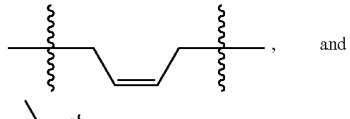

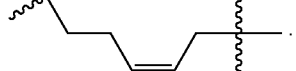

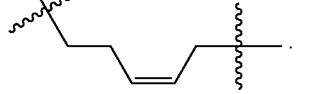

In some embodiments, —X-L-R¹ is (CH$_3$)$_3$C—S—S-L$^x$-S—. In some embodiments, —X-L-R¹ is R¹—C(=X')—Y'—C(R)$_2$—S-L$^x$-S—. In some embodiments, —X-L-R¹ is R—C(=X')—Y'—CH$_2$—S-L$^x$-S—. In some embodiments, —X-L-R¹ is

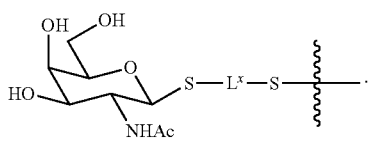

As will be appreciated by a person skilled in the art, many of the —X-L-R¹ groups described herein are cleavable and can be converted to —X⁻ after administration to a subject. In some embodiments, —X-L-R¹ is cleavable. In some embodiments, —X-L-R¹ is —S-L-R¹, and is converted to —S⁻ after administration to a subject. In some embodiments, the conversion is promoted by an enzyme of a subject. As appreciated by a person skilled in the art, methods of determining whether the —S-L-R¹ group is converted to —S⁻ after administration is widely known and practiced in the art, including those used for studying drug metabolism and pharmacokinetics.

In some embodiments, the internucleotidic linkage having the structure of formula I is

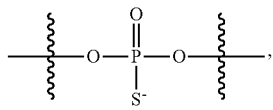

-continued

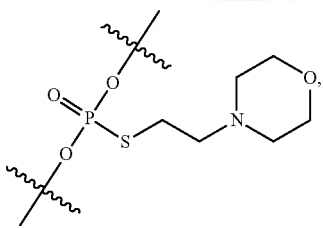

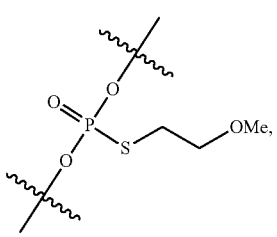

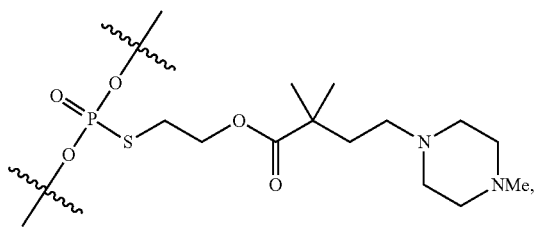

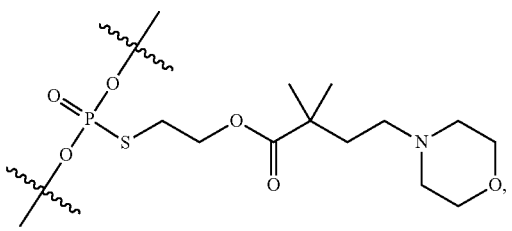

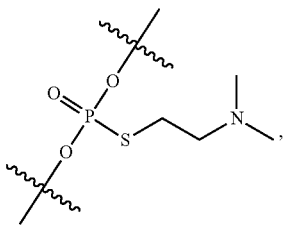

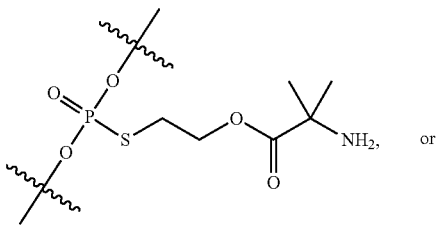 or

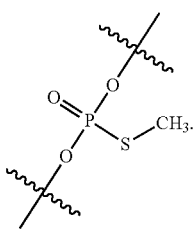

In some embodiments, the internucleotidic linkage of formula I has the structure of formula I-a:

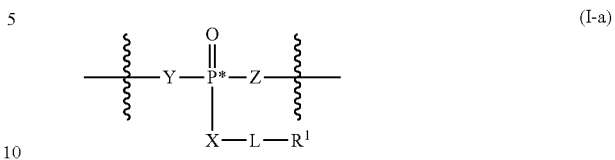

(I-a)

wherein each variable is independently as defined above and described herein.

In some embodiments, the internucleotidic linkage of formula I has the structure of formula I-b:

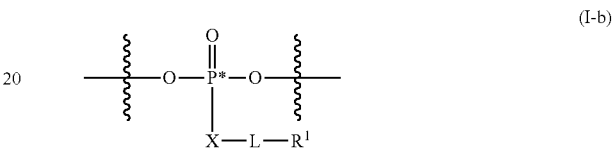

(I-b)

wherein each variable is independently as defined above and described herein.

In some embodiments, the internucleotidic linkage of formula I is an phosphorothioate triester linkage having the structure of formula I-c:

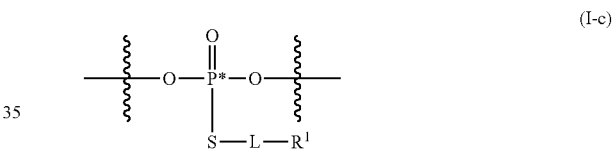

(I-c)

wherein:
P* is an asymmetric phosphorus atom and is either Rp or Sp;
L is a covalent bond or an optionally substituted, linear or branched $C_1$-$C_{10}$ alkylene, wherein one or more methylene units of L are optionally and independently replaced by an optionally substituted $C_1$-$C_6$ alkylene, $C_1$-$C_6$ alkenylene, —C≡C—, —C(R')$_2$—, -Cy-, —O—, —S—, —S—S—, N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, or —C(O)O—;
$R^1$ is halogen, R, or an optionally substituted $C_1$-$C_{50}$ aliphatic wherein one or more methylene units are optionally and independently replaced by an optionally substituted $C_1$-$C_6$ alkylene, $C_1$-$C_6$ alkenylene, —C≡C—, —C(R')$_2$, -Cy-, —O—, —S—, —S—S—, —C(O)N(R')—, —N(R') C(O)N(R')—, —N(R')C(O)—, —N(R')C(O)O—, —OC (O)N(R')—, —S(O)—, —S(O)$_2$—, —S(O)$_2$N(R')—, —N(V)S(O)$_2$—, —SC(O)—, —C(O)S—, —OC(O)—, or —C(O)O—;
each R' is independently —R, —C(O)R, —CO$_2$R, or —SO$_2$R, or:
two R' on the same nitrogen are taken together with their intervening atoms to form an optionally substituted heterocyclic or heteroaryl ring, or
two R' on the same carbon are taken together with their intervening atoms to form an optionally substituted aryl, carbocyclic, heterocyclic, or heteroaryl ring;
-Cy- is an optionally substituted bivalent ring selected from phenylene, carbocyclylene, arylene, heteroarylene, and heterocyclylene;

each R is independently hydrogen, or an optionally substituted group selected from $C_1$-$C_6$ aliphatic, phenyl, carbocyclyl, aryl, heteroaryl, and heterocyclyl;
each
independently represents a connection to a nucleoside; and $R^1$ is not —H when L is a covalent bond.
In some embodiments, the internucleotidic linkage having the structure of formula I is
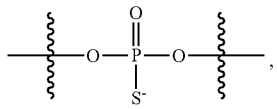
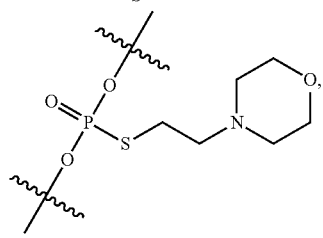
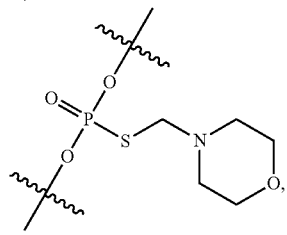
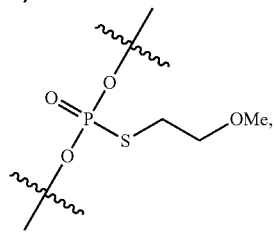
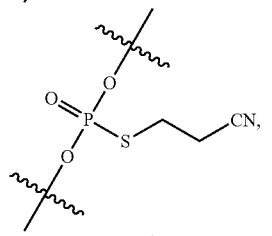
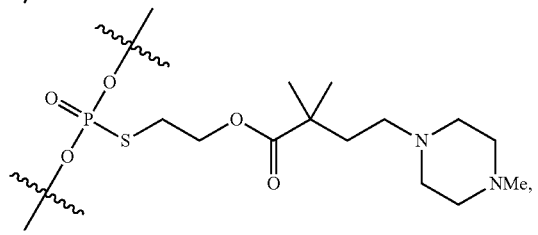
-continued
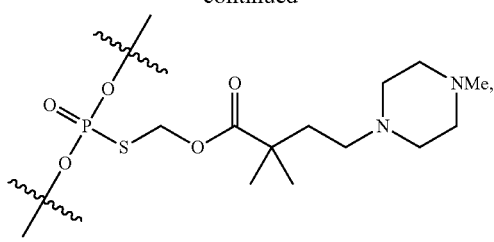
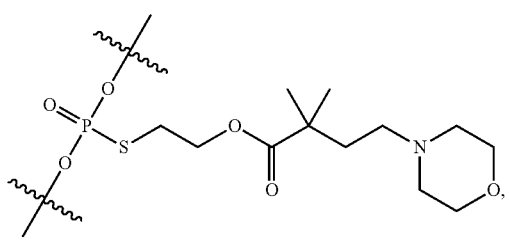
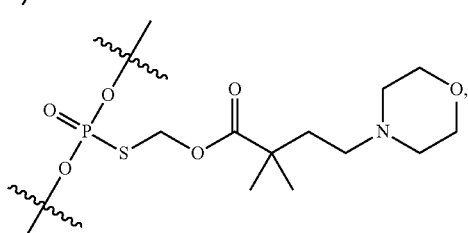
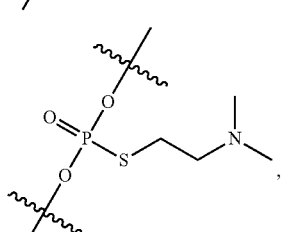
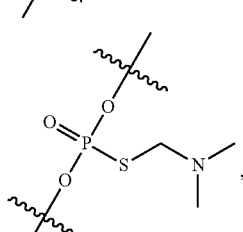
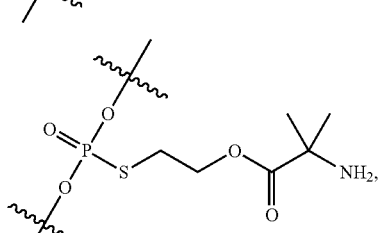
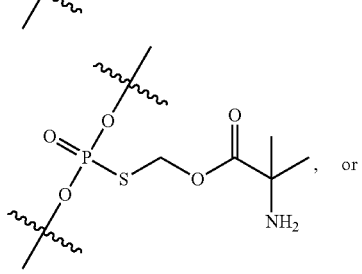, or

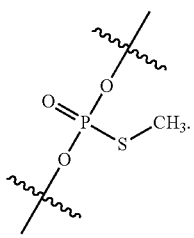
In some embodiments, the internucleotidic linkage having the structure of formula I-c is
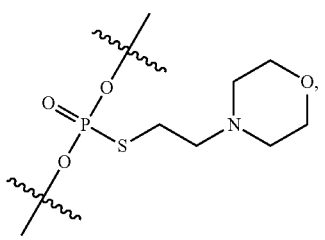
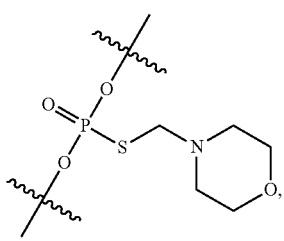
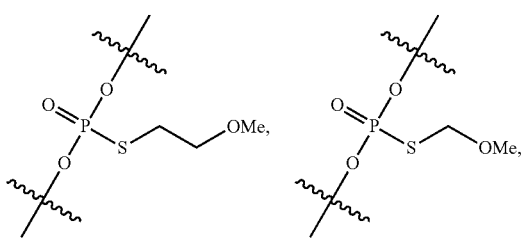
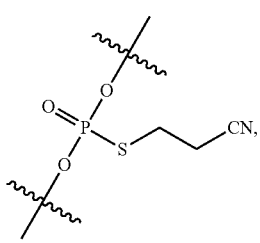
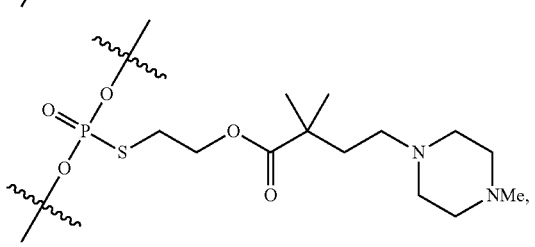
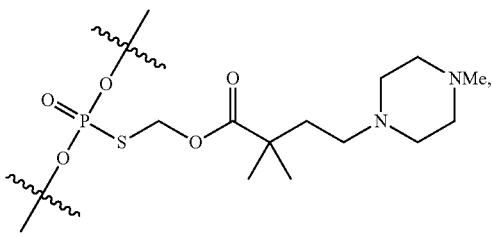
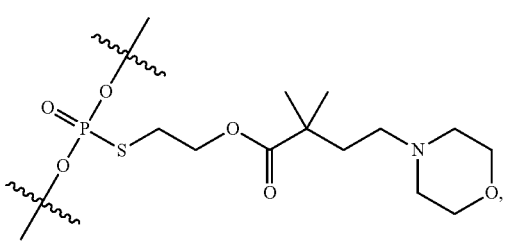
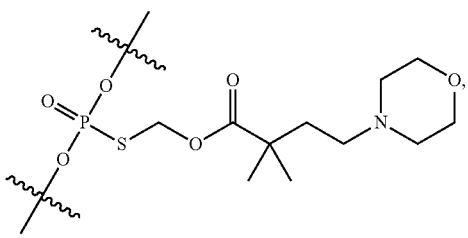
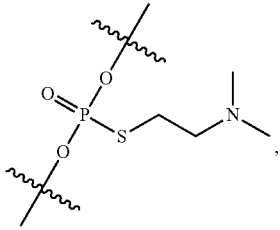
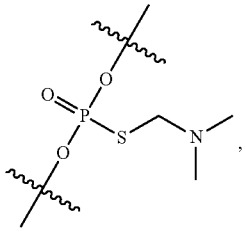
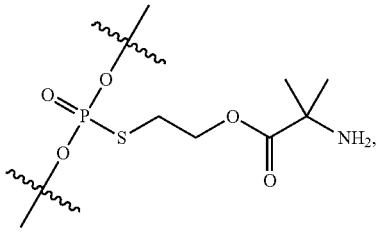
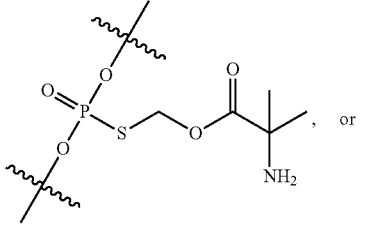, or -continued

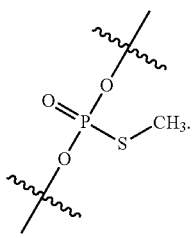

In some embodiments, the present disclosure provides a chirally controlled oligonucleotide comprising one or more phosphate diester linkages, and one or more modified internucleotide linkages having the formula of I-a, I-b, or I-c.

In some embodiments, the present disclosure provides a chirally controlled oligonucleotide comprising at least one phosphate diester internucleotidic linkage and at least one phosphorothioate triester linkage having the structure of formula I-c. In some embodiments, the present disclosure provides a chirally controlled oligonucleotide comprising at least one phosphate diester internucleotidic linkage and at least two phosphorothioate triester linkages having the structure of formula I-c. In some embodiments, the present disclosure provides a chirally controlled oligonucleotide comprising at least one phosphate diester internucleotidic linkage and at least three phosphorothioate triester linkages having the structure of formula I-c. In some embodiments, the present disclosure provides a chirally controlled oligonucleotide comprising at least one phosphate diester internucleotidic linkage and at least four phosphorothioate triester linkages having the structure of formula I-c. In some embodiments, the present disclosure provides a chirally controlled oligonucleotide comprising at least one phosphate diester internucleotidic linkage and at least five phosphorothioate triester linkages having the structure of formula I-c. In some embodiments, —X-L-R$^1$ is —R. In some embodiments, R is —CH$_3$. In some embodiments, R is —CH$_2$CH$_3$. In some embodiments, R is —CH$_2$CH$_2$CH$_3$. In some embodiments, R is —CH$_2$OCH$_3$. In some embodiments, R is CH$_3$CH$_2$OCH$_2$—. In some embodiments, R is PhCH$_2$OCH$_2$—. In some embodiments, R is HC≡C—CH$_2$—. In some embodiments, R is H$_3$C—C≡C—CH$_2$—. In some embodiments, R is CH$_2$=CHCH$_2$—. In some embodiments, R is CH$_3$SCH$_2$—. In some embodiments, R is —CH$_2$COOCH$_3$. In some embodiments, R is —CH$_2$COOCH$_2$CH$_3$. In some embodiments, R is —CH$_2$CONHCH$_3$.

In some embodiments, —X-L-R$^1$ is comprises a guanidine moiety. In some embodiments, —X-L-R$^1$ is or comprises

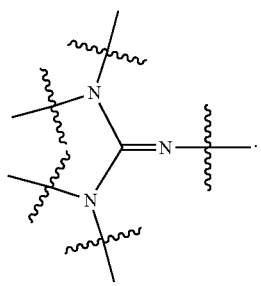 [SMILES: *N=C(N(*)*)N(*)*]

In some embodiments, —X-L-R$^1$ is -L-W$^z$, wherein W$^z$ is selected from

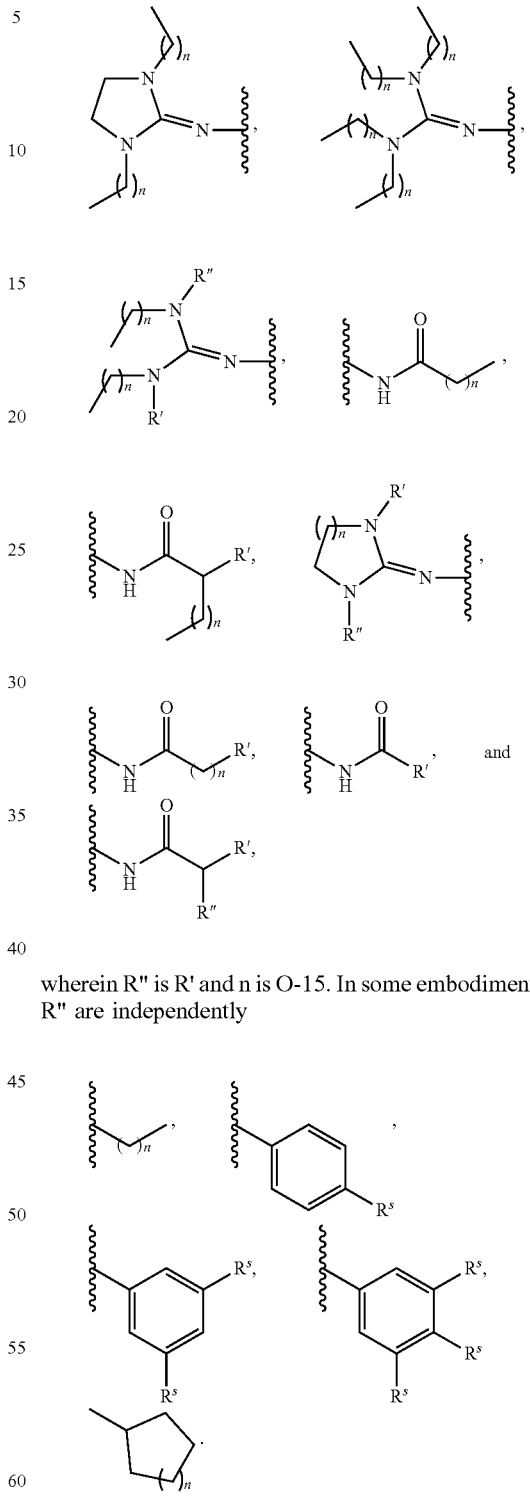

wherein R" is R' and n is 0-15. In some embodiments, R' and R" are independently

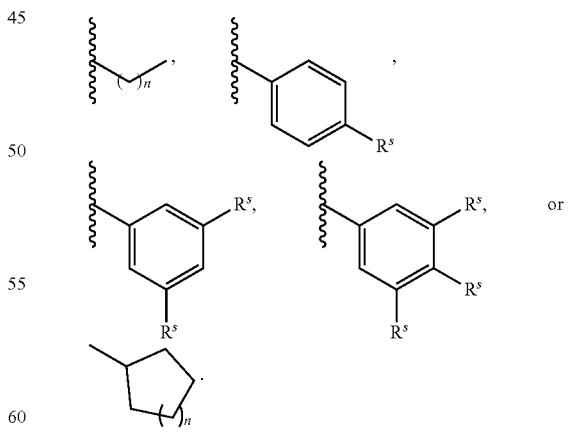

In some embodiments, L is —O—CH$_2$CH$_2$—. In some embodiments, n is 0-3. In some embodiments, each R$^s$ is independently —H, —OCH$_3$, —F, —CN, —CH$_3$, —NO$_2$, —CF$_3$, or -OCF$_3$. In some embodiments, R' and R" are the same. In some embodiments, R' and R" are different.

In some embodiments, In some embodiments, —X-L-R¹

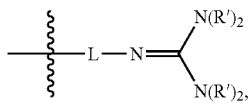

wherein each R' is independently as described in the present disclosure. In some embodiments, two R' on two different nitrogen atoms are taken together to form an optionally substituted ring as described in the present disclosure. In some embodiments, a ring is saturated. In some embodiments, a ring is monocyclic. In some embodiments, a ring is 3-10 membered. In some embodiments, a ring is 3-membered. In some embodiments, a ring is 4-membered. In some embodiments, a ring is 5-membered. In some embodiments, a ring is 6-membered. In some embodiments, a ring is 7-membered. In some embodiments, a ring has no additional ring heteroatoms in addition to the two nitrogen atoms.

In some embodiments, —X-L-R¹ is optionally substituted alkynyl. In some embodiments, —X-L-R¹ is —C≡CH. In some embodiments, an alkynyl group, e.g., —C≡CH, can react with a number of reagents through various reactions to provide further modifications. For example, in some embodiments, an alkynyl group can react with azides through click chemistry. In some embodiments, an azide has the structure of R¹—N₃.

In some embodiments, Z is O. In some embodiments, Z is S. In some embodiments, Z is —N(-L-R¹)—. In some embodiments, Z is L as described in the present disclosure.

In some embodiments, Y is O and Z is O. In some embodiments, Y is O, Z is O, and X is S. In some embodiments, P$^L$ is P(=W), Y is O, Z is O, and X is S. In some embodiments, P$^L$ is P(=W), Y is O, Z is O, and X is S. In some embodiments, P$^L$ is P(=O), Y is O, Z is O, and X is S. In some embodiments, P$^L$ is P(=S), Y is O, Z is O, and X is O.

In some embodiments, a is 1-1000. In some embodiments, a is 1-200. In some embodiments, a is 1-100. In some embodiments, a is 1-90. In some embodiments, a is 1-80. In some embodiments, a is 1-70. In some embodiments, a is 1-60. In some embodiments, a is 1-50. In some embodiments, a is 1-40. In some embodiments, a is 1-35. In some embodiments, a is 1-30. In some embodiments, a is 1-29. In some embodiments, a is 1-28. In some embodiments, a is 1-27. In some embodiments, a is 1-26. In some embodiments, a is 1-25. In some embodiments, a is 1-24. In some embodiments, a is 1-23. In some embodiments, a is 1-22. In some embodiments, a is 1-21. In some embodiments, a is 1-20. In some embodiments, a is 1-19. In some embodiments, a is 1-18. In some embodiments, a is 1-17. In some embodiments, a is 1-16. In some embodiments, a is 1-15. In some embodiments, a is 1-14. In some embodiments, a is 1-13. In some embodiments, a is 1-12. In some embodiments, a is 1-11. In some embodiments, a is 1-10. In some embodiments, a is 1-9. In some embodiments, a is 1-8. In some embodiments, a is 1-7. In some embodiments, a is 1-6. In some embodiments, a is 1-5. In some embodiments, a is 1-4. In some embodiments, a is 1-3. In some embodiments, a is 1-2. In some embodiments, a is 4-30. In some embodiments, a is 4-29. In some embodiments, a is 4-28. In some embodiments, a is 4-27. In some embodiments, a is 4-26. In some embodiments, a is 4-25. In some embodiments, a is 4-24. In some embodiments, a is 4-23. In some embodiments, a is 4-22. In some embodiments, a is 4-21. In some embodiments, a is 4-20. In some embodiments, a is 4-19. In some embodiments, a is 4-18. In some embodiments, a is 4-17. In some embodiments, a is 4-16. In some embodiments, a is 4-15. In some embodiments, a is 4-14. In some embodiments, a is 9-30. In some embodiments, a is 9-29. In some embodiments, a is 9-28. In some embodiments, a is 9-27. In some embodiments, a is 9-26. In some embodiments, a is 9-25. In some embodiments, a is 9-24. In some embodiments, a is 9-23. In some embodiments, a is 9-22. In some embodiments, a is 9-21. In some embodiments, a is 9-20. In some embodiments, a is 9-19. In some embodiments, a is 9-18. In some embodiments, a is 9-17. In some embodiments, a is 9-16. In some embodiments, a is 9-15. In some embodiments, a is 9-14. In some embodiments, a is 14-30. In some embodiments, a is 14-29. In some embodiments, a is 14-28. In some embodiments, a is 14-27. In some embodiments, a is 14-26. In some embodiments, a is 14-25. In some embodiments, a is 14-24. In some embodiments, a is 14-23. In some embodiments, a is 14-22. In some embodiments, a is 14-21. In some embodiments, a is 14-20. In some embodiments, a is 14-19. In some embodiments, a is 14-18. In some embodiments, a is 14-17. In some embodiments, a is 14-16. In some embodiments, a is 14-15.

In some embodiments, a is 1. In some embodiments, a is 2. In some embodiments, a is 3. In some embodiments, a is 4. In some embodiments, a is 5. In some embodiments, a is 6. In some embodiments, a is 7. In some embodiments, a is 8. In some embodiments, a is 9. In some embodiments, a is 10. In some embodiments, a is 11, 12, 13, 14, 15, 16, 17, 18, 19, 20, 21, 22, 23, 24, 25, 26, 27, 28, 29 or 30. In some embodiments, a is at least 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30. In some embodiments, a is at least 10 to 30.

In some embodiments, b is 1-1000. In some embodiments, b is 1-200. In some embodiments, b is 1-100. In some embodiments, b is 1-90. In some embodiments, b is 1-80. In some embodiments, b is 1-70. In some embodiments, b is 1-60. In some embodiments, b is 1-50. In some embodiments, b is 1-40. In some embodiments, b is 1-35. In some embodiments, b is 1-30. In some embodiments, b is 1-29. In some embodiments, b is 1-28. In some embodiments, b is 1-27. In some embodiments, b is 1-26. In some embodiments, b is 1-25. In some embodiments, b is 1-24. In some embodiments, b is 1-23. In some embodiments, b is 1-22. In some embodiments, b is 1-21. In some embodiments, b is 1-20.

In some embodiments, b is 1. In some embodiments, b is 2. In some embodiments, b is 3. In some embodiments, b is 4. In some embodiments, b is 5. In some embodiments, b is 6. In some embodiments, b is 7. In some embodiments, b is 8. In some embodiments, b is 9. In some embodiments, b is 10. In some embodiments, b is 11, 12, 13, 14, 15, 16, 17, 18, 19, 20, 21, 22, 23, 24, 25, 26, 27, 28, 29 or 30. In some embodiments, b is 10 to 30. In some embodiments, b is at least 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30. In some embodiments, b is at least 5. In some embodiments, b is at least 10. In some embodiments, b is at least 15. In some embodiments, b is at least 20.

In some embodiments, z is 1-1000. In some embodiments, z is 1-200. In some embodiments, z is 1-100. In some embodiments, z is 1-90. In some embodiments, z is 1-80. In some embodiments, z is 1-70. In some embodiments, z is 1-60. In some embodiments, z is 1-50. In some embodiments, z is 1-40. In some embodiments, z is 1-35. In some embodiments, z is 1-30. In some embodiments, z is 1-29. In some embodiments, z is 1-28. In some embodiments, z is 1-27. In some embodiments, z is 1-26. In some embodiments, z is 1-25. In some embodiments, z is 1-24. In some embodiments, z is 1-23. In some embodiments, z is 1-22. In some embodiments, z is 1-21. In some embodiments, z is 1-20. In some embodiments, z is 1-19. In some embodiments, z is 1-18. In some embodiments, z is 1-17. In some embodiments, z is 1-16. In some embodiments, z is 1-15. In some embodiments, z is 1-14. In some embodiments, z is 1-13. In some embodiments, z is 1-12. In some embodiments, z is 1-11. In some embodiments, z is 1-10. In some embodiments, z is 4-30. In some embodiments, z is 4-29. In some embodiments, z is 4-28. In some embodiments, z is 4-27. In some embodiments, z is 4-26. In some embodiments, z is 4-25. In some embodiments, z is 4-24. In some embodiments, z is 4-23. In some embodiments, z is 4-22. In some embodiments, z is 4-21. In some embodiments, z is 4-20. In some embodiments, z is 4-19. In some embodiments, z is 4-18. In some embodiments, z is 4-17. In some embodiments, z is 4-16. In some embodiments, z is 4-15. In some embodiments, z is 4-14. In some embodiments, z is 9-30. In some embodiments, z is 9-29. In some embodiments, z is 9-28. In some embodiments, z is 9-27. In some embodiments, z is 9-26. In some embodiments, z is 9-25. In some embodiments, z is 9-24. In some embodiments, z is 9-23. In some embodiments, z is 9-22. In some embodiments, z is 9-21. In some embodiments, z is 9-20. In some embodiments, z is 9-19. In some embodiments, z is 9-18. In some embodiments, z is 9-17. In some embodiments, z is 9-16. In some embodiments, z is 9-15. In some embodiments, z is 9-14. In some embodiments, z is 14-30. In some embodiments, z is 14-29. In some embodiments, z is 14-28. In some embodiments, z is 14-27. In some embodiments, z is 14-26. In some embodiments, z is 14-25. In some embodiments, z is 14-24. In some embodiments, z is 14-23. In some embodiments, z is 14-22. In some embodiments, z is 14-21. In some embodiments, z is 14-20. In some embodiments, z is 14-19. In some embodiments, z is 14-18. In some embodiments, z is 14-17. In some embodiments, z is 14-16. In some embodiments, z is 14-15.

In some embodiments, z is 1. In some embodiments, z is 2. In some embodiments, z is 3. In some embodiments, z is 4. In some embodiments, z is 5. In some embodiments, z is 6. In some embodiments, z is 7. In some embodiments, z is 8. In some embodiments, z is 9. In some embodiments, z is 10. In some embodiments, z is 11. In some embodiments, z is 12. In some embodiments, z is 13. In some embodiments, z is 14. In some embodiments, z is 15. In some embodiments, z is 16. In some embodiments, z is 17. In some embodiments, z is 18. In some embodiments, z is 19. In some embodiments, z is 20. In some embodiments, z is 21. In some embodiments, z is 22. In some embodiments, z is 23. In some embodiments, z is 24. In some embodiments, z is 25. In some embodiments, z is 26. In some embodiments, z is 27. In some embodiments, z is 28. In some embodiments, z is 29. In some embodiments, z is 30. In some embodiments, z is at least 2. In some embodiments, z is at least 3. In some embodiments, z is at least 4. In some embodiments, z is at least 5. In some embodiments, z is at least 6. In some embodiments, z is at least 7. In some embodiments, z is at least 8. In some embodiments, z is at least 9. In some embodiments, z is at least 10. In some embodiments, z is at least 11. In some embodiments, z is at least 12. In some embodiments, z is at least 13. In some embodiments, z is at least 14. In some embodiments, z is at least 15. In some embodiments, z is at least 16. In some embodiments, z is at least 17. In some embodiments, z is at least 18. In some embodiments, z is at least 19. In some embodiments, z is at least 20. In some embodiments, z is at least 21. In some embodiments, z is at least 22. In some embodiments, z is at least 23. In some embodiments, z is at least 24. In some embodiments, z is at least 25. In some embodiments, z is at least 26. In some embodiments, z is at least 27. In some embodiments, z is at least 28. In some embodiments, z is at least 29. In some embodiments, z is at least 30.

In some embodiments, a is 1 and b is 1. In some embodiments, a is 1 and b is greater than 1. In some embodiments, b is 1 and a is greater than 1.

In some embodiments, $L^{3E}$ is -L-. In some embodiments, $L^{3E}$ is -L-L-. In some embodiments, $L^{3E}$ is a covalent bond. In some embodiments, $L^{3E}$ is —O—.

In some embodiments, $R^{3E}$ is -R'. In some embodiments, $R^{3E}$ is -L-R'. In some embodiments, $R^{3E}$ is —OR'. In some embodiments, $R^{3E}$ is a solid support.

In some embodiments, $R^{3E}$ is —H. In some embodiments, $-L^3-R^{3E}$ is —H. In some embodiments, $-L^3-R^{3E}$ is —OH.

In some embodiments, $R^{3E}$ is optionally substituted $C_{1-6}$ aliphatic. In some embodiments, $R^{3E}$ is optionally substituted $C_{1-6}$ alkyl.

In some embodiments, $R^{3E}$ is —OR'. In some embodiments, $R^{3E}$ is —OH. In some embodiments, $R^{3E}$ is —OR', wherein R' is not hydrogen. In some embodiments, $R^{3E}$ is —OR', wherein R' is optionally substituted $C_{1-6}$ alkyl.

In some embodiments, $R^{3E}$ is a 3'-end cap as described in the present disclosure. In some embodiments, $R^{3E}$ is $(CAP)_{zz}$.

In some embodiments, $R^{3E}$ is a solid support. In some embodiments, $R^{3E}$ is a solid support for oligonucleotide synthesis. In some embodiments, $R^{3E}$ is for delivery.

In some embodiments, R' is —R. In some embodiments, R' is —C(O)R. In some embodiments, R' is —CO$_2$R. In some embodiments, R' is —SO$_2$R. In some embodiments, two or more R' are taken together with their intervening atoms to form an optionally substituted monocyclic, bicyclic or polycyclic, saturated, partially unsaturated, or aryl 3-30 membered ring having, in addition to the intervening atoms, 0-10 heteroatoms independently selected from oxygen, nitrogen, sulfur, phosphorus and silicon. In some embodiments, R' is hydrogen. In some embodiments, R' is not hydrogen.

In some embodiments, each R is independently —H, or an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon, or two R groups are optionally and independently taken together to form a covalent bond, or:

two or more R groups on the same atom are optionally and independently taken together with the atom to form an optionally substituted, 3-30 membered monocyclic, bicyclic or polycyclic ring having, in addition to the atom, 0-10 heteroatoms independently selected from oxygen, nitrogen, sulfur, phosphorus and silicon; or two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms independently selected from oxygen, nitrogen, sulfur, phosphorus and silicon.

In some embodiments, each R is independently —H, or an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon, or two R groups are optionally and independently taken together to form a covalent bond, or:

two or more R groups on the same atom are optionally and independently taken together with the atom to form an optionally substituted, 3-30 membered monocyclic, bicyclic or polycyclic ring having, in addition to the atom, 0-10 heteroatoms independently selected from oxygen, nitrogen, sulfur, phosphorus and silicon.

two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms independently selected from oxygen, nitrogen, sulfur, phosphorus and silicon.

In some embodiments, each R is independently —H, or an optionally substituted group selected from $C_{1-20}$ aliphatic, $C_{1-20}$ heteroaliphatic having 1-10 heteroatoms independently selected from oxygen, nitrogen, sulfur, phosphorus and silicon, $C_{6-20}$ aryl, $C_{6-20}$ arylaliphatic, $C_{6-20}$ arylheteroaliphatic having 1-10 heteroatoms independently selected from oxygen, nitrogen, sulfur, phosphorus and silicon, 5-20 membered heteroaryl having 1-10 heteroatoms independently selected from oxygen, nitrogen, sulfur, phosphorus and silicon, and 3-20 membered heterocyclyl having 1-10 heteroatoms independently selected from oxygen, nitrogen, sulfur, phosphorus and silicon, or two R groups are optionally and independently taken together to form a covalent bond, or:

two or more R groups on the same atom are optionally and independently taken together with the atom to form an optionally substituted, 3-20 membered monocyclic, bicyclic or polycyclic ring having, in addition to the atom, 0-10 heteroatoms independently selected from oxygen, nitrogen, sulfur, phosphorus and silicon.

two or more R groups on two or more atoms are optionally and independently taken together with their intervening atoms to form an optionally substituted, 3-20 membered monocyclic, bicyclic or polycyclic ring having, in addition to the intervening atoms, 0-10 heteroatoms independently selected from oxygen, nitrogen, sulfur, phosphorus and silicon.

In some embodiments, each R is independently —H, or an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon.

In some embodiments, each R is independently —H, or an optionally substituted group selected from $C_{1-20}$ aliphatic, $C_{1-20}$ heteroaliphatic having 1-10 heteroatoms independently selected from oxygen, nitrogen, sulfur, phosphorus and silicon, $C_{6-20}$ aryl, $C_{6-20}$ arylaliphatic, $C_{6-20}$ arylheteroaliphatic having 1-10 heteroatoms independently selected from oxygen, nitrogen, sulfur, phosphorus and silicon, 5-20 membered heteroaryl having 1-10 heteroatoms independently selected from oxygen, nitrogen, sulfur, phosphorus and silicon, and 3-20 membered heterocyclyl having 1-10 heteroatoms independently selected from oxygen, nitrogen, sulfur, phosphorus and silicon.

In some embodiments, R is hydrogen. In some embodiments, R is not hydrogen. In some embodiments, R is an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, a 5-30 membered heteroaryl ring having 1-10 heteroatoms independently selected from oxygen, nitrogen, sulfur, phosphorus and silicon, and a 3-30 membered heterocyclic ring having 1-10 heteroatoms independently selected from oxygen, nitrogen, sulfur, phosphorus and silicon.

In some embodiments, R is hydrogen or an optionally substituted group selected from $C_{1-20}$ aliphatic, phenyl, a 3-7 membered saturated or partially unsaturated carbocyclic ring, an 8-10 membered bicyclic saturated, partially unsaturated or aryl ring, a 5-6 membered monocyclic heteroaryl ring having 1-4 heteroatoms independently selected from nitrogen, oxygen, and sulfur, a 4-7 membered saturated or partially unsaturated heterocyclic ring having 1-3 heteroatoms independently selected from nitrogen, oxygen, and sulfur, a 7-10 membered bicyclic saturated or partially unsaturated heterocyclic ring having 1-5 heteroatoms independently selected from nitrogen, oxygen, and sulfur, or an 8-10 membered bicyclic heteroaryl ring having 1-5 heteroatoms independently selected from nitrogen, oxygen, and sulfur.

In some embodiments, each R is independently hydrogen, or an optionally substituted group selected from $C_1$-$C_6$ aliphatic, phenyl, carbocyclyl, aryl, heteroaryl, and heterocyclyl.

In some embodiments, R is hydrogen. In some embodiments, R is an optionally substituted group selected from $C_1$-$C_6$ aliphatic, phenyl, carbocyclyl, aryl, heteroaryl, and heterocyclyl.

In some embodiments, R is optionally substituted $C_{1-30}$ aliphatic. In some embodiments, R is optionally substituted $C_{1-20}$ aliphatic. In some embodiments, R is optionally substituted $C_{1-15}$ aliphatic. In some embodiments, R is optionally substituted $C_{1-10}$ aliphatic. In some embodiments, R is optionally substituted $C_{1-6}$ aliphatic. In some embodiments, R is optionally substituted $C_{1-6}$ alkyl. In some embodiments, R is optionally substituted hexyl, pentyl, butyl, propyl, ethyl or methyl. In some embodiments, R is optionally substituted hexyl. In some embodiments, R is optionally substituted pentyl. In some embodiments, R is optionally substituted butyl. In some embodiments, R is optionally substituted propyl. In some embodiments, R is optionally substituted ethyl. In some embodiments, R is optionally substituted methyl. In some embodiments, R is hexyl. In some embodiments, R is pentyl. In some embodiments, R is butyl. In some embodiments, R is propyl. In some embodiments, R is ethyl. In some embodiments, R is methyl. In some embodiments, R is isopropyl. In some embodiments, R is n-propyl.

In some embodiments, R is tert-butyl. In some embodiments, R is sec-butyl. In some embodiments, R is n-butyl.

In some embodiments, R is optionally substituted $C_{3-30}$ cycloaliphatic. In some embodiments, R is optionally substituted $C_{3-20}$ cycloaliphatic. In some embodiments, R is optionally substituted $C_{3-10}$ cycloaliphatic. In some embodiments, R is optionally substituted $C_{3-6}$ cycloaliphatic. In some embodiments, R is optionally substituted $C_{3-10}$ cycloaliphatic. In some embodiments, R is an optionally substituted 3-30 membered saturated or partially unsaturated carbocyclic ring. In some embodiments, R is an optionally substituted 3-7 membered saturated or partially unsaturated carbocyclic ring. In some embodiments, R is an optionally substituted 3-membered saturated or partially unsaturated carbocyclic ring. In some embodiments, R is an optionally substituted 4-membered saturated or partially unsaturated carbocyclic ring. In some embodiments, R is an optionally substituted 5-membered saturated or partially unsaturated carbocyclic ring. In some embodiments, R is an optionally substituted 6-membered saturated or partially unsaturated carbocyclic ring. In some embodiments, R is an optionally substituted 7-membered saturated or partially unsaturated carbocyclic ring. In some embodiments, R is optionally substituted $C_{3-30}$ cycloalkyl. In some embodiments, R is optionally substituted 3, 4, 5, 6, 7, 8, 9, 10, 11, 12, 13, 14, 15, 16, 17, 18, 19, 20-membered cycloalkyl. In some embodiments, R is optionally substituted cycloheptyl. In some embodiments, R is cycloheptyl. In some embodiments, R is optionally substituted cyclohexyl. In some embodiments, R is cyclohexyl. In some embodiments, R is optionally substituted cyclopentyl. In some embodiments, R is cyclopentyl. In some embodiments, R is optionally substituted cyclobutyl. In some embodiments, R is cyclobutyl. In some embodiments, R is optionally substituted cyclopropyl. In some embodiments, R is cyclopropyl.

In some embodiments, when R is or comprises a ring structure, e.g., cycloaliphatic, cycloheteroaliphatic, aryl, heteroaryl, etc., the ring structure can be monocyclic, bicyclic or polycyclic. In some embodiments, R is or comprises a monocyclic structure. In some embodiments, R is or comprises a bicyclic structure. In some embodiments, R is or comprises a polycyclic structure.

In some embodiments, R is $C_{1-30}$ heteroaliphatic having 1-10 heteroatoms independently selected from oxygen, nitrogen, sulfur, phosphorus and silicon. In some embodiments, R is $C_{1-20}$ heteroaliphatic having 1-10 heteroatoms. In some embodiments, R is $C_{1-20}$ heteroaliphatic having 1-10 heteroatoms independently selected from oxygen, nitrogen, sulfur, phosphorus and silicon, optionally including one or more oxidized forms of nitrogen, sulfur, or phosphorus. In some embodiments, R is $C_{1-6}$ heteroaliphatic having 1-10 heteroatoms. In some embodiments, R is $C_{1-30}$ heteroaliphatic comprising 1-10 groups independently selected from

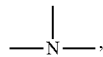

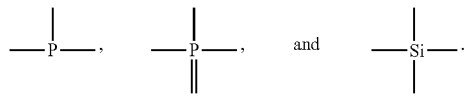

In some embodiments, R is optionally substituted phenyl. In some embodiments, R is substituted phenyl. In some embodiments, R is phenyl.

In some embodiments, R is optionally substituted $C_{6-30}$ aryl. In some embodiments, R is optionally substituted phenyl. In some embodiments, R is phenyl. In some embodiments, R is substituted phenyl. In some embodiments, R is optionally substituted bicyclic or polycyclic aryl.

In some embodiments, R is an optionally substituted 8-10 membered bicyclic saturated, partially unsaturated or aryl ring. In some embodiments, R is an optionally substituted 8-10 membered bicyclic saturated ring. In some embodiments, R is an optionally substituted 8-10 membered bicyclic partially unsaturated ring. In some embodiments, R is an optionally substituted 8-10 membered bicyclic aryl ring. In some embodiments, R is optionally substituted naphthyl.

In some embodiments, R is optionally substituted 5-30 membered heteroaryl ring having 1-10 heteroatoms independently selected from oxygen, nitrogen, sulfur, phosphorus and silicon. In some embodiments, R is optionally substituted 5-30 membered heteroaryl ring having 1-10 heteroatoms independently selected from oxygen, nitrogen, and sulfur. In some embodiments, R is optionally substituted 5-30 membered heteroaryl ring having 1-5 heteroatoms independently selected from oxygen, nitrogen, sulfur, phosphorus and silicon. In some embodiments, R is optionally substituted 5-30 membered heteroaryl ring having 1-5 heteroatoms independently selected from oxygen, nitrogen, and sulfur.

In some embodiments, R is an optionally substituted 5-6 membered monocyclic heteroaryl ring having 1-4 heteroatoms independently selected from nitrogen, oxygen, and sulfur. In some embodiments, R is a substituted 5-6 membered monocyclic heteroaryl ring having 1-4 heteroatoms independently selected from nitrogen, oxygen, and sulfur. In some embodiments, R is an unsubstituted 5-6 membered monocyclic heteroaryl ring having 1-4 heteroatoms independently selected from nitrogen, oxygen, and sulfur. In some embodiments, R is an optionally substituted 5-6 membered monocyclic heteroaryl ring having 1-3 heteroatoms independently selected from nitrogen, sulfur, and oxygen. In some embodiments, R is a substituted 5-6 membered monocyclic heteroaryl ring having 1-3 heteroatoms independently selected from nitrogen, oxygen, and sulfur. In some embodiments, R is an unsubstituted 5-6 membered monocyclic heteroaryl ring having 1-3 heteroatoms independently selected from nitrogen, sulfur, and oxygen.

In some embodiments, R is an optionally substituted 5-membered monocyclic heteroaryl ring having 1 heteroatom selected from nitrogen, oxygen, and sulfur. In some embodiments, R is optionally substituted pyrrolyl, furanyl, or thienyl.

In some embodiments, R is an optionally substituted 5-membered heteroaryl ring having 2 heteroatoms independently selected from nitrogen, oxygen, and sulfur. In certain embodiments, R is an optionally substituted 5-membered heteroaryl ring having 1 nitrogen atom, and an additional heteroatom selected from sulfur or oxygen. In some embodiments, R is optionally substituted pyrazolyl, imidazolyl, thiazolyl, isothiazolyl, oxazolyl or isoxazolyl.

In some embodiments, R is an optionally substituted 5-membered heteroaryl ring having three heteroatoms independently selected from nitrogen, oxygen, and sulfur. In some embodiments, R is optionally substituted triazolyl, oxadiazolyl or thiadiazolyl.

In some embodiments, R is an optionally substituted 5-membered heteroaryl ring having four heteroatoms independently selected from nitrogen, oxygen, and sulfur. In some embodiments, R is optionally substituted tetrazolyl, oxatriazolyl and thiatriazolyl.

In some embodiments, R is an optionally substituted 6-membered heteroaryl ring having 1-4 nitrogen atoms. In some embodiments, R is an optionally substituted 6-membered heteroaryl ring having 1-3 nitrogen atoms. In other embodiments, R is an optionally substituted 6-membered heteroaryl ring having 1-2 nitrogen atoms. In some embodiments, R is an optionally substituted 6-membered heteroaryl ring having four nitrogen atoms. In some embodiments, R is an optionally substituted 6-membered heteroaryl ring having three nitrogen atoms. In some embodiments, R is an optionally substituted 6-membered heteroaryl ring having two nitrogen atoms. In certain embodiments, R is an optionally substituted 6-membered heteroaryl ring having one nitrogen atom. In some embodiments, R is optionally substituted pyridinyl, pyrimidinyl, pyrazinyl, pyridazinyl, triazinyl, or tetrazinyl.

In certain embodiments, R is an optionally substituted 8-10 membered bicyclic heteroaryl ring having 1-4 heteroatoms independently selected from nitrogen, oxygen, and sulfur. In some embodiments, R is an optionally substituted 5,6-fused heteroaryl ring having 1-4 heteroatoms independently selected from nitrogen, oxygen, and sulfur. In other embodiments, R is an optionally substituted 5,6-fused heteroaryl ring having 1-2 heteroatoms independently selected from nitrogen, oxygen, and sulfur. In certain embodiments, R is an optionally substituted 5,6-fused heteroaryl ring having 1 heteroatom independently selected from nitrogen, oxygen, and sulfur. In some embodiments, R is an optionally substituted indolyl. In some embodiments, R is an optionally substituted azabicyclo[3.2.1]octanyl. In certain embodiments, R is an optionally substituted 5,6-fused heteroaryl ring having 2 heteroatoms independently selected from nitrogen, oxygen, and sulfur. In some embodiments, R is an optionally substituted azaindolyl. In some embodiments, R is an optionally substituted benzimidazolyl. In some embodiments, R is an optionally substituted benzothiazolyl. In some embodiments, R is an optionally substituted benzoxazolyl. In some embodiments, R is an optionally substituted indazolyl. In certain embodiments, R is an optionally substituted 5,6-fused heteroaryl ring having 3 heteroatoms independently selected from nitrogen, oxygen, and sulfur.

In some embodiments, R is an optionally substituted 5,6-fused heteroaryl ring having 1-5 heteroatoms independently selected from nitrogen, oxygen, and sulfur. In some embodiments, R is an optionally substituted 5,6-fused heteroaryl ring having 1-4 heteroatoms independently selected from nitrogen, oxygen, and sulfur. In some embodiments, R is an optionally substituted 5,6-fused heteroaryl ring having 1-3 heteroatoms independently selected from nitrogen, oxygen, and sulfur. In some embodiments, R is an optionally substituted 5,6-fused heteroaryl ring having two heteroatoms independently selected from nitrogen, oxygen, and sulfur. In some embodiments, R is an optionally substituted 5,6-fused heteroaryl ring having three heteroatoms independently selected from nitrogen, oxygen, and sulfur. In some embodiments, R is an optionally substituted 5,6-fused heteroaryl ring having four heteroatoms independently selected from nitrogen, oxygen, and sulfur. In some embodiments, R is an optionally substituted 5,6-fused heteroaryl ring having five heteroatoms independently selected from nitrogen, oxygen, and sulfur.

In certain embodiments, R is an optionally substituted 5,6-fused heteroaryl ring having one heteroatom independently selected from nitrogen, oxygen, and sulfur. In some embodiments, R is optionally substituted indolyl. In some embodiments, R is optionally substituted benzofuranyl. In some embodiments, R is optionally substituted benzo[b]thienyl. In certain embodiments, R is an optionally substituted 5,6-fused heteroaryl ring having two heteroatoms independently selected from nitrogen, oxygen, and sulfur. In some embodiments, R is optionally substituted azaindolyl. In some embodiments, R is optionally substituted benzimidazolyl. In some embodiments, R is optionally substituted benzothiazolyl. In some embodiments, R is optionally substituted benzoxazolyl. In some embodiments, R is an optionally substituted indazolyl. In certain embodiments, R is an optionally substituted 5,6-fused heteroaryl ring having three heteroatoms independently selected from nitrogen, oxygen, and sulfur. In some embodiments, R is optionally substituted oxazolopyridiyl, thiazolopyridinyl or imidazopyridinyl. In certain embodiments, R is an optionally substituted 5,6-fused heteroaryl ring having four heteroatoms independently selected from nitrogen, oxygen, and sulfur. In some embodiments, R is optionally substituted purinyl, oxazolopyrimidinyl, thiazolopyrimidinyl, oxazolopyrazinyl, thiazolopyrazinyl, imidazopyrazinyl, oxazolopyridazinyl, thiazolopyridazinyl or imidazopyridazinyl. In certain embodiments, R is an optionally substituted 5,6-fused heteroaryl ring having five heteroatoms independently selected from nitrogen, oxygen, and sulfur.

In some embodiments, R is optionally substituted 1,4-dihydropyrrolo[3,2-b]pyrrolyl, 4H-furo [3,2-b]pyrrolyl, 4H-thieno [3,2-b]pyrrolyl, furo [3,2-b]furanyl, thieno [3,2-b]furanyl, thieno [3,2-b]thienyl, 1H-pyrrolo[1,2-a]imidazolyl, pyrrolo[2,1-b]oxazolyl or pyrrolo[2,1-b]thiazolyl. In some embodiments, R is optionally substituted dihydropyrroloimidazolyl, 1H-furoimidazolyl, 1H-thienoimidazolyl, furooxazolyl, furoisoxazolyl, 4H-pyrrolooxazolyl, 4H-pyrroloisoxazolyl, thienooxazolyl, thienoisoxazolyl, 4H-pyrrolothiazolyl, furothiazolyl, thienothiazolyl, 1H-imidazoimidazolyl, imidazooxazolyl or imidazo[5,1-b]thiazolyl.

In certain embodiments, R is an optionally substituted 6,6-fused heteroaryl ring having 1-4 heteroatoms independently selected from nitrogen, oxygen, and sulfur. In some embodiments, R is an optionally substituted 6,6-fused heteroaryl ring having 1-2 heteroatoms independently selected from nitrogen, oxygen, and sulfur. In other embodiments, R is an optionally substituted 6,6-fused heteroaryl ring having 1 heteroatom independently selected from nitrogen, oxygen, and sulfur. In some embodiments, R is an optionally substituted quinolinyl. In some embodiments, R is an optionally substituted isoquinolinyl. According to one aspect, R is an optionally substituted 6,6-fused heteroaryl ring having 2 heteroatoms independently selected from nitrogen, oxygen, and sulfur. In some embodiments, R is a quinazoline or a quinoxaline.

In some embodiments, R is 3-30 membered heterocyclic ring having 1-10 heteroatoms independently selected from oxygen, nitrogen, sulfur, phosphorus and silicon. In some embodiments, R is 3-30 membered heterocyclic ring having 1-10 heteroatoms independently selected from oxygen, nitrogen, and sulfur. In some embodiments, R is 3-30 membered heterocyclic ring having 1-5 heteroatoms independently selected from oxygen, nitrogen, sulfur, phosphorus and silicon. In some embodiments, R is 3-30 membered heterocyclic ring having 1-5 heteroatoms independently selected from oxygen, nitrogen, and sulfur.

In some embodiments, R is an optionally substituted 3-7 membered saturated or partially unsaturated heterocyclic ring having 1-3 heteroatoms independently selected from nitrogen, oxygen, and sulfur. In some embodiments, R is a substituted 3-7 membered saturated or partially unsaturated heterocyclic ring having 1-3 heteroatoms independently selected from nitrogen, oxygen, and sulfur. In some embodiments, R is an unsubstituted 3-7 membered saturated or partially unsaturated heterocyclic ring having 1-3 heteroatoms independently selected from nitrogen, oxygen, and sulfur. In certain embodiments, R is an optionally substituted 5-7 membered partially unsaturated monocyclic ring having 1-3 heteroatoms independently selected from nitrogen, oxygen, and sulfur. In certain embodiments, R is an optionally substituted 5-6 membered partially unsaturated monocyclic ring having 1-3 heteroatoms independently selected from nitrogen, oxygen, and sulfur. In certain embodiments, R is an optionally substituted 5-membered partially unsaturated monocyclic ring having 1-3 heteroatoms independently selected from nitrogen, oxygen, and sulfur. In certain embodiments, R is an optionally substituted 6-membered partially unsaturated monocyclic ring having 1-3 heteroatoms independently selected from nitrogen, oxygen, and sulfur. In certain embodiments, R is an optionally substituted 7-membered partially unsaturated monocyclic ring having 1-3 heteroatoms independently selected from nitrogen, oxygen, and sulfur. In some embodiments, R is optionally substituted 3-membered heterocyclic ring having one heteroatom selected from nitrogen, sulfur, and oxygen. In some embodiments, R is optionally substituted 4-membered heterocyclic ring having 1-3 heteroatoms independently selected from nitrogen, oxygen, and sulfur. In some embodiments, R is optionally substituted 5-membered heterocyclic ring having 1-3 heteroatoms independently selected from nitrogen, oxygen, and sulfur. In some embodiments, R is optionally substituted 6-membered heterocyclic ring having 1-3 heteroatoms independently selected from nitrogen, oxygen, and sulfur. In some embodiments, R is optionally substituted 7-membered heterocyclic ring having 1-3 heteroatoms independently selected from nitrogen, oxygen, and sulfur.

In some embodiments, R is an optionally substituted 3-membered saturated or partially unsaturated heterocyclic ring having 1-2 heteroatoms independently selected from nitrogen, oxygen, and sulfur. In some embodiments, R is an optionally substituted 4-membered saturated or partially unsaturated heterocyclic ring having 1-2 heteroatoms independently selected from nitrogen, oxygen, and sulfur. In some embodiments, R is an optionally substituted 5-membered saturated or partially unsaturated heterocyclic ring having 1-2 heteroatoms independently selected from nitrogen, oxygen, and sulfur. In some embodiments, R is an optionally substituted 6-membered saturated or partially unsaturated heterocyclic ring having 1-2 heteroatoms independently selected from nitrogen, oxygen, and sulfur. In some embodiments, R is an optionally substituted 7-membered saturated or partially unsaturated heterocyclic ring having 1-2 heteroatoms independently selected from nitrogen, oxygen, and sulfur.

In some embodiments, R is an optionally substituted 5-membered saturated or partially unsaturated heterocyclic ring having 1-2 heteroatoms independently selected from nitrogen, oxygen, and sulfur. In some embodiments, R is an optionally substituted 5-membered partially unsaturated heterocyclic ring having 2 heteroatoms independently selected from nitrogen, oxygen, and sulfur. In some embodiments, R is an optionally substituted 5-membered partially unsaturated heterocyclic ring having no more than 1 heteroatom. In some embodiments, R is an optionally substituted 5-membered partially unsaturated heterocyclic ring having no more than 1 heteroatom, wherein the heteroatom is nitrogen. In some embodiments, R is an optionally substituted 5-membered partially unsaturated heterocyclic ring having no more than 1 heteroatom, wherein the heteroatom is oxygen. In some embodiments, R is an optionally substituted 5-membered partially unsaturated heterocyclic ring having no more than 1 heteroatom, wherein the heteroatom is sulfur. In some embodiments, R is an optionally substituted 5-membered partially unsaturated heterocyclic ring having 2 oxygen atoms. In some embodiments, R is an optionally substituted 5-membered partially unsaturated heterocyclic ring having 2 nitrogen atoms.

In some embodiments, R is an optionally substituted 6-membered saturated or partially unsaturated heterocyclic ring having 1-2 heteroatoms independently selected from nitrogen, oxygen, and sulfur. In some embodiments, R is an optionally substituted 6-membered partially unsaturated heterocyclic ring having 2 heteroatoms independently selected from nitrogen, oxygen, and sulfur. In some embodiments, R is an optionally substituted 6-membered partially unsaturated heterocyclic ring having no more than 1 heteroatom. In some embodiments, R is an optionally substituted 6-membered partially unsaturated heterocyclic ring having no more than 1 heteroatom, wherein the heteroatom is nitrogen. In some embodiments, R is an optionally substituted 6-membered partially unsaturated heterocyclic ring having no more than 1 heteroatom, wherein the heteroatom is oxygen. In some embodiments, R is an optionally substituted 6-membered partially unsaturated heterocyclic ring having no more than 1 heteroatom, wherein the heteroatom is sulfur. In some embodiments, R is an optionally substituted 6-membered partially unsaturated heterocyclic ring having 2 oxygen atoms. In some embodiments, R is an optionally substituted 6-membered partially unsaturated heterocyclic ring having 2 nitrogen atoms.

In certain embodiments, R is a 3-7 membered saturated or partially unsaturated heterocyclic ring having 1-2 heteroatoms independently selected from nitrogen, oxygen, and sulfur. In certain embodiments, R is optionally substituted oxiranyl, oxetanyl, tetrahydrofuranyl, tetrahydropyranyl, oxepaneyl, aziridineyl, azetidineyl, pyrrolidinyl, piperidinyl, azepanyl, thiiranyl, thietanyl, tetrahydrothiophenyl, tetrahydrothiopyranyl, thiepanyl, dioxolanyl, oxathiolanyl, oxazolidinyl, imidazolidinyl, thiazolidinyl, dithiolanyl, dioxanyl, morpholinyl, oxathianyl, piperazinyl, thiomorpholinyl, dithianyl, dioxepanyl, oxazepanyl, oxathiepanyl, dithiepanyl, diazepanyl, dihydrofuranonyl, tetrahydropyranonyl, oxepanonyl, pyrolidinonyl, piperidinonyl, azepanonyl, dihydrothiophenonyl, tetrahydrothiopyranonyl, thiepanonyl, oxazolidinonyl, oxazinanonyl, oxazepanonyl, dioxolanonyl, dioxanonyl, dioxepanonyl, oxathiolinonyl, oxathianonyl, oxathiepanonyl, thiazolidinonyl, thiazinanonyl, thiazepanonyl, imidazolidinonyl, tetrahydropyrimidinonyl, diazepanonyl, imidazolidinedionyl, oxazolidinedionyl, thiazolidinedionyl, dioxolanedionyl, oxathiolanedionyl, piperazinedionyl, morpholinedionyl, thiomorpholinedionyl, tetrahydropyranyl, tetrahydrofuranyl, morpholinyl, thiomorpholinyl, piperidinyl, piperazinyl, pyrrolidinyl, tetrahydrothiophenyl, or tetrahydrothiopyranyl.

In certain embodiments, R is an optionally substituted 5-6 membered partially unsaturated monocyclic ring having 1-2 heteroatoms independently selected from nitrogen, oxygen, and sulfur. In certain embodiments, R is an optionally substituted tetrahydropyridinyl, dihydrothiazolyl, dihydrooxazolyl, or oxazolinyl group.

In some embodiments, R is an optionally substituted 7-10 membered bicyclic saturated or partially unsaturated heterocyclic ring having 1-5 heteroatoms independently selected from nitrogen, oxygen, and sulfur. In some embodiments, R is optionally substituted indolinyl. In some embodiments, R is optionally substituted isoindolinyl. In some embodiments, R is optionally substituted 1, 2, 3, 4-tetrahydroquinolinyl. In some embodiments, R is optionally substituted 1, 2, 3, 4-tetrahydroisoquinolinyl. In some embodiments, R is an optionally substituted azabicyclo[3.2.1]octanyl.

In some embodiments, R is optionally substituted $C_{6-30}$ arylaliphatic. In some embodiments, R is optionally substituted $C_{6-20}$ arylaliphatic. In some embodiments, R is optionally substituted $C_{6-10}$ arylaliphatic. In some embodiments, an aryl moiety of the arylaliphatic has 6, 10, or 14 aryl carbon atoms. In some embodiments, an aryl moiety of the arylaliphatic has 6 aryl carbon atoms. In some embodiments, an aryl moiety of the arylaliphatic has 10 aryl carbon atoms. In some embodiments, an aryl moiety of the arylaliphatic has 14 aryl carbon atoms. In some embodiments, an aryl moiety is optionally substituted phenyl.

In some embodiments, R is optionally substituted $C_{6-30}$ arylheteroaliphatic having 1-10 heteroatoms independently selected from oxygen, nitrogen, sulfur, phosphorus and silicon. In some embodiments, R is optionally substituted $C_{6-30}$ arylheteroaliphatic having 1-10 heteroatoms independently selected from oxygen, nitrogen, and sulfur. In some embodiments, R is optionally substituted $C_{6-20}$ arylheteroaliphatic having 1-10 heteroatoms independently selected from oxygen, nitrogen, sulfur, phosphorus and silicon. In some embodiments, R is optionally substituted $C_{6-20}$ arylheteroaliphatic having 1-10 heteroatoms independently selected from oxygen, nitrogen, and sulfur. In some embodiments, R is optionally substituted $C_{6-10}$ arylheteroaliphatic having 1-5 heteroatoms independently selected from oxygen, nitrogen, sulfur, phosphorus and silicon. In some embodiments, R is optionally substituted $C_{6-10}$ arylheteroaliphatic having 1-5 heteroatoms independently selected from oxygen, nitrogen, and sulfur.

In some embodiments, two R groups are optionally and independently taken together to form a covalent bond. In some embodiments, —C=O is formed. In some embodiments, —C=C— is formed. In some embodiments, —C≡C— is formed.

In some embodiments, two or more R groups on the same atom are optionally and independently taken together with the atom to form an optionally substituted, 3-30 membered monocyclic, bicyclic or polycyclic ring having, in addition to the atom, 0-10 heteroatoms independently selected from oxygen, nitrogen, sulfur, phosphorus and silicon. In some embodiments, two or more R groups on the same atom are optionally and independently taken together with the atom to form an optionally substituted, 3-20 membered monocyclic, bicyclic or polycyclic ring having, in addition to the atom, 0-10 heteroatoms independently selected from oxygen, nitrogen, sulfur, phosphorus and silicon. In some embodiments, two or more R groups on the same atom are optionally and independently taken together with the atom to form an optionally substituted, 3-10 membered monocyclic, bicyclic or polycyclic ring having, in addition to the atom, 0-5 heteroatoms independently selected from oxygen, nitrogen, sulfur, phosphorus and silicon. In some embodiments, two or more R groups on the same atom are optionally and independently taken together with the atom to form an optionally substituted, 3-6 membered monocyclic, bicyclic or polycyclic ring having, in addition to the atom, 0-3 heteroatoms independently selected from oxygen, nitrogen, sulfur, phosphorus and silicon. In some embodiments, two or more R groups on the same atom are optionally and independently taken together with the atom to form an optionally substituted, 3-5 membered monocyclic, bicyclic or polycyclic ring having, in addition to the atom, 0-3 heteroatoms independently selected from oxygen, nitrogen, sulfur, phosphorus and silicon.

In some embodiments, two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms independently selected from oxygen, nitrogen, sulfur, phosphorus and silicon. In some embodiments, two or more R groups on two or more atoms are optionally and independently taken together with their intervening atoms to form an optionally substituted, 3-20 membered monocyclic, bicyclic or polycyclic ring having, in addition to the intervening atoms, 0-10 heteroatoms independently selected from oxygen, nitrogen, sulfur, phosphorus and silicon. In some embodiments, two or more R groups on two or more atoms are optionally and independently taken together with their intervening atoms to form an optionally substituted, 3-10 membered monocyclic, bicyclic or polycyclic ring having, in addition to the intervening atoms, 0-10 heteroatoms independently selected from oxygen, nitrogen, sulfur, phosphorus and silicon. In some embodiments, two or more R groups on two or more atoms are optionally and independently taken together with their intervening atoms to form an optionally substituted, 3-10 membered monocyclic, bicyclic or polycyclic ring having, in addition to the intervening atoms, 0-5 heteroatoms independently selected from oxygen, nitrogen, sulfur, phosphorus and silicon. In some embodiments, two or more R groups on two or more atoms are optionally and independently taken together with their intervening atoms to form an optionally substituted, 3-6 membered monocyclic, bicyclic or polycyclic ring having, in addition to the intervening atoms, 0-3 heteroatoms independently selected from oxygen, nitrogen, sulfur, phosphorus and silicon. In some embodiments, two or more R groups on two or more atoms are optionally and independently taken together with their intervening atoms to form an optionally substituted, 3-5 membered monocyclic, bicyclic or polycyclic ring having, in addition to the intervening atoms, 0-3 heteroatoms independently selected from oxygen, nitrogen, sulfur, phosphorus and silicon.

In some embodiments, heteroatoms in R groups, or in the structures formed by two or more R groups taken together, are selected from oxygen, nitrogen, and sulfur. In some embodiments, a formed ring is 3, 4, 5, 6, 7, 8, 9, 10, 11, 12, 13, 14, 15, 16, 17, 18, 19, or 20-membered. In some embodiments, a formed ring is saturated. In some embodiments, a formed ring is partially saturated. In some embodiments, a formed ring is aromatic. In some embodiments, a formed ring comprises a saturated, partially saturated, or aromatic ring moiety. In some embodiments, a formed ring comprises 5, 6, 7, 8, 9, 10, 11, 12, 13, 14, 15, 16, 17, 18, 19, or 20 aromatic ring atoms. In some embodiments, a formed contains no more than 5, 6, 7, 8, 9, 10, 11, 12, 13, 14, 15, 16, 17, 18, 19, or 20 aromatic ring atoms. In some embodiments, aromatic ring atoms are selected from nitrogen, oxygen and sulfur.

In some embodiments, a 5'-end region is represented by any of: PX0-, PX0-N1-, PX0-N1-PX1-, PX0-N1-PX1-N2-, PX0-N1-PX1-N2-PX2-, PX0-N1-PX1-N2-PX2-N3-, or PX0-N1-PX1-N2-PX2-N3-PX3-. In some embodiments, a 5'-end region is represented by any of: PX0-, PX0-N1-, or PX0-N1-PX1-. In some embodiments, a 5'-end structure is represented by any of: PX0-, PX0-N1-, or PX0-N1-PX1-. In some embodiments, a 5'-end structure is represented by PX0-. In some embodiments, a 5'-end structure is a 5'-end group. In some embodiments, a 5'-end comprises a 5'-end region or structure. In some embodiments, a 5'-end comprises a 5' nucleotide moiety. In some embodiments, a 5'-end comprises a 5' nucleotide moiety, which can be a nucleotide. In some embodiments, —N1-PX1- represents a 5' nucleotide moiety. In some embodiments, —N1- represents a 5' nucleoside. In some embodiments, a 5'-end nucleoside is -N1-. In some embodiments, a 5'-end nucleotide is -N1-PX1-.

In some embodiments, —PX0-, -PX0-N1-, and -PX0-N1-PX1- is represented by the structure described herein of any 5'-end structure, 5'-end region, 5'-nucleotide, modified 5'-nucleotide, 5'-nucleotide analog, or 5'-nucleoside, modified 5'-nucleoside or 5'-nucleoside analog.

In some embodiments, an oligonucleotide capable of directing a decrease in the expression and/or level of a target gene or its gene product can comprise any 5'-end described herein or known in the art.

In some embodiments, an oligonucleotide, an oligonucleotide that directs RNA interference, an oligonucleotide that directs RNase H-mediated knockdown can comprise any 5'-end described herein or known in the art.

In some embodiments, an oligonucleotide, an oligonucleotide that directs RNase H-mediated knockdown, or an oligonucleotide that directs both RNA interference and RNase H-mediated knockdown can comprise any 5'-end described herein or known in the art.

In some embodiments, the 5'-end of a provided single-stranded RNAi agent comprises a phosphorus-comprising moiety (e.g., a 5'-end represented by PX0 comprises a phosphorus). Non-limiting examples of ssRNAi formats wherein the 5'-end comprises a phosphorus-comprising moiety include Formats 1-15, 20-21, 23-31, 80-82, 92-95, 97-102, and 104-107 of FIG. 1.

In some embodiments, the 5'-end of a provided single-stranded RNAi agent does not comprise a phosphorus-comprising moiety (e.g., a 5'-end represented by PX0 comprises a phosphorus). In some embodiments, PX0 is —OH. Non-limiting examples of ssRNAi formats wherein the 5'-end does not comprise a phosphorus-comprising moiety include Formats 16-19, 22, 32-79, 83-91, 96, and 103 of FIG. 1.

In some embodiments, the 5'-end of a provided single-stranded RNAi agent comprises a moiety comprising a phosphate, such as a phosphodiester, phosphorothioate, phosphorodithioate, H-phosphonate, or other moiety similar or identical to a phosphate-comprising internucleotidic linkage. In some embodiments, the 5'-end of a provided single-stranded RNAi agent comprises a moiety comprising a phosphate, but which is not a phosphodiester; such a moiety in some embodiments is referred to as a phosphate mimic, modified phosphate or phosphate analog. In some embodiments, this moiety comprising a phosphate is represented in the structure of a single-stranded RNAi agent as PX0-.

In some embodiments, the 5'-end of a provided single-stranded RNAi agent does not comprise a moiety comprising a phosphate.

In some embodiments of a single-stranded RNAi agent, a 5' end structure, e.g, PX0-N1-, has a structure selected from: 5'-(R)-Me OH T, 5'-(R)-Me PO T, 5'-(R)-Me PS T, 5'-(R)-Me PH T, 5'-(S)-Me OH T, 5'-(S)-Me PO T, 5'-(S)-Me PS T, and 5'-(S)—PH T.

Some embodiments of a provided single-stranded RNAi agent, which comprise a phosphorus-comprising moiety in the 5'-end structure, represented by PX0-, PX0-N1-, or PX0-N1-PX1-, is represented by a structure selected from the structure of any of Formula III-a to III-l:

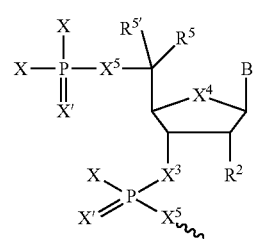

III-a

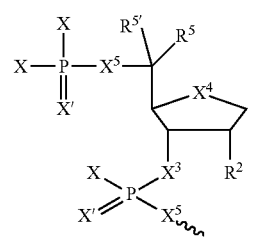

III-b

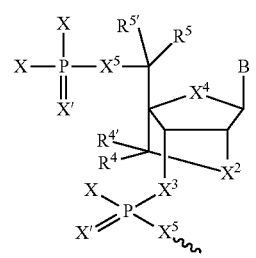

III-c

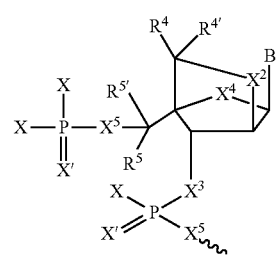

III-d

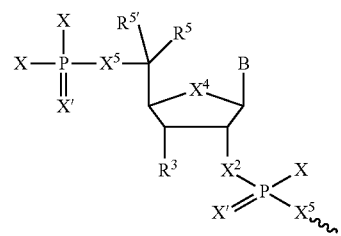

III-e

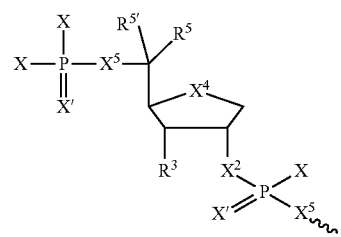

III-f

-continued

III-g

III-h

III-i

III-j

III-k

III-l

-continued

III-g (structure)

VPT

V-e (structure labeled Th)

X = O', S', NR$_2$, BH$_3$', H
X' = O, S
X$^2$, X$^3$, X$^4$, X$^5$ = O, S, CH$_2$ or NR
R = H, alkyl or targeting moiety (e.g. GalNAc)
R$^2$, R$^3$, R$^4$, R$^5$ = H, alkyl, O-alkyl, S-alkyl, N-alkyl, OH, F
B = nucleobase, modified nucleobase, heterocyclic compound derivatives wherein ~ indicates a connection site.

In some embodiments, P in any of Formula III-a to III-l is stereorandom or stereodefined as in the Sp or Rp configuration.

In some embodiments, the 5'-end structure, represented by PX0-, is represented by the structure of Formula III-a.

In some embodiments, the 5'-end structure, represented by PX0-, is represented by the structure of Formula III-a, wherein R$^5$ is CH$_3$ and R$^{5s}$ is H.

In some embodiments, the 5'-end structure, represented by PX0-, is represented by the structure of Formula III-a, wherein R5 is CH$_3$ and R5' is H, X is O or S, and X', X$^3$ and X$^5$ are O.

In some embodiments, the 5'-end structure, represented by PX0-, is represented by the structure of Formula III-a, wherein R5 is CH$_3$ and R5' is H, X is O or S, and X', X$^3$ and X$^5$ are O, and R$^2$ is F, H, OH, OMe or MOE.

In some embodiments, the 5'-end structure, represented by PX0-, is represented by the structure of Formula III-a, and wherein P is in the Sp configuration.

In some embodiments, the 5'-end structure, represented by PX0-, is represented by the structure of Formula III-a, wherein R$^5$ is CH$_3$ and R$^{5s}$ is H, and wherein P is in the Sp configuration.

In some embodiments, the 5'-end structure, represented by PX0-, is represented by the structure of Formula III-a, wherein R5 is CH$_3$ and R5' is H, X is O or S, and X', X$^3$ and X$^5$ are O, and wherein P is in the Sp configuration.

In some embodiments, the 5'-end structure, represented by PX0-, is represented by the structure of Formula III-a, wherein R5 is CH$_3$ and R5' is H, X is O or S, and X', X$^3$ and X$^5$ are O, and R$^2$ is F, H, OH, OMe or MOE, and wherein P is in the Sp configuration.

In some embodiments, the 5'-end structure, represented by PX0-, is represented by the structure of Formula III-a, and wherein P is in the Rp configuration.

In some embodiments, the 5'-end structure, represented by PX0-, is represented by the structure of Formula III-a, wherein R$^5$ is CH$_3$ and R$^{5s}$ is H, and wherein P is in the Rp configuration.

In some embodiments, the 5'-end structure, represented by PX0-, is represented by the structure of Formula III-a, wherein R5 is CH$_3$ and R5' is H, X is O or S, and X', X$^3$ and X$^5$ are O, and wherein P is in the Rp configuration.

In some embodiments, the 5'-end structure, represented by PX0-, is represented by the structure of Formula III-a, wherein R5 is CH₃ and R5' is H, X is O or S, and X', X³ and X⁵ are O, and R² is F, H, OH, OMe or MOE, and wherein P is in the Rp configuration.

In some embodiments of a provided single-stranded RNAi agent, which comprise a phosphorus-comprising moiety at the 5'-end structure, PX0-, which is represented by a structure selected from the Formula IV-a (Mod022 also known as C3 PO and n-propyl), IV-b (Mod022*), IV-c (POMod023*), IV-d (PSMod023*), and IV-e (PHMod023*):

Mod022:

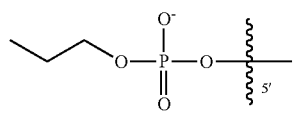

IV-a

Mod022*:

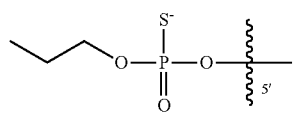

IV-b

POMod023*:

IV-c

PSMod023*:

IV-d

PHMod023*:

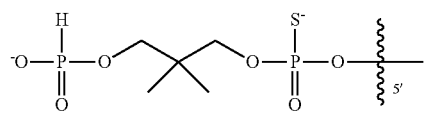

IV-e

Non-limiting examples of a provided single-stranded RNAi agent which comprises a phosphorus-comprising moiety at the 5'-end structure, PX0-, which is represented by a structure of the Formula IV-a (Mod022), also known as C3 PO, include: WV-2654, Table 28; and WV-2655, Table 31. A non-limiting example of a single-stranded RNAi which comprises a phosphorus-comprising moiety at the 5'-end structure, PX0-, which is represented by the structure of POMod023*(also known as C₃dimethyl 0) is WV-2657, Table 31. A non-limiting example of a single-stranded RNAi which comprises a phosphorus-comprising moiety at the 5'-end structure, PX0-, which is represented by the structure of PHMod023*(also known as C3dimethyl H) is WV-2656, Table 31. A non-limiting example of a single-stranded RNAi which comprises a phosphorus-comprising moiety at the 5'-end structure, PX0-, which is represented by the structure of PSMod023*(also known as C3dimethyl PS) is WV-2658, Table 31.

In some embodiments of a provided single-stranded RNAi agent, which comprise a phosphorus-comprising moiety at the 5'-end structure, PX0-, is represented by a structure selected of the structure of Formula IV-f (also known as n-propyl, C3 PO or Mod022):

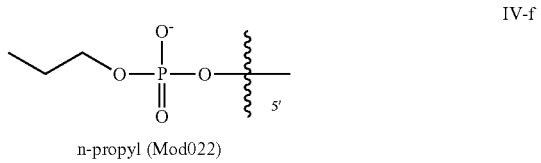 [SMILES: *OP(=O)([O-])OCCC]

n-propyl (Mod022)

IV-f wherein 5' indicates the attachment point to the 5' carbon of a sugar (e.g., of N1).

In some embodiments of a provided single-stranded RNAi agent, which comprise a phosphorus-comprising moiety at the 5'-end structure, PX0-, is represented by a structure selected of the following structure (also known as C3 PS or Mod022*):

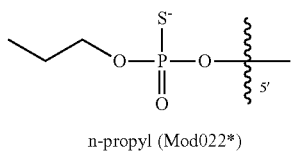

n-propyl (Mod022*)

wherein 5' indicates the attachment point to the 5' carbon of a sugar (e.g., of N1).

In some embodiments of a provided single-stranded RNAi agent, which comprise a phosphorus-comprising moiety at the 5'-end structure, PX0-, is represented by a structure selected of the structure of Formula IV-g (also known as DimethylC3 or C3dimethyl PS or Mod023*):

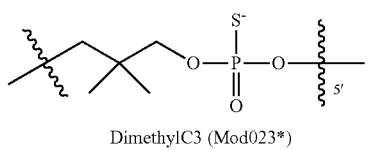

DimethylC3 (Mod023*)

IV-g wherein 5' indicates the attachment point to the 5' carbon of a sugar (e.g., of N1).

In some embodiments, a single-stranded RNAi agent comprises a 5'-end structure, or a structure of PX0-, which is selected from any of PO (phosphorodiester), Formula IV-h; PH (H-Phosphonate), Formula IV-i; and PS (Phosphorothioate), Formula IV-j:

PO:

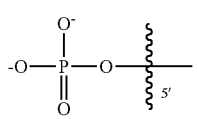

IV-h

PH:

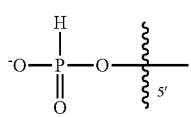

IV-i

PS:

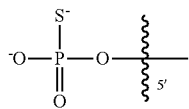
IV-j

In some embodiments of a provided single-stranded RNAi agent, which comprise a phosphorus-comprising moiety at the 5'-end structure, PX0-, is represented by a structure selected from any of the following:

POMod023*:


PSMod023*:

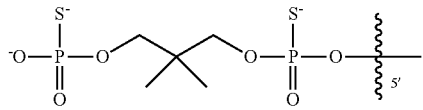

PHMod023*:

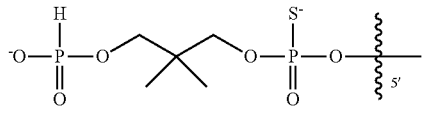

wherein 5' indicates the attachment point to the 5' carbon of a sugar (e.g., of N1).

Non-limiting examples of single-stranded RNAi agents comprising a 5'-end structure, or a structure of PX0-, which is selected from any of PO, PH, and PS, include: WV-2652 (PH), WV-2653 (PS), and WV-2420 (PO), Table 28.

In some embodiments, P in any of Formula IV-a to IV-j is stereorandom or stereodefined as in the Sp or Rp configuration.

In some embodiments, a 5'-end structure, or a structure of PX0-, is selected from any of: a phosphate, a phosphate analogue, 5'-monophosphate ((HO)$_2$(O)P—O-5'), 5'-diphosphate ((HO)$_2$(O)P—O—P(HO)(O)-O-5'), 5'-triphosphate ((HO)$_2$(O)P-O-(HO)(O)P—O—P(HO)(O)-O-5'), 5'-guanosine cap (7-methylated or non-methylated) (7m-G-O-5'-(HO)(O)P-O-(HO)(O)P—O—P(HO)(O)-O-5'), 5'-adenosine cap (Appp), and any modified or unmodified nucleotide cap structure (N-O-5'-(HO)(O)P—O-(HO)(O)P—O—P(HO)(O)-O-5'), 5'-monothiophosphate (phosphorothioate; (HO)$_2$(S)P-O-5'), 5'-monodithiophosphate (phosphorodithioate; (HO)(HS)(S)P-O-5'), 5'-phosphorothiolate ((HO)2(O)P-S-5'); any additional combination of oxygen/sulfur replaced monophosphate, diphosphate and triphosphates (e.g. 5'-alpha-thiotriphosphate, 5'-gamma-thiotriphosphate, etc.), 5'-phosphoramidates ((HO)2(O)P-NH-5', (HO)(NH$_2$)(O)P-O-5'), 5'-alkylphosphonates (R=alkyl=methyl, ethyl, isopropyl, propyl, etc., e.g. RP(OH)(O)-O-5'-, (OH)$_2$ (O)P-5'—CH$_2$-), 5'-alkyletherphosphonates (R=alkylether=methoxymethyl (MeOCH2-), ethoxymethyl, etc., e.g. RP(OH)(0)-0-5'-).

In some embodiments, the 5'-end structure, represented by PX0- or PX0-N1-PX1-, is represented by the structure of Formula II-a to II-l:

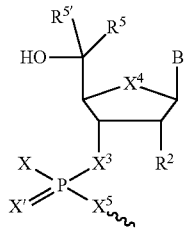
II-a

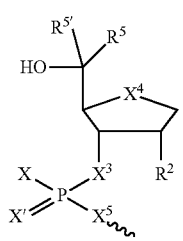
II-b

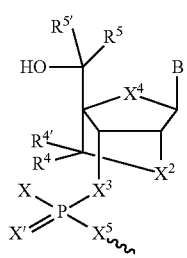
II-c

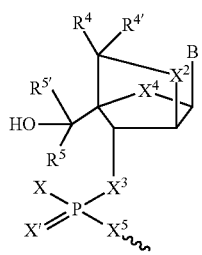
II-d

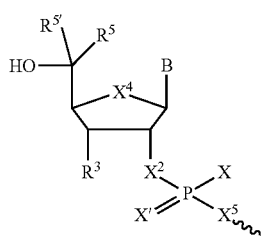
II-e

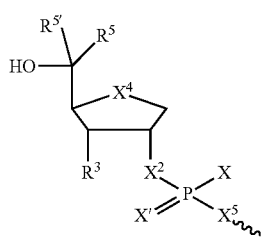
II-f

-continued

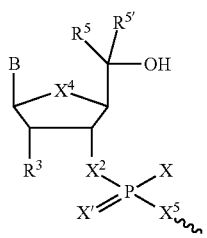

II-g

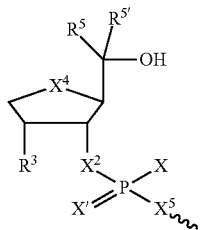

II-h

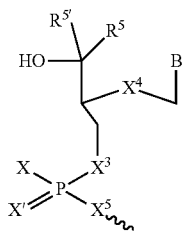

II-i

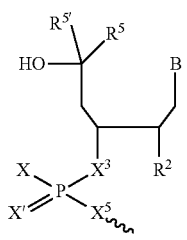

II-j

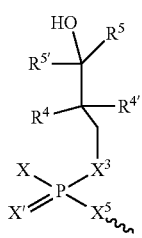

II-k

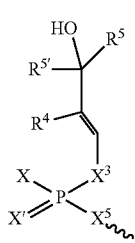

II-l

X = O', S', NR$_2$, BH$_3$', H
X' = O, S
X$^2$, X$^3$, X$^4$, X$^5$ = O, S, CH$_2$ or NR
R = H, alkyl or targeting moiety (e.g. GalNAc)
R$^2$, R$^3$, R$^4$, R$^5$ = H, alkyl, O-alkyl, S-alkyl, N-alkyl, OH, F
B = nucleobase, modified nucleobase, heterocyclic compound derivatives In some embodiments, P in any of Formula II-a to II-l is stereorandom or stereodefined as in the Sp or Rp configuration.

In some embodiments, the 5'-end structure, represented by PX0-, is represented by the structure of Formula II-a.

In some embodiments, the 5'-end structure, represented by PX0-, is represented by the structure of Formula II-a, wherein R$^5$ is CH$_3$ and R$^{5s}$ is H.

In some embodiments, the 5'-end structure, represented by PX0-, is represented by the structure of Formula II-a, wherein R5 is CH$_3$ and R5' is H, X is O or S, and X', X$^3$ and X$^5$ are O.

In some embodiments, the 5'-end structure, represented by PX0-, is represented by the structure of Formula II-a, wherein R5 is CH$_3$ and R5' is H, X is O or S, and X', X$^3$ and X$^5$ are O, and R$^2$ is F, H, OH, OMe or MOE.

In some embodiments, 5'-end structure, represented by PX0- or PX0-N1-PX1-, is represented by the structure of any of Formula V-a to V-d:

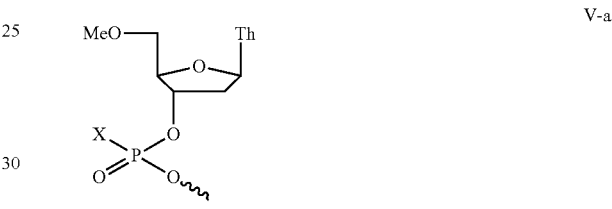

MeOT

V-a

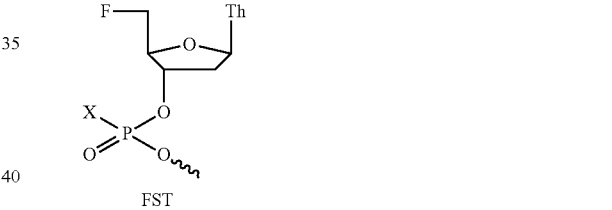

FST

V-b

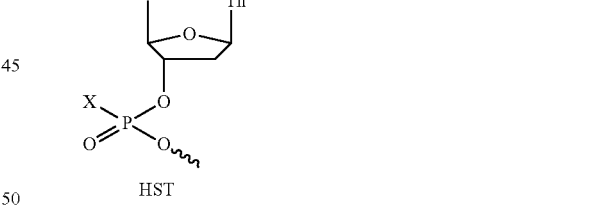

HST

V-c

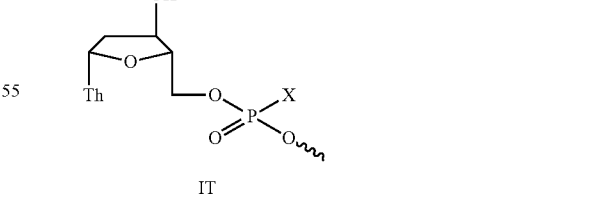

IT

V-d

A non-limiting example of a single-stranded RNAi agent PX0-N1-PX1- is a structure of Formula V-d (also known as IT) is WV-3818.

In some embodiments, a 5'-end has a structure in which PX0- or PX0-N1-PX1- is represented by a structure of the Formula V-f or V-g:

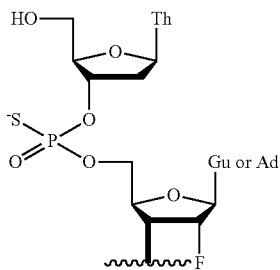

V-f

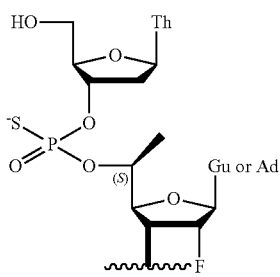

V-g

Th, Gu, Ad=nucleobases Thymine, Guanine and Adenine, respectively. In some embodiments, Th, Gu or Ad can be replaced by any base.

In some embodiments, a 5'-end comprising a phosphorus-comprising moiety can have particular advantages, in that the single-stranded RNAi agents comprising them may be more active in RNA interference.

In some embodiments, a 5' end structure, e.g., PX0-, PX0-N1- or PX0-N1-PX1-, has a structure of a 5'-nucleotide or a modified 5'-nucleotide, a 5'-nucleotide analog, a 5'-nucleoside or a modified 5'-nucleoside or a 5'-nucleoside analog.

In some embodiments, a 5' end structure, e.g., PX0-, has a structure of any of: a 5'-guanosine cap, a 5'-adenosine cap, a 5'-monothiophosphate, a 5'-monodithiophosphate, a 5'-phosphorothiolate, a 5'-phosphoramidate, a 5'-alkylphosphonate, and a 5'-alkyletherphosphonate; a 5'-monophosphate, a 5'-diphosphate, and a 5'-triphosphate; 5'-triphosphate; a monophosphate, a diphosphate, or a triphosphate in which at least one oxygen atom of the monophosphate, diphosphate, or triphosphate is replaced with a sulfur atom; 5'-alpha-thiotriphosphate and 5'-gamma-thiotriphosphate; alkylphosphonate; alkylphosphonate has the formula: RP(OH)(0)-0-5' or (OH)$_2$(O)P-5'-CH$_2$—, wherein R is a C$_1$-C$_3$ alkyl; alkyletherphosphonate; or alkyletherphosphonate of the formula: RP(OH)(0)-0-5', wherein R is an alkylether.

Various 5'-nucleosides are described in, for example, U.S. patent application Ser. No. 14/959,714, published as US 2016-0194349 A1; U.S. patent application Ser. No. 14/983,907, published as US 2016-0186175 A1; or U.S. patent application Ser. No. 13/696,796, published as US 20130323836.

In some embodiments, a 5' end structure, PX0-N1-, has a structure of Formula VIII-a:

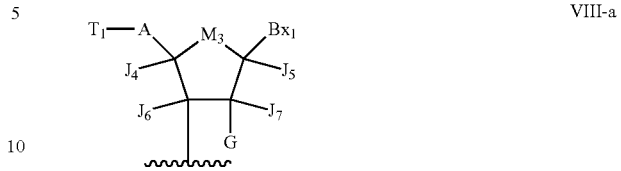

VIII-a wherein:
T$_1$ is H or an optionally protected phosphorus moiety;
A has one of the formulas:

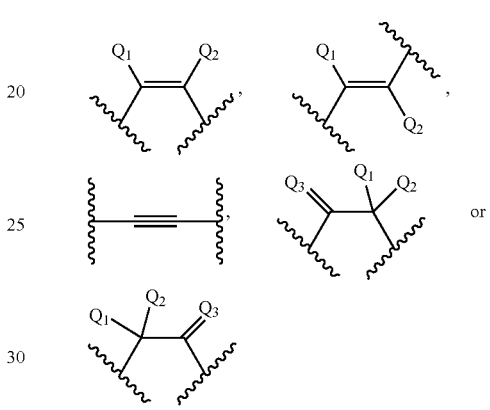

Q$_1$ and Q$_2$ are each, independently, H, halogen, C$_1$-C$_6$ alkyl, substituted C$_1$-C$_6$ alkyl, C$_1$-C$_6$ alkoxy, substituted C$_1$-C$_6$ alkoxy, C$_2$-C$_6$ alkenyl, substituted C$_2$-C$_6$ alkenyl, C$_2$-C$_6$ alkynyl, substituted C$_2$-C$_6$ alkynyl or N(R$_3$)(R$_4$),
Q$_3$ is O, S, N(R$_5$) or C(R$_6$)(R$_7$);
each R$_3$, R$_4$ R$_5$, R$_6$ and R$_7$ is, independently, H, C$_1$-C$_6$ alkyl, substituted C$_1$-C$_6$ alkyl or C$_1$-C$_6$ alkoxy;
M$_3$ is O, S, NR$_{14}$, C(R$_{15}$)(R$_{16}$), C(R$_{15}$)(R$_{16}$)C(R$_{17}$)(R$_{18}$), C(R$_{15}$)=C(R$_{17}$), OC(R$_{15}$)(R$_{16}$) or OC(R$_{15}$)(Bx$_2$);
R$_{14}$ is H, C$_1$-C$_6$ alkyl, substituted C$_1$-C$_6$ alkyl, C$_1$-C$_6$ alkoxy, substituted C$_1$-C$_6$ alkoxy, C$_2$-C$_6$ alkenyl, substituted C$_2$-C$_6$ alkenyl, C$_2$-C$_6$ alkynyl or substituted C$_2$-C$_6$ alkynyl; R$_{15}$, R$_{16}$, R$_{17}$ and R$_{18}$ are each, independently, H, halogen, C$_1$-C$_6$ alkyl, substituted C$_1$-C$_6$ alkyl, C$_1$-C$_6$ alkoxy, substituted C$_1$-C$_6$ alkoxy, C$_2$-C$_6$ alkenyl, substituted C$_2$-C$_6$ alkenyl, C$_2$-C$_6$ alkynyl or substituted C$_2$-C$_6$ alkynyl;
Bx$_1$ is a base;
or if Bx$_2$ is present then Bx$_2$ is a base; and Bx$_1$ is H, halogen, C$_1$-C$_6$ alkyl, substituted C$_1$-C$_6$ alkyl, C$_1$-C$_6$ alkoxy, substituted C$_1$-C$_6$ alkoxy, C$_2$-C$_6$ alkenyl, substituted C$_2$-C$_6$ alkenyl, C$_2$-C$_6$ alkynyl or substituted C$_2$-C$_6$ alkynyl;
J$_1$, J$_5$, J$_6$ and J$_7$ are each, independently, H, halogen, C$_1$-C$_6$ alkyl, substituted C$_1$-C$_6$ alkyl, C$_1$-C$_6$ alkoxy, substituted C$_1$-C$_6$ alkoxy, C$_2$-C$_6$ alkenyl, substituted C$_2$-C$_6$ alkenyl, C$_2$-C$_6$ alkynyl or substituted C$_2$-C$_6$ alkynyl;
or J$_4$ forms a bridge with one of J$_5$ or J$_7$ wherein said bridge comprises from 1 to 3 linked biradical groups selected from —O—, —S—, —NR$_{19}$, C(R$_{20}$)(R$_{21}$), C(R$_{20}$)=C(R$_{21}$), C[=C(R$_2$)(R$_{21}$)] and C(=O) and the other two of J$_5$, J$_6$ and J$_7$ are each, independently, H, halogen, C$_1$-C$_6$ alkyl, substituted C$_1$-C$_6$ alkyl, C$_1$-C$_6$ alkoxy, substituted C$_1$-C$_6$ alkoxy, C$_2$-C$_6$ alkenyl, substituted C$_2$-C$_6$ alkenyl, C$_2$-C$_6$ alkynyl or substituted C$_2$-C$_6$ alkynyl;
each R$_{19}$, R$_{20}$ and R$_{21}$ is, independently, H, C$_1$-C$_6$ alkyl, substituted C$_1$-C$_6$ alkyl, C$_1$-C$_6$ alkoxy, substituted C$_1$-C$_6$ alkoxy, $C_2$-$C_6$ alkenyl, substituted $C_2$-$C_6$ alkenyl, $C_2$-$C_6$ alkynyl or substituted $C_2$-$C_6$ alkynyl;

G is H, OH, halogen or O—[C($R_8$)($R_9$)]$_n$—[(C=O)$_m$—$X_1$]$_j$-Z;

each $R_8$ and $R_9$ is, independently, H, halogen, $C_1$-$C_6$ alkyl or substituted $C_1$-$C_6$ alkyl;

$X_1$ is O, S or N($E_1$);

Z is H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl or N($E_2$)($E_3$);

$E_1$, $E_2$ and $E_3$ are each, independently, H, $C_1$-$C_6$ alkyl or substituted $C_1$-$C_6$ alkyl;

n is from 1 to about 6;
m is 0 or 1;
j is 0 or 1;

each substituted group comprises one or more optionally protected substituent groups independently selected from halogen, $OJ_1$, $N(J_1)(J_2)$, $SJ_1$, $N_3$, CN, OC(=$X_2$)$J_1$, OC(=$X_2$)N($J_1$)($J_2$) and C(=$X_2$)N($J_1$)($J_2$); $X_2$ is O, S or $NJ_3$;

each $J_1$, $J_2$ and $J_3$ is, independently, H or $C_1$-$C_6$ alkyl;

when j is 1 then Z is other than halogen or N($E_2$)($E_3$); and wherein said oligomeric compound comprises from 8 to 40 monomeric subunits and is hybridizable to at least a portion of a target nucleic acid.

In some embodiments, $M_3$ is O, CH=CH, $OCH_2$ or OC(H)($Bx_2$). In some embodiments, $M_3$ is O.

In some embodiments, $J_4$, $J_5$, $J_6$ and $J_7$ are each H. In some embodiments, $J_4$ forms a bridge with one of $J_5$ or $J_7$.

In some embodiments, A has one of the formulas:

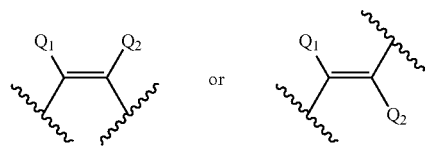

wherein:
$Q_1$ and $Q_2$ are each, independently, H, halogen, $C_1$-$C_6$ alkyl, substituted $C_1$-$C_6$ alkyl, $C_1$-$C_6$ alkoxy or substituted $C_1$-$C_6$ alkoxy. In some embodiments, $Q_1$ and $Q_2$ are each H. In some embodiments, $Q_1$ and $Q_2$ are each, independently, H or halogen. In some embodiments, $Q_1$ and $Q_2$ is H and the other of $Q_1$ and $Q_2$ is F, $CH_3$ or $OCH_3$.

In some embodiments, $T_1$ has the structure of Formula IX-a:

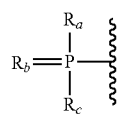

IX-a wherein:
$R_a$ and $R_c$ are each, independently, protected hydroxyl, protected thiol, $C_1$-$C_6$ alkyl, substituted $C_1$-$C_6$ alkyl, $C_1$-$C_6$ alkoxy, substituted $C_1$-$C_6$ alkoxy, protected amino or substituted amino; and $R_b$ is O or S. In some embodiments, $R_b$ is O and $R_a$ and $R_c$ are each, independently, $OCH_3$, $OCH_2CH_3$ or $CH(CH_3)_2$.

In some embodiments, G is halogen, $OCH_3$, $OCH_2F$, $OCHF_2$, $OCF_3$, $OCH_2CH_3$, $O(CH_2)_2F$, $OCH_2CHF_2$, $OCH_2CF_3$, $OCH_2$—CH=$CH_2$, $O(CH_2)_2$—$OCH_3$, $O(CH_2)_2$—$SCH_3$, $O(CH_2)_2$—$OCF_3$, $O(CH_2)_3$—N($R_{10}$)($R_{11}$), $O(CH_2)_2$—($R_{10}$)($R_{11}$), $O(CH_2)_2$—$O(CH_2)_2$—N($R_{10}$)($R_{11}$), $OCH_2C$(=O)—N($R_{10}$)($R_{11}$), $OCH_2C$(=O)—N($R_{12}$)—($CH_2$)$_2$—N($R_{10}$)($R_{11}$) or $O(CH_2)_2$—N($R_{12}$)—C(=$NR_{13}$)[N($R_{10}$)($R_{11}$—)] wherein $R_{10}$, $R_{11}$, $R_{12}$ and $R_{13}$ are each, independently, H or $C_1$-$C_6$ alkyl. In some embodiments, G is halogen, $OCH_3$, $OCF_3$, $OCH_2CH_3$, $OCH_2CF_3$, $OCH_2$—CH=$CH_2$, $O(CH_2)_2$—$OCH_3$, $O(CH_2)_2$—O($CH_2)_2$—N($CH_3$)$_2$, $OCH_2C$(O)—N(H)$CH_3$, $OCH_2C$(O)—N(H)—($CH_2)_2$—N($CH_3$)$_2$ or $OCH_2$—N(H)—C(=NH)$NH_2$. In some embodiments, G is F, $OCH_3$ or $O(CH_2)_2$—$OCH_3$. In some embodiments, G is $O(CH_2)_2$—$OCH_3$.

In certain embodiments, PX0- has the structure of A-B—, wherein -B- is an internucleotidic linkage and A has the configuration of Formula VIII-b, or PX0-N1- has the structure of Formula VIII-b:

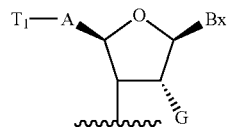

VIII-b

Bx is a base, or a heterocyclic base moiety selected from a pyrimidine, substituted pyrimidine, and purine or substituted purine.

In certain embodiments, A has the formula:

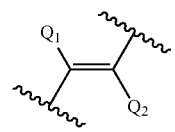

wherein $Q_1$ and $Q_2$ are each, independently, H, halogen, $C_1$-$C_6$ alkyl, substituted $C_1$-$C_6$ alkyl, $C_1$-$C_6$ alkoxy or substituted $C_1$-$C_6$ alkoxy. In certain embodiments, $Q_1$ and $Q_2$ are each, independently, H, F, $CH_3$ or $OCH_3$.

In certain embodiments, $T_1$ has the formula:

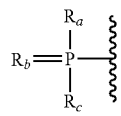

IX-b wherein;
$R_b$ is O; and
$R_a$ and $R_c$ are each, independently, $OCH_3$, $OCH_2CH_3$ or $OCH(CH_3)_2$.

In some embodiments, a 5'-end structure is a vinylphosphonate.

In certain embodiments, a 5' end structure, PX0-, has the structure of A-B—, wherein —B— is an internucleotidic linkage and A has the structure of Formula VIII-c, or PX0-N1- has the structure of Formula VIII-c:

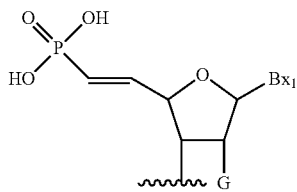

wherein:
Bx is a base;
G is halogen, $OCH_3$, $OCF_3$, $OCH_2CH_3$, $OCH_2CF_3$, $OCH_2$—CH=$CH_2$, $O(CH_2)_2$—$OCH_3$, $O(CH_2)_2$—$O(CH_2)_2$—N($CH_3)_2$, $OCH_2C(=O)$—$N(H)CH_3$, $OCH_2C(=O)$—$N(H)$—$(CH_2)_2$—$N(CH_3)_2$ or $OCH_2$—$N(H)$—$C(=NH)NH_2$.

In certain embodiments, oligomeric compounds are provided wherein said 5'-terminal compound has Formula VIII-c wherein G is F, $OCH_3$ or $O(CH_2)_2$—$OCH_3$.

In some embodiments, a 5' end structure, PX0-, has the structure of A-B—, wherein -B- is an internucleotidic linkage and A has the structure of Formula VIII-d, or PX0-N1- has the structure of Formula VIII-d:

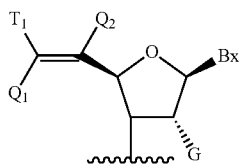

wherein:
Bx is a base;
$T_1$ is H or an optionally protected phosphorus moiety;
$Q_1$ and $Q_2$ are each, independently, H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl, $C_1$-$C_6$ alkoxy, substituted $C_1$-$C_6$ alkoxy or $N(R_3)(R_4)$;
each $R_3$ and $R_4$ is, independently, H, $C_1$-$C_6$ alkyl, substituted $C_1$-$C_6$ alkyl or $C_1$-$C_6$ alkoxy;
G is H, OH, halogen or O—$[C(R_8)(R_9)]_n$—$[(C=O)_m$—$X]_j$—Z;
each $R_8$ and $R_9$ is, independently, H, halogen, $C_1$-$C_6$ alkyl or substituted $C_1$-$C_6$ alkyl;
X is O, S or $N(E_1)$;
Z is H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl or $N(E_2)(E_3)$;
$E_1$, $E_2$ and $E_3$ are each, independently, H, $C_1$-$C_6$ alkyl or substituted $C_1$-$C_6$ alkyl;
n is from 1 to about 6;
m is 0 or 1;
j is 0 or 1;
each substituted group comprises one or more optionally protected substituent groups independently selected from halogen, $OJ_1$, $N(J_1)(J_2)$, =$NJ_1$, $SJ_1$, $N_3$, CN, $OC(=L)J_1$, $OC(=L)N(J_1)(J_2)$ and $C(=L)N(J_1)(J_2)$;
L is O, S or $NJ_3$;
each $J_1$, $J_2$ and $J_3$ is, independently, H or $C_1$-$C_6$ alkyl; and when j is 1 then Z is other than halogen or $N(E_2)(E_3)$.

In one embodiment, PX0- has the structure of A-B—, wherein -B- is an internucleotidic linkage and A has the structure of Formula VIII-e, or PX0-N1- has the structure of Formula VIII-e:

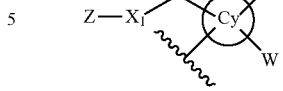

or isomers thereof, wherein

is a 4, 5, 6, 7 or 8 heterocyclic or cycloalkyl ring;
wherein
$T_1$ and $T_2$ are each independently H, OR", SR", $NQ_1Q_2$, substituted or unsubstituted aliphatic; alternatively, $T_1$ and $T_2$ can be taking together with the carbon they attached to form C=O, C=S, C=$NQ_1$; where $Q_1$ and $Q_2$ are each independently selected from H, OH, substituted or unsubstituted aliphatic, substituted or unsubstituted acyl, substituted or unsubstituted aryl, substituted or unsubstituted heteroaryl, substituted or unsubstituted heterocyclyl, and substituted or unsubstituted cycloalkyl and where R" is H, substituted or unsubstituted aliphatic, substituted or unsubstituted aryl, substituted or unsubstituted heteroaryl, substituted or unsubstituted heterocyclyl, and substituted or unsubstituted cycloalkyl;
$X_1$ is O, S, $NQ_1$, or $(CR_aR_b)_t$ wherein each $R_a$ and $R_b$ is, independently, H, F, $C_1$-$C_6$ haloalkyl, or $C_1$-$C_6$ alkyl; wherein t is 1 to 6;
Z is selected from $OP(Z_{10})Y_{10}NQ_1Q_2$, $R_{10}$, $OR_{10}$, $COR_{10}$, $CO(CR_aR_b)_tCOR_{10}$, $CO_2R_{10}$, $NR_{20}R_{30}$, $CONR_{20}R_{30}$, $CON(H)NR_{20}R_{30}$, $ONR_{20}R_{30}$, $CON(H)N=CR_{40}R_{50}$, $N(R_{20})C(=NR_{30})NR_{20}R_{30}$, $N(R_{20})C(O)NR_{20}R_{30}$, $N(R_{20})C(S)NR_{20}R_{30}$, $OC(O)NR_{20}R_{30}$, $SC(O)NR_{20}R_{30}$, $N(R_{20})C(S)OR_{10}$, $N(R_{20})C(O)OR_{10}$, $N(R_{20})C(O)SR_{10}$, $N(R_{20})N=CR_{40}R_{50}$, $ON=CR_{40}R_{50}$, $SO_2R_{10}$, $SOR_{10}$, $SR_{10}$ and substituted or unsubstituted heterocyclic, where $R_{10}$ is independently hydrogen, aliphatic, substituted or unsubstituted aliphatic, aryl, heteroaryl, or heterocyclic; $R_{20}$, $R_{30}$, $R_{40}$ and $R_{50}$ are independently selected from is hydrogen, acyl, aliphatic or substituted aliphatic, aryl, heteroaryl, heterocyclic, $OR_{10}$, $COR_{10}$, $CO_2R_{10}$, $NQ_1Q_2$; $R_{20}$ and $R_{30}$ can be taken together to form a heterocyclic ring; wherein $Y_{10}$ and $Z_{10}$ are each independently O, S, alkyl, or $NQ_1Q_2$;
B is selected from hydrogen, aliphatic, substituted aliphatic, or base; and
W is H, halogen, $OR_{10}$, $SR_{10}$, $NQ_1Q_2$, substituted or unsubstituted aliphatic, substituted or unsubstituted aryl, substituted or unsubstituted heteroaryl, substituted or unsubstituted cycloalkyl, substituted or unsubstituted heterocyclyl, protecting group, reactive phosphorus group, or oligonucleotide, where $Q_1$ and $Q_2$ are each independently selected from the group consisting of H, OH, substituted or unsubstituted aliphatic, substituted or unsubstituted acyl, substituted or unsubstituted carboxyl, substituted or unsubstituted aryl, substituted or unsubstituted heteroaryl, substituted or unsubstituted heterocyclyl, and substituted or unsubstituted cycloalkyl, and $R_{10}$ is independently H, alkyl, substituted alkyl, substituted or unsubstituted aliphatic, hydroxyl or alkoxy substituted aliphatic, aryl, arylaliphatic, hydroxyl or alkoxy substituted aryl, hydroxyl or alkoxy substituted arylaliphatic, heteroaryl, heterocyclic, hydroxyl or alkoxy substituted heteroaryl, or hydroxyl or alkoxy substituted heterocyclic.

In one embodiment, PX0- has the structure of A-B—, wherein -B- is an internucleotidic linkage and A has the structure of Formula VIII-f, or PX0-N1- has the structure of Formula VIII-f:

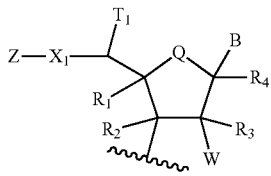

$T_1$ is selected from OR", SR", $NQ_1$, $Q_2$, and substituted or unsubstituted aliphatic, $C_1$-$C_6$ alkyl, $C_2$-$C_6$ alkenyl, substituted $C_1$-$C_6$ alkyl, substituted $C_2$-$C_6$ alkenyl or substituted $C_2$-$C_6$ alkynyl;

Q is O, S, $NQ_1$, $CR_aR_b$;

$X_1$ is absent, O, S, $NQ_1$, or $(CR_aR_b)_t$, wherein each $R_a$ and $R_1$, is, independently, H, F, $C_1$-$C_6$ haloalkyl, or $C_1$-$C_6$ alkyl; wherein t is 1 to 6;

Z is selected from H, OH, $OP(Z_{10})Y_{10}NQ_1Q_2$, $R_{10}$, $OR_{10}$, $COR_{10}$, $CO(CR_aR_b)_tCOR_{10}$, $CO_2R_{10}$, $NR_{20}R_{30}$, $CONR_{20}R_{30}$, $CON(H)NR_{20}R_{30}$, $ONR_{20}R_{30}$, $CON(H)N=CR_{40}R_{50}$, $N(R_{20})C(=NR_{30})NR_{20}R_{30}$, $N(R_{20})C(O)NR_{20}R_{30}$, $N(R_{20})C(S)NR_{20}R_{30}$, $OC(O)NR_{20}R_{30}$, $SC(O)NR_{20}R_{30}$, $N(R_{20})C(S)OR_{10}$, $N(R_{20})C(O)OR_{10}$, $N(R_{20})C(O)SR_{10}$, $N(R_{20})N=CR_{40}R_{50}$, $ON=CR_{40}R_{50}$, $SO_2R_{10}$, $SOR_{10}$, $SR_{10}$ and substituted or unsubstituted heterocyclic, where $R_{10}$ is independently hydrogen, aliphatic, substituted or unsubstituted aliphatic, aryl, heteroaryl, or heterocyclic; $R_{20}$, $R_{30}$, $R_{40}$ and $R_{50}$ are independently selected from is hydrogen, acyl, aliphatic or substituted aliphatic, aryl, heteroaryl, heterocyclic, $OR_{10}$, $COR_{10}$, $CO_2R_{10}$, $NQ_1Q_2$, $R_{20}$ and $R_{30}$ can be taken together to form a heterocyclic ring; or Z has the structure of:

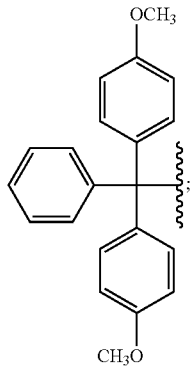

wherein $Y_{10}$ and $Z_{10}$ are each independently O, S, alkyl, or $NQ_1Q_2$;

B is selected from hydrogen, aliphatic, substituted aliphatic and base;

W is H, halogen, $OR_{10}$, $SR_{10}$, $NQ_1Q_2$, substituted or unsubstituted aliphatic, substituted or unsubstituted aryl, substituted or unsubstituted heteroaryl, substituted or unsubstituted cycloalkyl, substituted or unsubstituted heterocyclyl, protecting group, reactive phosphorus group, or oligonucleotide, where $Q_1$ and $Q_2$ are each independently selected from the group consisting of H, OH, substituted or unsubstituted aliphatic, substituted or unsubstituted acyl, substituted or unsubstituted carboxyl, substituted or unsubstituted aryl, substituted or unsubstituted heteroaryl, substituted or unsubstituted heterocyclyl, and substituted or unsubstituted cycloalkyl, and $R_{10}$ is independently H, alkyl, substituted alkyl, substituted or unsubstituted aliphatic, hydroxyl or alkoxy substituted aliphatic, aryl, arylaliphatic, hydroxyl or alkoxy substituted aryl, hydroxyl or alkoxy substituted arylaliphatic, heteroaryl, heterocyclic, hydroxyl or alkoxy substituted heteroaryl, or hydroxyl or alkoxy substituted heterocyclic; and $R_1$, $R_2$, $R_3$, and $R_4$ are each independently selected from H, halogen, OH, $C_1$-$C_6$ alkyl, $C_1$-$C_6$ haloalkyl; alternatively, two of $R_1$, $R_2$, $R_3$ and $R_4$ can be taken together to form a 5-8 membered ring, wherein the ring can optionally contain a heteroatom.

In one embodiment, PX0- has the structure of A-B—, wherein -B- is an internucleotidic linkage and A has the structure of Formula VIII-g, or PX0-N1- has the structure of Formula VIII-g:

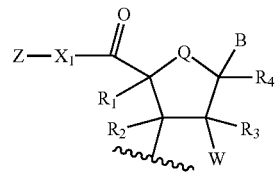

wherein:

Q is O, S, $NQ_1$, or $CR_aR_b$;

$X_1$ is absent, O, S, $NQ_1$, or $(CR_aR_b)_t$;

$R_a$ and $R_b$ are each independently H, F, $C_1$-$C_6$ haloalkyl, or $C_1$-$C_6$ alkyl;

t is 1 to 6;

Z is selected from the group consisting of $OP(Z_{10})(Y_{10})NQ_1Q_2$, $R_{10}$, $OR_{10}$, $COR_{10}$, $CO(CR_aR_b)_tCOR_{10}$, $CO_2R_{10}$, $NR_{20}R_{30}$, $CONR_{20}R_{30}$, $CON(H)NR_{20}R_{30}$, $ONR_{20}R_{30}$, $CON(H)N=CR_{40}R_{50}$, $N(R_{20})C(=NR_{30})NR_{20}R_{30}$, $N(R_{20})C(O)NR_{20}R_{30}$, $N(R_{20})C(S)NR_{20}R_{30}$, $OC(O)NR_{20}R_{30}$, $SC(O)NR_{20}R_{30}$, $N(R_{20})C(S)OR_{10}$, $N(R_{20})C(O)OR_{10}$, $N(R_{20})C(O)_SR_{10}$, $N(R_{20})N=CR_{40}R_{50}$, $ON=CR_{40}R_{50}$, $SO_2R_{10}$, $SOR_{10}$, $SR_{10}$, substituted or unsubstituted heterocyclic, Y',

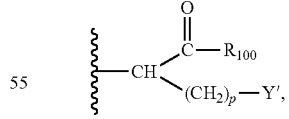

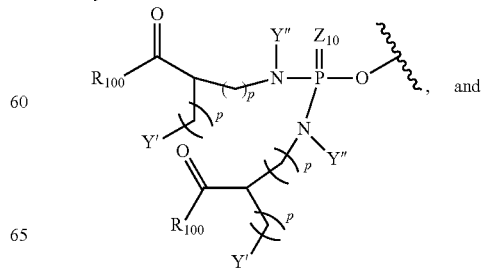

and

-continued

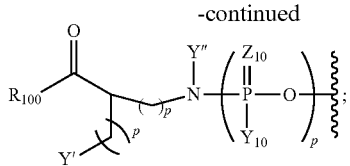

$R_{100}$ is selected from the group consisting of OH, SH, $NQ_1Q_2$, $(CH_2)_nCOR_{100}$, $(CH_2)_nNQ_1Q_2$, $(CH_2)_nOH$, $(CH_2)_nSH$, alkyl, alkoxy, aralkyl, aryl, heterocyclic, heteroaryl, cyclic alkyl, alkenyl, alkynyl, aralkenyl, and aralkynyl;

Y' and Y" are each independently H, OH, $OR_{10}$, $(CH_2)_nOH$, SH, $(CH_2)_nSCH_3$, $(CH_2)_nSH$, $COR_{100}$, $(CH_2)_nCOR_{100}$, $(CH_2)_nCONQ_1Q_2$, $(CH_2)_nNQ_1Q_2$, $(CH_2)_nNHC(=NQ_1)NQ_2$, $(CH_2)_nCONQ_1Q_2$, $OP(Z_{10})(Y_{10})NQ_1Q_2$, $OP(Z_{10})(X_{10})Y_{10}$, linear or branched aliphatic, hydroxyl or alkoxy substituted aliphatic, aryl, arylalkyl, hydroxyl or alkoxy substituted aryl, hydroxyl or alkoxy substituted arylakyl, heteroaryl, heterocyclic, hydroxyl or alkoxy substituted heteroaryl, or hydroxyl or alkoxy substituted heterocyclic;

p is 0-10;

$R_{10}$ is independently H, alkyl, substituted alkyl, substituted or unsubstituted aliphatic, hydroxyl or alkoxy substituted aliphatic, aryl, arylaliphatic, hydroxyl or alkoxy substituted aryl, hydroxyl or alkoxy substituted arylaliphatic, heteroaryl, heterocyclic, hydroxyl or alkoxy substituted heteroaryl, or hydroxyl or alkoxy substituted heterocyclic;

$R_{20}$, $R_{30}$, $R_{40}$ and $R_{50}$ are each independently selected from the group consisting of hydrogen, acyl, aliphatic or substituted aliphatic, aryl, heteroaryl, heterocyclic, $OR_{10}$, $COR_{10}$, $CO_2R_{10}$, and $NQ_1Q_2$; or $R_{20}$ and $R_{30}$ can be taken together to form a heterocyclic ring; or Z has the structure of:

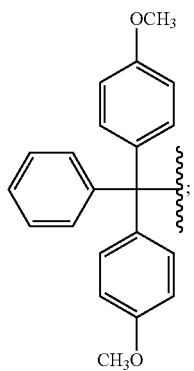

$Y_{10}$ and $Z_{10}$ are each independently O, S, alkyl, or $NQ_1Q_2$;
B is selected from the group consisting of hydrogen, aliphatic, substituted aliphatic and base;
W is H, halogen, $OR_{10}$, $SR_{10}$, $NQ_1Q_2$, substituted or unsubstituted aliphatic, substituted or unsubstituted aryl, substituted or unsubstituted heteroaryl, substituted or unsubstituted cycloalkyl, substituted or unsubstituted heterocyclyl, protecting group, reactive phosphorus group, or oligonucleotide, where $Q_1$ and $Q_2$ are each independently selected from the group consisting of H, OH, substituted or unsubstituted aliphatic, substituted or unsubstituted acyl, substituted or unsubstituted carboxyl, substituted or unsubstituted aryl, substituted or unsubstituted heteroaryl, substituted or unsubstituted heterocyclyl, and substituted or unsubstituted cycloalkyl, and $R_{10}$ is independently H, alkyl, substituted alkyl, substituted or unsubstituted aliphatic, hydroxyl or alkoxy substituted aliphatic, aryl, arylaliphatic, hydroxyl or alkoxy substituted aryl, hydroxyl or alkoxy substituted arylaliphatic, heteroaryl, heterocyclic, hydroxyl or alkoxy substituted heteroaryl, or hydroxyl or alkoxy substituted heterocyclic;

$R_1$, $R_2$, $R_3$, and $R_4$ are each independently selected from the group consisting of H, halogen, OH, $C_1$-$C_6$ alkyl, and $C_1$-$C_6$ haloalkyl; or two of $R_1$, $R_2$, $R_3$ and $R_4$ can be taken together to form a 5-8 membered ring, wherein the ring can optionally contain a heteroatom; and $Q_1$ and $Q_2$ are each independently selected from the group consisting of H, OH, substituted or unsubstituted aliphatic, substituted or unsubstituted acyl, substituted or unsubstituted carboxyl, substituted or unsubstituted aryl, substituted or unsubstituted heteroaryl, substituted or unsubstituted heterocyclyl, and substituted or unsubstituted cycloalkyl.

In one embodiment, PX0- has the structure of A-B—, wherein -B- is an internucleotidic linkage and A has the structure of Formula VIII-h, or PX0-N1- has the structure of Formula VIII-h:

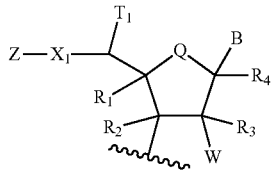

VIII-h $T_1$ is selected from the group consisting of OR", SR", $NQ_1Q_2$, and substituted or unsubstituted aliphatic; R' and R" are each independently H, substituted or unsubstituted aliphatic, substituted or unsubstituted aryl, substituted or unsubstituted heteroaryl, substituted or unsubstituted heterocyclyl, and substituted or unsubstituted cycloalkyl;

Q is O, S, $NQ_1$, or $CR_aR_b$;
$X_t$ is absent, O, S, $NQ_1$, or $(CR_aR_b)_t$;
$R_a$ and $R_b$ each are independently H, F, $C_1$-$C_6$ haloalkyl, or $C_1$-$C_6$ alkyl;
t is 1 to 6;
Z is selected from the group consisting of $OP(Z_{10})(Y_{10})NQ_1Q_2$, $R_{10}$, $OR_{10}$, $COR_{10}$, $CO(CR_aR_b)_1COR_{10}$, $CO_2R_{10}$, $NR_{20}R_{30}$, $CONR_{20}R_{30}$, $CON(H)NR_{20}R_{30}$, $ONR_{20}R_{30}$, $CON(H)N=CR_{40}R_{50}$, $N(R_{20})C(=NR_{30})NR_{20}R_{30}$, $N(R_{20})C(O)NR_{20}R_{30}$, $N(R_{20})C(S)NR_{20}R_{30}$, $OC(O)NR_{20}R_{30}$, $SC(O)NR_{20}R_{30}$, $N(R_{20})C(S)OR_{10}$, $N(R_{20})C(O)OR_{10}$, $N(R_{20})C(O)_SR_{10}$, $N(R_{20})N=CR_{40}R_{50}$, $ON=CR_{40}R_{50}$, $SO_2R_{10}$, $SOR_{10}$, $SR_{10}$, substituted or unsubstituted heterocyclic, Y',

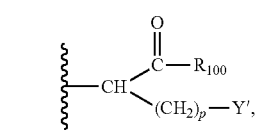

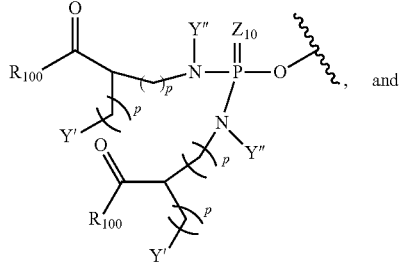 and

-continued

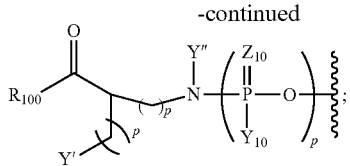

$R_{100}$ is selected from the group consisting of OH, SH, $NQ_1Q_2$, $(CH_2)_nCOR_{100}$, $(CH_2)_nNQ_1Q_2$, $(CH_2)_nOH$, $(CH_2)_nSH$, alkyl, alkoxy, aralkyl, aryl, heterocyclic, heteroaryl, cyclic alkyl, alkenyl, alkynyl, aralkenyl, and aralkynyl;

Y' and Y" are each independently H, OH, $OR_{IN}$, $(CH_2)_nOH$, SH, $(CH_2)_nSCH_3$, $(CH_2)_nSH$, $COR_{100}$, $(CH_2)_nCOR_{100}$, $(CH_2)_nCONQ_1Q_2$, $(CH_2)_nQ_1Q_2$, $(CH_2)_nNHC(=NQ_1)NO_2$, $(CH_2)_nCONQ_1Q_2$, $OP(Z_{10})(Y_{10})NQ_1Q_2$, $OP(Z_{10})(X_{10})Y_{10}$, linear or branched aliphatic, hydroxyl or alkoxy substituted aliphatic, aryl, arylalkyl, hydroxyl or alkoxy substituted aryl, hydroxyl or alkoxy substituted arylakyl, heteroaryl, heterocyclic, hydroxyl or alkoxy substituted heteroaryl, or hydroxyl or alkoxy substituted heterocyclic;

p is 0-10;

$R_{10}$ is independently H, alkyl, substituted alkyl, substituted or unsubstituted aliphatic, hydroxyl or alkoxy substituted aliphatic, aryl, arylaliphatic, hydroxyl or alkoxy substituted aryl, hydroxyl or alkoxy substituted arylaliphatic, heteroaryl, heterocyclic, hydroxyl or alkoxy substituted heteroaryl, or hydroxyl or alkoxy substituted heterocyclic;

$R_{20}$, $R_{30}$, $R_{40}$ and $R_{50}$ are each independently selected from the group consisting of hydrogen, acyl, aliphatic or substituted aliphatic, aryl, heteroaryl, heterocyclic, $OR_{10}$, $COR_{10}$, $CO_2R_{10}$, and $NQ_1Q_2$; or $R_{20}$ and $R_{30}$ can be taken together to form a heterocyclic ring; or Z has the structure of:

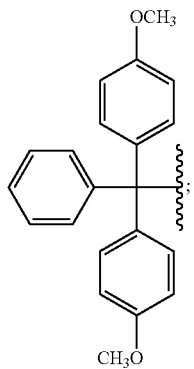

$Y_{10}$ and $Z_{10}$ are each independently O, S, alkyl, or $NQ_1Q_2$;
B is selected from the group consisting of hydrogen, aliphatic, substituted aliphatic and base;
W is H, halogen, $OR_{10}$, $SR_{10}$, $NQ_1Q_2$, substituted or unsubstituted aliphatic, substituted or unsubstituted aryl, substituted or unsubstituted heteroaryl, substituted or unsubstituted cycloalkyl, substituted or unsubstituted heterocyclyl, protecting group, reactive phosphorus group, or oligonucleotide, where $Q_1$ and $Q_2$ are each independently selected from the group consisting of H, OH, substituted or unsubstituted aliphatic, substituted or unsubstituted acyl, substituted or unsubstituted carboxyl, substituted or unsubstituted aryl, substituted or unsubstituted heteroaryl, substituted or unsubstituted heterocyclyl, and substituted or unsubstituted cycloalkyl, and $R_{10}$ is independently H, alkyl, substituted alkyl, substituted or unsubstituted aliphatic, hydroxyl or alkoxy substituted aliphatic, aryl, arylaliphatic, hydroxyl or alkoxy substituted aryl, hydroxyl or alkoxy substituted arylaliphatic, heteroaryl, heterocyclic, hydroxyl or alkoxy substituted heteroaryl, or hydroxyl or alkoxy substituted heterocyclic; and $R_1$, $R_2$, $R_3$, and $R_4$ are each independently selected from the group consisting of H, halogen, OH, $C_1$-$C_6$ alkyl, and $C_1$-$C_6$ haloalkyl; or two of $R_1$, $R_2$, $R_3$ and $R_4$ can be taken together to form a 5-8 membered ring, wherein the ring can optionally contain a heteroatom; and $Q_1$ and $Q_2$ are each independently selected from the group consisting of H, OH, substituted or unsubstituted aliphatic, substituted or unsubstituted acyl, substituted or unsubstituted carboxyl, substituted or unsubstituted aryl, substituted or unsubstituted heteroaryl, substituted or unsubstituted heterocyclyl, and substituted or unsubstituted cycloalkyl.

In some embodiments, PX0- has the structure of A-B—, wherein -B- is an internucleotidic linkage and A has the structure of Formula VIII-i or VIII-j, or PX0-N1- has the structure of Formula VIII-i or VIII-j:

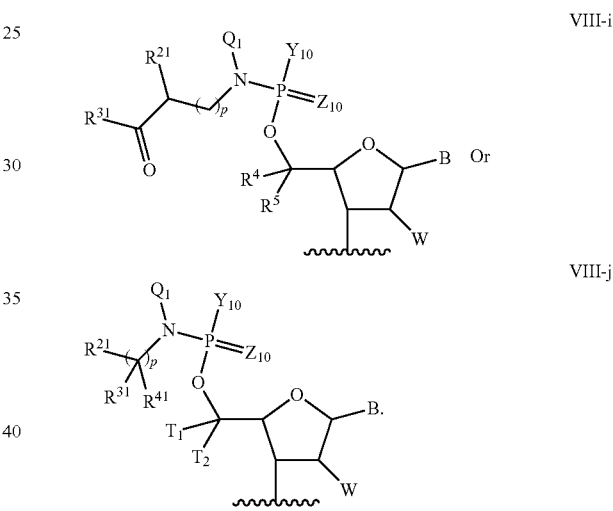

In Formula VIII-i and VIII-j:
$Y_{10}$ and $Z_{10}$ are each independently O, OH, S, SH, alkyl, hydroxyl, alkoxy, cyanoalkyl, cyanoalkoxy, $NQ_1$ or $NQ_1Q_2$
B is a base;
Configuration independently at C1', C2' or C3' position is alpha or beta or combination thereof; The asymmetric position(s) is (are) independently R, S, racemic or combination thereof p is 0-6; $R^4$ to $R^{41}$ is independently selected from H, OH, SH, $NQ_1Q_2$, $(CH_2)_nCOR^3$, $(CH_2)_nN(R')(R")$, $(CH_2)_nOH$; $(CH_2)_nSH$, alkyl, aralkyl, aryl, heterocyclic, cyclic alkyl, alkenyl, alkynyl, aralkenyl, aralkynyl, where n is 1-10;
$T_1$ and $T_2$ are each independently H, OR", SR", $NQ_1Q_2$, substituted or unsubstituted aliphatic; alternatively, $T_1$ and $T_2$ can be taking together with the carbon they attached to form C=O, C=S, C=$NQ_1$;
$Q_1$ and $Q_2$ are each independently selected from H, OH, substituted or unsubstituted aliphatic, substituted or unsubstituted acyl, substituted or unsubstituted aryl, substituted or unsubstituted heteroaryl, substituted or unsubstituted heterocyclyl, and substituted or unsubstituted cycloalkyl and where R" is H, substituted or unsubstituted aliphatic, substituted or unsubstituted aryl, substituted or unsubstituted heteroaryl, substituted or unsubstituted heterocyclyl, and substituted or unsubstituted cycloalkyl; and W is H, halogen, $OR_{10}$, $SR_{10}$, $NQ_1Q_2$, substituted or unsubstituted aliphatic, substituted or unsubstituted aryl, substituted or unsubstituted heteroaryl, substituted or unsubstituted cycloalkyl, substituted or unsubstituted heterocyclyl, protecting group, reactive phosphorus group, or oligonucleotide, where $Q_1$ and $Q_2$ are each independently selected from the group consisting of H, OH, substituted or unsubstituted aliphatic, substituted or unsubstituted acyl, substituted or unsubstituted carboxyl, substituted or unsubstituted aryl, substituted or unsubstituted heteroaryl, substituted or unsubstituted heterocyclyl, and substituted or unsubstituted cycloalkyl, and $R_{10}$ is independently H, alkyl, substituted alkyl, substituted or unsubstituted aliphatic, hydroxyl or alkoxy substituted aliphatic, aryl, arylaliphatic, hydroxyl or alkoxy substituted aryl, hydroxyl or alkoxy substituted arylaliphatic, heteroaryl, heterocyclic, hydroxyl or alkoxy substituted heteroaryl, or hydroxyl or alkoxy substituted heterocyclic.

In some embodiments, PX0- has the structure of A-B—, wherein -B- is an internucleotidic linkage and A has the structure of Formula VIII-k or VIII-l, or PX0-N1- has the structure of Formula VIII-k or VIII-l:

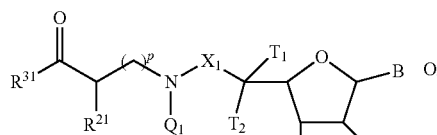

VIII-k

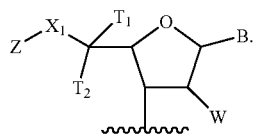

VIII-l

In Formulae VIII-k and VIII-l:

$X_1$ is absent, C(O), —P(O)(YM)-O—, —C(O)(CH$_2$)$_n$C(O)—, $(CR_aR_b)_n$, wherein n is 1-10.

Z is selected from H, natural and un-natural a-amino acids with D and L stereochemistry, peptides, substituted amines, carboxylic acids, amino acid, hydroxy acids, oligo and polyamines;

$T_1$ and $T_2$ are each independently H, OR", SR", $NQ_1Q_2$, substituted or unsubstituted aliphatic; alternatively, $T_1$ and $T_2$ can be taking together with the carbon they attached to form C=O, C=S, C=$NQ_1$; and $T_1$ and $T_2$ are each independently H, OR", SR", $NQ_1Q_2$, substituted or unsubstituted aliphatic; alternatively, $T_1$ and $T_2$ can be taking together with the carbon they attached to form C=O, C=S, C=$NQ_1$, and W is H, halogen, $OR_{10}$, $SR_{10}$, $NQ_1Q_2$, substituted or unsubstituted aliphatic, substituted or unsubstituted aryl, substituted or unsubstituted heteroaryl, substituted or unsubstituted cycloalkyl, substituted or unsubstituted heterocyclyl, protecting group, reactive phosphorus group, or oligonucleotide, where $Q_1$ and $Q_2$ are each independently selected from the group consisting of H, OH, substituted or unsubstituted aliphatic, substituted or unsubstituted acyl, substituted or unsubstituted carboxyl, substituted or unsubstituted aryl, substituted or unsubstituted heteroaryl, substituted or unsubstituted heterocyclyl, and substituted or unsubstituted cycloalkyl, and $R_{10}$ is independently H, alkyl, substituted alkyl, substituted or unsubstituted aliphatic, hydroxyl or alkoxy substituted aliphatic, aryl, arylaliphatic, hydroxyl or alkoxy substituted aryl, hydroxyl or alkoxy substituted arylaliphatic, heteroaryl, heterocyclic, hydroxyl or alkoxy substituted heteroaryl, or hydroxyl or alkoxy substituted heterocyclic.

In some embodiments, PX0- has the structure of A-B—, wherein -B- is an internucleotidic linkage and A has the structure of any of Formulae VIII-m, VIII-n, VIII-o, or VIII-p, or PX0-N1- has the structure of any of Formulae VIII-m, VIII-n, VIII-o, or VIII-p:

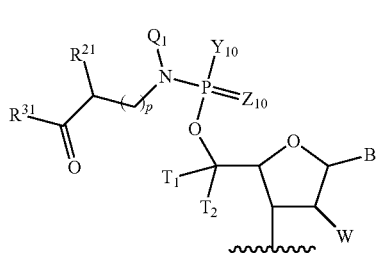

VIII-m

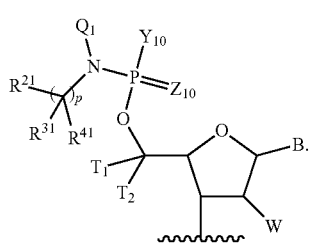

VIII-n

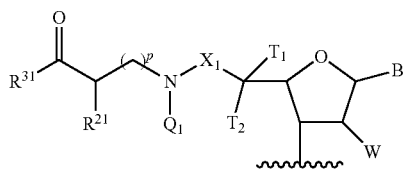

VIII-o

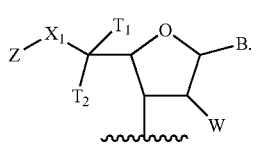

VIII-p

In Formulae VIII-m, VIII-n, VIII-o, or VIII-p:

$T_1$ and $T_2$ are each independently selected from the group consisting of H, OR", SR", $NQ_1Q_2$, and substituted or unsubstituted aliphatic;

R' and R" are each independently H, substituted or unsubstituted aliphatic, substituted or unsubstituted aryl, substituted or unsubstituted heteroaryl, substituted or unsubstituted heterocyclyl, and substituted or unsubstituted cycloalkyl;

$X_1$ is absent, O, S, $NQ_1$, or $(CR_aR_b)_t$;

$R_a$ and $R_b$ each are independently H, F, $C_1$-$C_6$ haloalkyl, or $C_1$-$C_6$ alkyl;

t is 1 to 6;

Z is selected from the group consisting of $OP(Z_{10})(Y_{10})$ $NQ_1Q_2$, $R_{10}$, $OR_{10}$, $COR_{10}$, $CO(CR_aR_b)_tCOR_{10}$, $CO_2R_{10}$, $NR_{20}R_{30}$, $CONR_{20}R_{30}$, $CON(H)NR_{20}R_{30}$, $ONR_{20}R_{30}$, $CON(H)N=CR_{40}R_{50}$, $N(R_{20})C(=NR_{30})NR_{20}R_{30}$, $N(R_{20})C(O)$ $NR_{20}R_{30}$, $N(R_{20})C(S)NR_{20}R_{30}$, $OC(O)NR_{20}R_{30}$, $SC(O)$ $NR_{20}R_{30}$, $N(R_{20})C(S)OR_{10}$, $N(R_{20})C(O)OR_{10}$, $N(R_{20})C$ $(O)_5R_{10}$, $N(R_{20})N=CR_{40}R_{50}$, $ON=CR_{40}R_{50}$, $SO_2R_{10}$, $SOR_{10}$, $SR_{10}$, substituted or unsubstituted heterocyclic, Y',

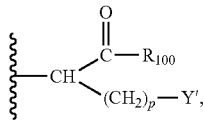

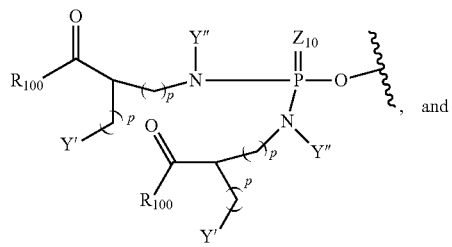, and

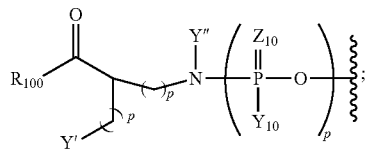;

$R_{100}$ is selected from the group consisting of OH, SH, $NQ_1Q_2$, $(CH_2)_nCOR_{100}$, $(CH_2)_nNQ_1Q_2$, $(CH_2)_nOH$, $(CH_2)_nSH$, alkyl, alkoxy, aralkyl, aryl, heterocyclic, heteroaryl, cyclic alkyl, alkenyl, alkynyl, aralkenyl, and aralkynyl;

Y' and Y" are each independently H, OH, $OR_{IN}$, $(CH_2)_nOH$, SH, $(CH_2)_nSCH_3$, $(CH_2)_nSH$, $COR_{100}$, $(CH_2)_nCOR_{100}$, $(CH_2)_{11}CONQ_1Q_2$, $(CH_2)_nNQ_1Q_2$, $(CH_2)_nNHC(=NO_1)NO_2$, $(CH_2)_{11}CONQ_1Q_2$, $OP(Z_{10})(Y_{10})NQ_1Q_2$, $OP(Z_{10})(X_{10})Y_{10}$, linear or branched aliphatic, hydroxyl or alkoxy substituted aliphatic, aryl, arylalkyl, hydroxyl or alkoxy substituted aryl, hydroxyl or alkoxy substituted arylakyl, heteroaryl, heterocyclic, hydroxyl or alkoxy substituted heteroaryl, or hydroxyl or alkoxy substituted heterocyclic;

$R_{10}$ is independently H, alkyl, substituted alkyl, substituted or unsubstituted aliphatic, hydroxyl or alkoxy substituted aliphatic, aryl, arylaliphatic, hydroxyl or alkoxy substituted aryl, hydroxyl or alkoxy substituted arylaliphatic, heteroaryl, heterocyclic, hydroxyl or alkoxy substituted heteroaryl, or hydroxyl or alkoxy substituted heterocyclic;

$R_{20}$, $R_{30}$, $R_{40}$ and $R_{50}$ are each independently selected from the group consisting of hydrogen, acyl, aliphatic or substituted aliphatic, aryl, heteroaryl, heterocyclic, $OR_{10}$, $COR_{10}$, $CO_2R_{10}$, and $NQ_1Q_2$; or $R_{20}$ and $R_{30}$ can be taken together to form a heterocyclic ring;

$X_{10}$, $Y_{10}$ and $Z_{10}$ are each independently absent, O, S, alkyl, hydroxyl, alkoxy, cyanoalkyl, cyanoalkoxy, $NQ_1$ or $NQ_1Q_2$;

B is selected from the group consisting of hydrogen, aliphatic, substituted aliphatic and base;

W is H, halogen, $OR_{10}$, $SR_{10}$, $NQ_1Q_2$, substituted or unsubstituted aliphatic, substituted or unsubstituted aryl, substituted or unsubstituted heteroaryl, substituted or unsubstituted cycloalkyl, substituted or unsubstituted heterocyclyl, protecting group, reactive phosphorus group, or oligonucleotide, where $Q_1$ and $Q_2$ are each independently selected from the group consisting of H, OH, substituted or unsubstituted aliphatic, substituted or unsubstituted acyl, substituted or unsubstituted carboxyl, substituted or unsubstituted aryl, substituted or unsubstituted heteroaryl, substituted or unsubstituted heterocyclyl, and substituted or unsubstituted cycloalkyl, and $R_{10}$ is independently H, alkyl, substituted alkyl, substituted or unsubstituted aliphatic, hydroxyl or alkoxy substituted aliphatic, aryl, arylaliphatic, hydroxyl or alkoxy substituted aryl, hydroxyl or alkoxy substituted arylaliphatic, heteroaryl, heterocyclic, hydroxyl or alkoxy substituted heteroaryl, or hydroxyl or alkoxy substituted heterocyclic;

$Q_1$ and $Q_2$ are each independently selected from the group consisting of H, OH, substituted or unsubstituted aliphatic, substituted or unsubstituted acyl, substituted or unsubstituted carboxyl, substituted or unsubstituted aryl, substituted or unsubstituted heteroaryl, substituted or unsubstituted heterocyclyl, and substituted or unsubstituted cycloalkyl;

$R_{21}$, $R_{31}$ and $R_{41}$ are each independently selected from the group consisting of OH, SH, $NQ_1Q_2$, $(CH_2)_nCOR_{31}$, $(CH_2)_nNQ_1Q_2$, $(CH_2)_nOH$, $(CH_2)_nSH$, alkyl, alkoxy, aralkyl, aryl, heterocyclic, cyclic alkyl, alkenyl, alkynyl, aralkenyl, and aralkynyl;

n is 1-10; and p is 0-10.

In some embodiments, Z of the above formula can be selected from natural and un-natural a-amino acids with D and L stereochemistry, peptides, substituted amines, carboxylic acids, amino acid, hydroxy acids, oligo and polyamines.

In some embodiments, $T_1$, $T_2$, R' and R" can be each independently H, alkyl, or alkoxy.

In some embodiments, Y' and Y" can be OH, $OR_{100}$, $(CH_2)_nOH$, SH, $(CH_2)_nSCH_3$, $(CH_2)_nSH$, $COR_{100}$, $(CH_2)_nCOR_{100}$, $(CH_2)_nCONQ_1Q_2$, $(CH_2)_nNQ_1Q_2$, $(CH_2)_nNHC(=NQ_1)NQ_2$, $(CH_2)_nCONQ_1Q_2$, $OP(Z_{10})(Y_{10})NQ_1Q_2$, $OP(Z_{10})(X_{10})Y_{10}$, linear or branched alkyl, aryl, hydroxyl or alkoxy substituted aryl, heteroaryl, or heterocyclic. In some embodiments, Y' and Y" can be independently for each occurrence Y' is $(CH_2)_nOH$, $(CH_2)_nSCH_3$, $(CH_2)_nSH$, $COR_{100}$, $(CH_2)_nCOR_{100}$, $(CH_2)_nNQ_1Q_2$, $OP(Z_{10})(Y_{10})NQ_1Q_2$, $OP(Z_{10})(X_{10})Y_{10}$, linear or branched alkyl, aryl, heteroaryl, or heterocyclic.

In some embodiments, n can be 1-4.

In some embodiments, p can be 0-6.

In some embodiments, $R_{100}$ can be OH or alkoxy.

In some embodiments, W can be H, OH, alkoxy, alkoxy substituted alkoxy, protecting group, reactive phosphorus group, or oligonucleotide.

In some embodiments, $Z_1$ can be H, OH, alkoxy, alkoxy substituted alkoxy, protecting group, reactive phosphorus group or oligonucleotide.

In some embodiments, the protecting group is a hydroxyl protecting group selected from the group consisting of acetyl, benzyl, t-butyldimethylsilyl, t-butyldiphenylsilyl, trityl, monomethoxytrityl, and dimethoxytrityl.

In some embodiments, the reactive phosphorus group can be selected from the group consisting of phosphoramidite, H-phosphonate, alkyl-phosphonate, and phosphate triester.

In some embodiments, $Z_1$ is a phosphoramidite.

In some embodiments, $Z_1$ is an oligonucleotide.

In some embodiments, PX0- has the structure of A-B—, wherein -B- is an internucleotidic linkage and A has the structure of Formula VIII-q, or PX0-N1- has the structure of Formula VIII-q:

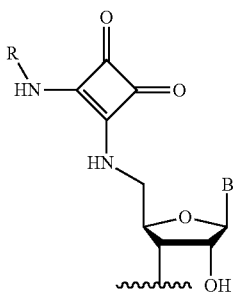

VIII-q

R is H, halogen, phosphate group, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl, substituted $C_2$-$C_6$ alkynyl, benzyl, 3-hydroxyphenyl, n-butyl, 4-fluorobenzyl, 3-nitrophenyl, 4-methoxybenzyl, pyridin-4-ylmethyl, 5-methylfuran-2-ylmethyl, or 4-methylbenzyl; and B is a base.

In some embodiments, PX0- has the structure of A-B—, wherein -B- is an internucleotidic linkage and A has the structure of any of: 3omeU, 3fU, 3daraT, 3rT, vmoeT or v3dT, or PX0-N1- has the structure of any of: 3omeU, 3fU, 3daraT, 3rT, vmoeT or v3dT:

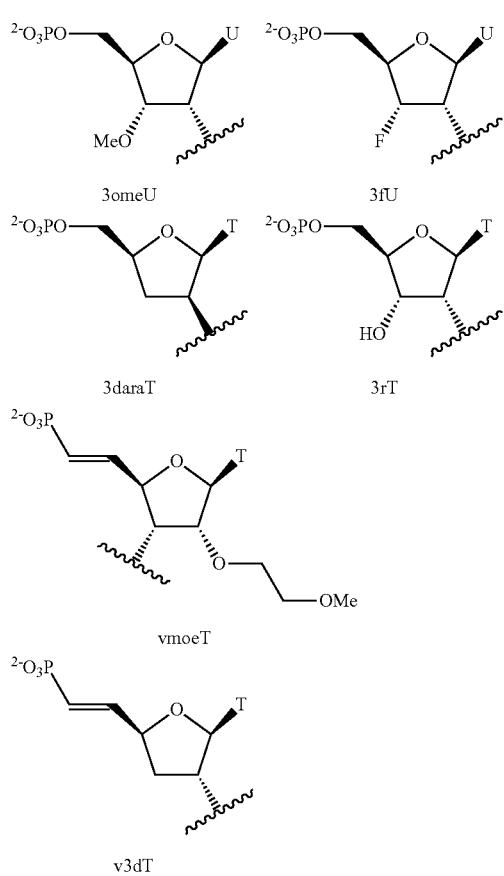

In some embodiments of 3omeU, 3fU, 3daraT, 3rT, vmoeT and v3dT, the nucleobase T or U is substituted with a different base.

In some embodiments, PX0- has the structure of A-B—, wherein -B- is an internucleotidic linkage and A has the structure of any of: 5'-OH, 5'-OMe, 5'H, or 5'-F, or PX0-N1- has the structure of any of:

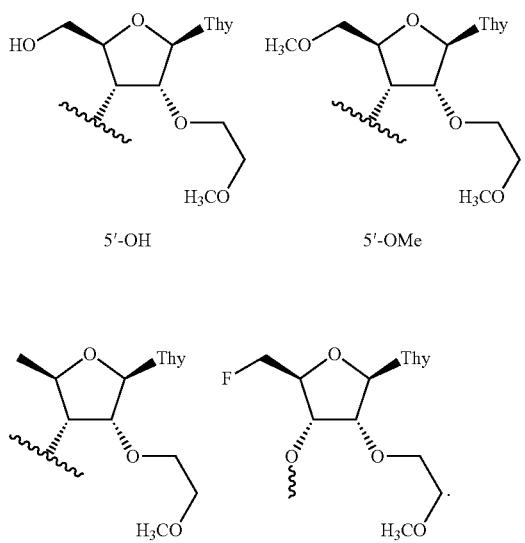

In some embodiments, PX0- has the structure of A-B—, wherein -B- is an internucleotidic linkage and A has the structure of any of: (R)-5'-MeOMe-P, (S)-5'-F-Me-P, (R)-5'-NH$_2$-Me-P, or (S)-5'-Carboxy-P, or PX0-N1- has the structure of any of (R)-5'-MeOMe-P, (S)-5'-F-Me-P, (R)-5'-NH$_2$-Me-P, or (S)-5'-Carboxy-P:

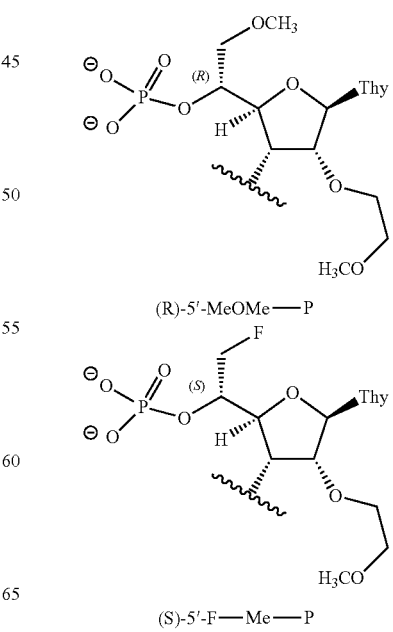

-continued

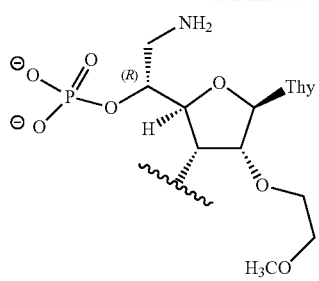

(R)-5'-NH₂—Me—P

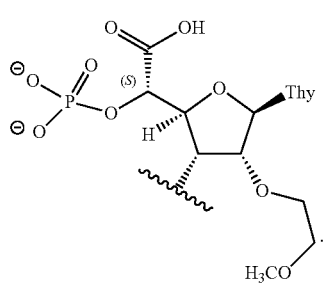

(S)-5'-Carboxy-P

In some embodiments, PX0- has the structure of A-B—, wherein -B- is an internucleotidic linkage and A has the structure of any of: (E)-5'-VP, (Z)-5'-VP, (E)-5'-F-VP, or (Z)-5'-F-VP, or PX0-N1- has the structure of any of: (E)-5'-VP, (Z)-5'-VP, (E)-5'-F-VP, or (Z)-5'-F-VP:

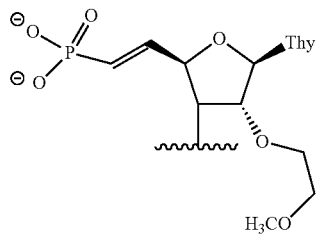

(E)-5'-VP

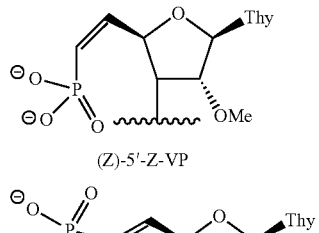

(Z)-5'-Z-VP

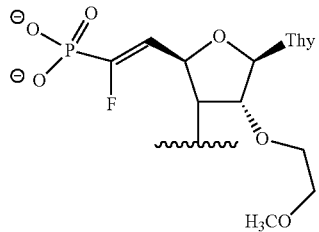

(E)-5'-F-VP

-continued

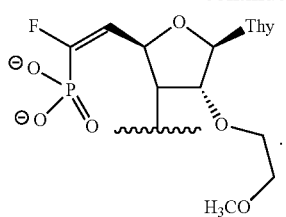

(Z)-5'-F-VP

In some embodiments, PX0- has the structure of A-B—, wherein -B- is an internucleotidic linkage and A has the structure of any of, or PX0-N1- has the structure of any of:

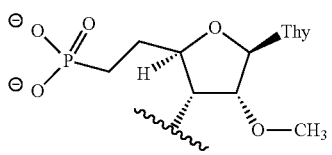

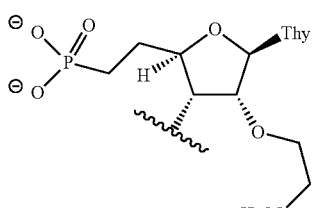

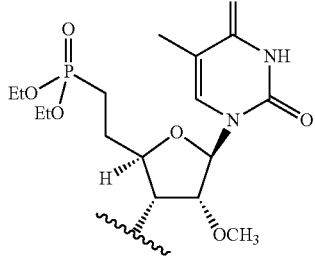

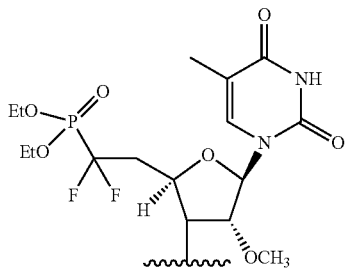

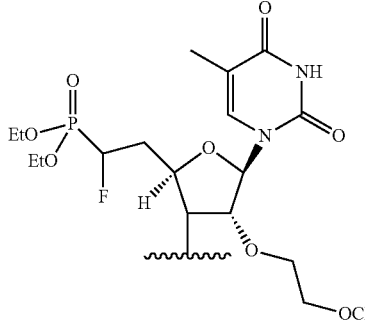

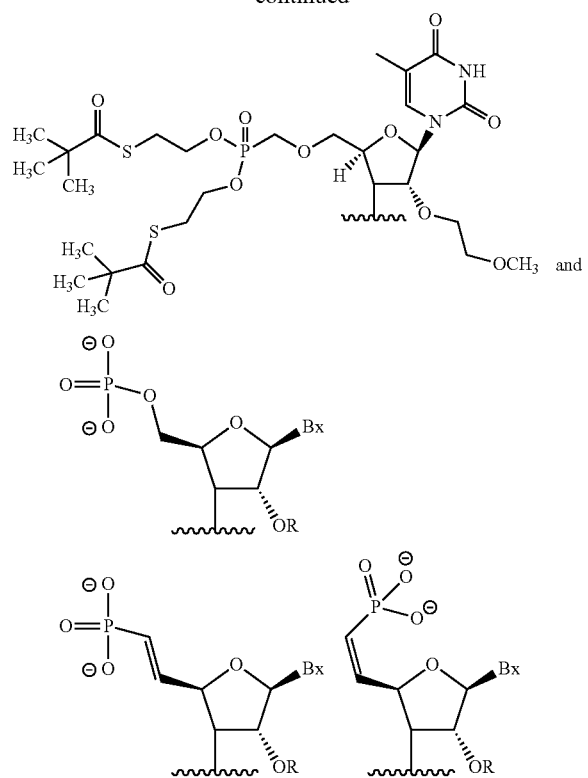
and
Bx is a base.
In some embodiments, PX0- has the structure of A-B—, wherein -B- is an internucleotidic linkage and A has the structure of any of, or PX0-N1- has the structure of any of:
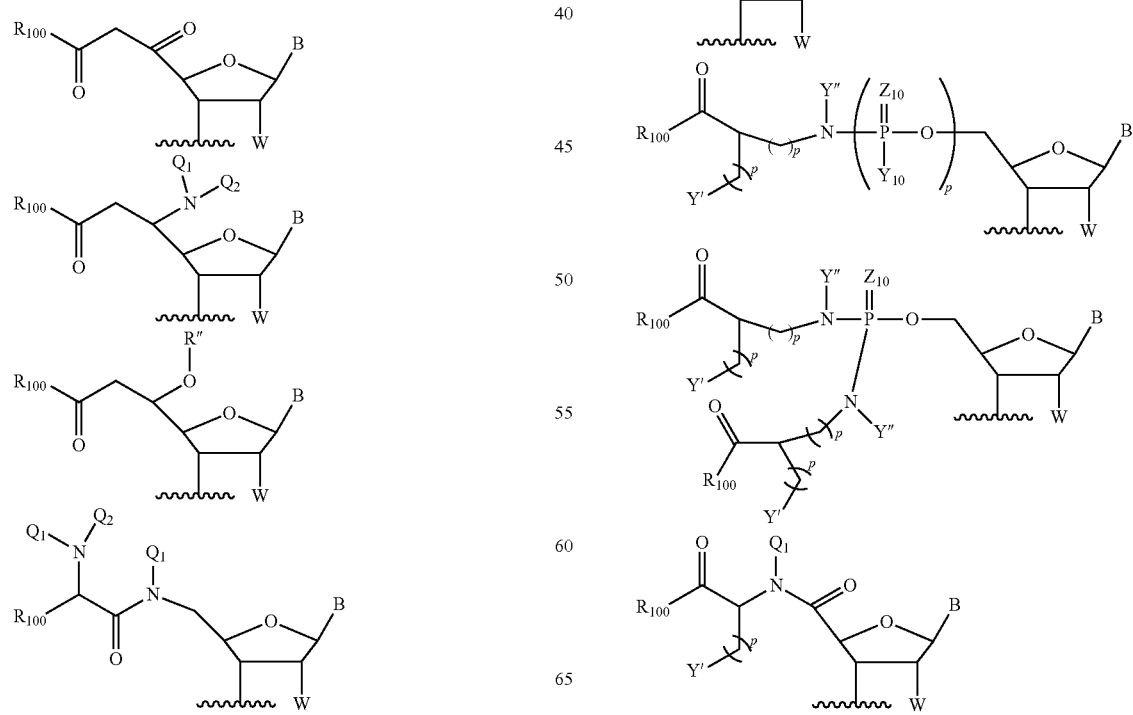

-continued

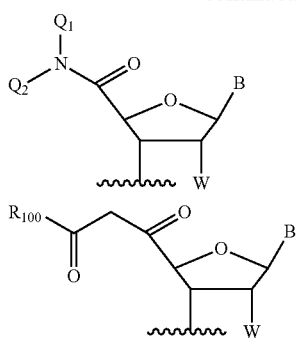

$R_{10}$, $R_{100}$, $Q_1$, $Q_2$, B, W, Y', Y", p, R" are as defined in Formula VIII-h.

In some embodiments, PX0- has the structure of A-B—, wherein -B- is an internucleotidic linkage and A has the structure of any of, or PX0-N1- has the structure of any of:

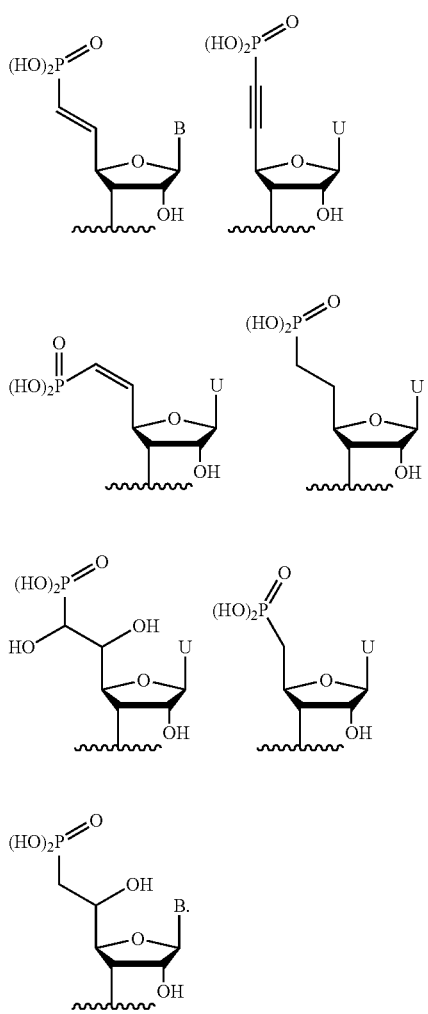

In some embodiments, PX0- has the structure of A-B—, wherein -B- is an internucleotidic linkage and A has the structure of, or PX0-N1- has the structure of:

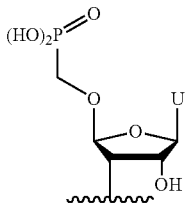

In some embodiments, PX0- comprises or consists of any of: 5'-monophosphate ((HOMO)P-O-5'), 5'-diphosphate ((HO)2(O)P—O—P(HO)(O)-O-5'), 5'-triphosphate((HO)2 (O)P-O-(HO)(O)P—O—P(HO) (O)-O-5'), 5'-guanosine cap (7-methylated or non-methylated) (7m-G-O-5'-(HO)(O)P—O-(HO)(O)P—O—P(HO) 30 (O)-O-5'), 5'-adenosine cap. (Appp), and any modified or unmodified nucleotide cap structure (N-O-5'-(HO)(O)P0-(HO)(O)P—O—P(HO)(O)-O-5'), 5'-monothiophosphate (phosphorothioate; (HOMS)P-O-5'), 5'-monodithiophosphate (phosphorodithioate; (HO)(HS)(S)P-O-5'), 35 5'-phosphorothiolate ((HOMO)P-S-5'); any additional combination of oxygen/sulfur replaced monophosphate, diphosphate and triphosphates (e.g. 5'-alpha-thiotriphosphate, 5'-gamma-thiotriphosphate, etc.), 5'-phosphoramidates ((HOMO)P-NH-5', (HO) (NH$_2$)(O)P-0-5'), 40 5'-alkylphosphonates (R=alkyl=methyl, ethyl, isopropyl, propyl, etc., e.g. RP(OH)(0)-O-5'-, (OHMO)P-5'-CH$_2$-), 5'-alkyletherphosphonates (R=alkylether=methoxymethyl (MeOCH2-), ethoxymethyl, etc., e.g. RP(OH)(0)-0-5'-).

In some embodiments, PX0- comprises or consists of a phosphate, modified phosphate, phosphate analog, 5'-nucleoside, modified 5'-nucleoside or 5'-nucleoside analog, or, 5'-nucleotide, modified 5'-nucleotide or 5'-nucleotide analog, and —N1- comprises or consists of a Morpholino, bridged Morpholino or cyclohexenyl.

In some embodiments, a nucleotide is a cyclohexenyl or a bridged Morpholino.

Bridged Morpholinos and cyclohexenyl nucleotides and nucleosides are described in, for example, published patent application US 2016-0186175 A1.

In some embodiments, a 5'-end comprises a phosphate-comprising moiety wherein the phosphate is a chiral center.

In various 5'-ends described herein, the phosphate is a chiral center.

In some embodiments, a 5'-end comprises a phosphate-comprising moiety wherein the phosphate is a chiral center, wherein the phosphate is a stereorandom mixture.

In some embodiments, a 5'-end comprises a phosphate-comprising moiety wherein the phosphate is a chiral center, wherein the phosphate is stereocontrolled.

In some embodiments, a 5'-end comprises a phosphate-comprising moiety wherein the phosphate is a chiral center, wherein the phosphate is stereocontrolled and in the Sp configuration.

In some embodiments, a 5'-end comprises a phosphate-comprising moiety wherein the phosphate is a chiral center, wherein the phosphate is stereocontrolled and in the Rp configuration.

Various 5'-ends suitable for a provided single-strand RNAi agent are described in, for example, EP 1520022 B1.

In some embodiments of a single-stranded RNAi agent, PX0- has the structure of: Formula IV-i (PH).

In some embodiments of a single-stranded RNAi agent, PX0- has the structure of: Formula IV-j (PS).

In some embodiments of a single-stranded RNAi agent, PX0- has the structure of: Formula IV-a (n-propyl, C3 PO or Mod022).

In some embodiments of a single-stranded RNAi agent, PX0- has the structure of: Formula IV-g (Dimethyl C3 or C3dimethyl PS or Mod023*).

In some embodiments of a single-stranded RNAi agent, PX0- has the structure of: Formula Mod022*.

In some embodiments of a single-stranded RNAi agent, PX0- has the structure of: Formula IV-c (POMod023*).

In some embodiments of a single-stranded RNAi agent, PX0- has the structure of: Formula IV-d (PSMod023*).

In some embodiments of a single-stranded RNAi agent, PX0- has the structure of: Formula IV-e (PHMod023*).

In some embodiments of a single-stranded RNAi agent, PX0- has the structure of: Formula II-a.

In some embodiments of a single-stranded RNAi agent, PX0- has the structure of: Formula II-b.

In some embodiments of a single-stranded RNAi agent, PX0- has the structure of: Formula II-c.

In some embodiments of a single-stranded RNAi agent, PX0- has the structure of: Formula II-d.

In some embodiments of a single-stranded RNAi agent, PX0- has the structure of: Formula II-e.

In some embodiments of a single-stranded RNAi agent, PX0- has the structure of: Formula II-f.

In some embodiments of a single-stranded RNAi agent, PX0- has the structure of: Formula II-g.

In some embodiments of a single-stranded RNAi agent, PX0- has the structure of: Formula II-h.

In some embodiments of a single-stranded RNAi agent, PX0- has the structure of: Formula II-i.

In some embodiments of a single-stranded RNAi agent, PX0- has the structure of: Formula II-j.

In some embodiments of a single-stranded RNAi agent, PX0- has the structure of: Formula II-k.

In some embodiments of a single-stranded RNAi agent, PX0- has the structure of: Formula II-l.

In some embodiments of a single-stranded RNAi agent, PX0- has the structure of: Formula II-a to II-l.

In some embodiments of a single-stranded RNAi agent, PX0- has the structure of: Formula III-a.

In some embodiments of a single-stranded RNAi agent, PX0- has the structure of: Formula III-b.

In some embodiments of a single-stranded RNAi agent, PX0- has the structure of: Formula III-c.

In some embodiments of a single-stranded RNAi agent, PX0- has the structure of: Formula III-d.

In some embodiments of a single-stranded RNAi agent, PX0- has the structure of: Formula III-e.

In some embodiments of a single-stranded RNAi agent, PX0- has the structure of: Formula III-f.

In some embodiments of a single-stranded RNAi agent, PX0- has the structure of: Formula III-g.

In some embodiments of a single-stranded RNAi agent, PX0- has the structure of: Formula III-h.

In some embodiments of a single-stranded RNAi agent, PX0- has the structure of: Formula III-i.

In some embodiments of a single-stranded RNAi agent, PX0- has the structure of: Formula III-j.

In some embodiments of a single-stranded RNAi agent, PX0- has the structure of: Formula III-k.

In some embodiments of a single-stranded RNAi agent, PX0- has the structure of: Formula III-l.

In some embodiments of a single-stranded RNAi agent, PX0- has the structure of and of: Formula III-a to III-l.

In some embodiments of a single-stranded RNAi agent, PX0- has the structure of: Formula V-a.

In some embodiments of a single-stranded RNAi agent, PX0- has the structure of: Formula V-b.

In some embodiments of a single-stranded RNAi agent, PX0- has the structure of: Formula V-c.

In some embodiments of a single-stranded RNAi agent, PX0- has the structure of: Formula V-d.

In some embodiments of a single-stranded RNAi agent, PX0- has the structure of any of Formula V-a to V-d.

In some embodiments, a 5' end structure, PX0-N1-, has a structure selected from: 5'-(R)-Me OH T, 5'-(R)-Me PO T, 5'-(R)-Me PS T, 5'-(R)-Me PH T, 5'-(S)-Me OH T, 5'-(S)-Me PO T, 5'-(S)-Me PS T, and 5'-(S)—PH T.

In some embodiments, a 5' end structure, PX0-N1-, has the structure of 5'-(R)-Me OH T.

In some embodiments, a 5' end structure, PX0-N1-, has the structure of 5'-(R)-Me PO T.

In some embodiments, a 5' end structure, PX0-N1-, has the structure of 5'-(R)-Me PS T.

In some embodiments, a 5' end structure, PX0-N1-, has the structure of 5'-(R)-Me PH T.

In some embodiments, a 5' end structure, PX0-N1-, has the structure of 5'-(S)-Me OH T.

In some embodiments, a 5' end structure, PX0-N1-, has the structure of 5'-(S)-Me PO T.

In some embodiments, a 5' end structure, PX0-N1-, has the structure of 5'-(S)-Me PS T.

Non-limiting examples of such single-stranded RNAi agents include: WV-7643 and WV-7644, Table 46.

In some embodiments of a single-stranded RNAi agent, a 5' end structure, e.g., PX0-N1-, has the structure of 5'-(R)-Me PO T. Non-limiting examples of such single-stranded RNAi agents include: WV-7645 and WV-7646, Table 46.

In some embodiments of a single-stranded RNAi agent, a 5' end structure, e.g., PX0-N1-, has the structure of 5'-(R)-Me PS T. Non-limiting examples of such single-stranded RNAi agents include: WV-7647 and WV-7648, Table 46.

In some embodiments of a single-stranded RNAi agent, a 5' end structure, e.g., PX0-N1-, has the structure of 5'-(R)-Me PH T. Non-limiting examples of such single-stranded RNAi agents include: WV-7649 and WV-7650, Table 46.

In some embodiments of a single-stranded RNAi agent, a 5' end structure, e.g., PX0-N1-, has the structure of 5'-(S)-Me OH T. Non-limiting examples of such single-stranded RNAi agents include: WV-7635 and WV-7636, Table 46.

In some embodiments of a single-stranded RNAi agent, a 5' end structure, e.g., PX0-N1-, has the structure of 5'-(S)-Me PO T. Non-limiting examples of such single-stranded RNAi agents include: WV-7637 and WV-7638, Table 46.

In some embodiments of a single-stranded RNAi agent, a 5' end structure, e.g., PX0-N1-, has the structure of 5'-(S)-Me PS T. Non-limiting examples of such single-stranded RNAi agents include: WV-7639 and WV-7640, Table 46.

In some embodiments of a single-stranded RNAi agent, a 5' end structure, e.g., PX0-N1-, has the structure of 5'-(S)-Me PH T. Non-limiting examples of such single-stranded RNAi agents include: WV-7641 and WV-7642, Table 46.

In some embodiments, a 5' end structure, PX0-N1-, has the structure of 5'-(S)-Me PH T. In addition, some references such as EP 1520022 B1, paragraph 6, have reported that a 5' phosphate is required at the target-complementary strand (e.g., the antisense strand) of a siRNA duplex for RISC activity. U.S. Pat. No. 8,729,036, column 2, also noted that 5' phosphates are reported to be essential for RNA interference. U.S. Pat. No. 8,729,036, column 3, also reported that a 5' phosphate was required for single-stranded antisense siRNAs to trigger RNAi in HeLa S100 extract. However, the present disclosure has demonstrated that various single-stranded RNAi agents which do not comprise a 5' phosphate are capable of directing RNA interference.

In some embodiments, a 5'-end comprises a phosphate-comprising moiety such as T-VP or T-PO, or any other suitable RNAi agent 5'-end compound as described in, for example, Allerson et al. 2005 J. Med. Chem. 48: 901-04; Lima et al. 2012 Cell 150: 883-894; Prakash et al. 2015 Nucl. Acids Res. 43: 2993-3011; and/or Prakash et al. 2016 Bioorg. Med. Chem. Lett. 26: 26: 2817-2820.

In some embodiments, a 5'-end which does not comprise a phosphorus-comprising moiety can have particular advantages, in that the single-stranded RNAi agent can be easier to synthesize, and it may not be necessary to protect the phosphorus-comprising moiety from degradation. In some embodiments, a 5'-end of a provided single-stranded RNAi agent which does not comprise a phosphorus-comprising moiety comprises a moiety which can act as a substrate for a mammalian kinase which, inside a target cell, is able to attach a phosphorus-comprising moiety at the 5'-end of the single-stranded RNAi agent.

Non-limiting examples of efficacious single-stranded RNAi agents wherein the 5'-end does not comprise a phosphorus-comprising moiety include: WV-3068, WV-3069, WV-2818, WV-2817, WV-2721, and WV-2386.

In some embodiments, a 5'-end does not comprise a phosphorus-comprising moiety.

In some embodiments, a 5'-end does not comprise a phosphorus-comprising moiety, and PX0- is H or OH.

In some non-limiting examples of efficacious single-stranded RNAi agents wherein the 5'-end does not comprise a phosphorus-comprising moiety, PX0- is OH and —N1- is a 2'-deoxy or 2'-OMe.

In some embodiments of a single-stranded RNAi agent, the 5'-end does not comprise a phosphorus-comprising moiety, PX0- is OH and —N1- is a 2'-deoxy T. Some non-limiting examples of efficacious single-stranded RNAi agents with this structure include: WV-3068, WV-2818, and WV-2817.

In some embodiments of a single-stranded RNAi agent, the 5'-end does not comprise a phosphorus-comprising moiety, PX0- is OH and —N1- is a 2'-deoxy A. Some non-limiting examples of efficacious single-stranded RNAi agents with this structure include: WV-2721.

In some embodiments of a single-stranded RNAi agent, the 5'-end does not comprise a phosphorus-comprising moiety, PX0- is OH and —N1- is a 2'-OMe. Some non-limiting examples of efficacious single-stranded RNAi agents with this structure include: WV-2386.

In some embodiments of a single-stranded RNAi agent, the 5'-end does not comprise a phosphorus-comprising moiety, PX0- is OH and —N1- is a 2'-OMe U. Some non-limiting examples of efficacious single-stranded RNAi agents with this structure include: WV-2386.

In some embodiments, neither PX0- nor PX0-N1- comprise a does not comprise a phosphorus-comprising moiety.

In some embodiments, PX0- does not comprise a does not comprise a phosphorus-comprising moiety, In some embodiments, a 5'-end does not comprise a does not comprise a phosphorus-comprising moiety, and PX0- or PX0-N1- is H or OH.

In some embodiments, a 5'-end does not comprise a does not comprise a phosphorus-comprising moiety, and PX0- is H or OH.

In some embodiments, a 5'-end does not comprise a does not comprise a phosphorus-comprising moiety, and PX0- is H.

In some embodiments, a 5'-end does not comprise a does not comprise a phosphorus-comprising moiety, and PX0- is OH.

In some embodiments, a 5'-end does not comprise a does not comprise a phosphorus-comprising moiety, and PX0-N1- is H.

In some embodiments, a 5'-end does not comprise a does not comprise a phosphorus-comprising moiety, and PX0-N1- is OH.

In some embodiments of a single-stranded RNAi agent, the single-stranded RNAi agent comprises a 5' terminal OH, and the first nucleoside is 2'-deoxy.

In some embodiments of a single-stranded RNAi agent, the single-stranded RNAi agent comprises a 5' terminal OH, and the first nucleoside is 2'-deoxy T.

In some embodiments of a single-stranded RNAi agent, the single-stranded RNAi agent comprises a 5' terminal OH, and the first nucleoside is 2'-deoxy U.

In some embodiments of a single-stranded RNAi agent, the single-stranded RNAi agent comprises a 5' terminal OH, and the first nucleoside is 2'-deoxy A.

In some embodiments of a single-stranded RNAi agent, the single-stranded RNAi agent comprises a 5' terminal OH, and the first nucleoside is 2'-deoxy G.

In some embodiments of a single-stranded RNAi agent, the single-stranded RNAi agent comprises a 5' terminal OH, and the first nucleoside is 2'-deoxy C.

In some embodiments of a single-stranded RNAi agent, the single-stranded RNAi agent comprises a 5' terminal OH (e.g., PX0=OH), and the first nucleoside is 2'-deoxy (e.g., N1=2'-deoxy). Non-limiting examples of such a single-stranded RNAi agent include: WV-3068, WV-2817, WV-2818, WV-2721, Table 13, and many more single-stranded RNAi agents disclosed herein.

In some embodiments of a single-stranded RNAi agent, the single-stranded RNAi agent comprises a 5' terminal OH, and the first nucleoside is 2'-deoxy T (e.g., N1=2'-deoxy T). Non-limiting examples of such a single-stranded RNAi agent include: WV-3068, WV-2817, WV-2818, Table 13, and many more single-stranded RNAi agents disclosed herein.

In some embodiments of a single-stranded RNAi agent, the single-stranded RNAi agent comprises a 5' terminal OH, and the first nucleoside is 2'-deoxy U (e.g., N1=2'-deoxy U).

In some embodiments of a single-stranded RNAi agent, the single-stranded RNAi agent comprises a 5' terminal OH, and the first nucleoside is 2'-deoxy A (e.g., N1=2'-deoxy A). Non-limiting examples of such a single-stranded RNAi agent include: WV-2721, Table 13.

In some embodiments of a single-stranded RNAi agent, the single-stranded RNAi agent comprises a 5' terminal OH, and the first nucleoside is 2'-deoxy G (e.g., N1=2'-deoxy G).

In some embodiments of a single-stranded RNAi agent, the single-stranded RNAi agent comprises a 5' terminal OH, and the first nucleoside is 2'-deoxy C (e.g., N1=2'-deoxy C).

In some embodiments of a single-stranded RNAi agent, the single-stranded RNAi agent comprises a 5' terminal OH, and the first nucleoside is 2'-OMe.

In some embodiments of a single-stranded RNAi agent, the single-stranded RNAi agent comprises a 5' terminal OH, and the first nucleoside is 2'-OMe T.

In some embodiments of a single-stranded RNAi agent, the single-stranded RNAi agent comprises a 5' terminal OH, and the first nucleoside is 2'-OMe U.

In some embodiments of a single-stranded RNAi agent, the single-stranded RNAi agent comprises a 5' terminal OH, and the first nucleoside is 2'-OMe A.

In some embodiments of a single-stranded RNAi agent, the single-stranded RNAi agent comprises a 5' terminal OH, and the first nucleoside is 2'-OMe G.

In some embodiments of a single-stranded RNAi agent, the single-stranded RNAi agent comprises a 5' terminal OH, and the first nucleoside is 2'-OMe C.

In some embodiments of a single-stranded RNAi agent, the single-stranded RNAi agent comprises a 5' terminal OH, and the first nucleoside is 2'-OMe (e.g., N1=2'—OMe).

In some embodiments of a single-stranded RNAi agent, the single-stranded RNAi agent comprises a 5' terminal OH, and the first nucleoside is 2'-OMe T (e.g., N1=2'—OMe T).

In some embodiments of a single-stranded RNAi agent, the single-stranded RNAi agent comprises a 5' terminal OH, and the first nucleoside is 2'-OMe U (e.g., N1=2'—OMe U). A non-limiting example of such a single-stranded RNAi agent is WV-2386, Table 35.

In some embodiments of a single-stranded RNAi agent, the single-stranded RNAi agent comprises a 5' terminal OH, and the first nucleoside is 2'-OMe A (e.g., N1=2'—OMe A).

In some embodiments of a single-stranded RNAi agent, the single-stranded RNAi agent comprises a 5' terminal OH, and the first nucleoside is 2'-OMe G (e.g., N1=2'—OMe G).

In some embodiments of a single-stranded RNAi agent, the single-stranded RNAi agent comprises a 5' terminal OH, and the first nucleoside is 2'-OMe C (e.g., N1=2'—OMe C).

In some embodiments of a single-stranded RNAi agent, the single-stranded RNAi agent comprises a 5' terminal OH, and the first nucleoside is 2'-F.

In some embodiments of a single-stranded RNAi agent, the single-stranded RNAi agent comprises a 5' terminal OH, and the first nucleoside is 2'-F T.

In some embodiments of a single-stranded RNAi agent, the single-stranded RNAi agent comprises a 5' terminal OH, and the first nucleoside is 2'-F U.

In some embodiments of a single-stranded RNAi agent, the single-stranded RNAi agent comprises a 5' terminal OH, and the first nucleoside is 2'-F A.

In some embodiments of a single-stranded RNAi agent, the single-stranded RNAi agent comprises a 5' terminal OH, and the first nucleoside is 2'-F G.

In some embodiments of a single-stranded RNAi agent, the single-stranded RNAi agent comprises a 5' terminal OH, and the first nucleoside is 2'-F C.

In some embodiments of a single-stranded RNAi agent, the single-stranded RNAi agent comprises a 5' terminal OH, and the first nucleoside is 2'-F (e.g., N1=2'—F).

In some embodiments of a single-stranded RNAi agent, the single-stranded RNAi agent comprises a 5' terminal OH, and the first nucleoside is 2'-F T (e.g., N1=2'—F T).

In some embodiments of a single-stranded RNAi agent, the single-stranded RNAi agent comprises a 5' terminal OH, and the first nucleoside is 2'-F U (e.g., N1=2'—F U).

In some embodiments of a single-stranded RNAi agent, the single-stranded RNAi agent comprises a 5' terminal OH, and the first nucleoside is 2'-F A (e.g., N1=2'—F A). A non-limiting example of such a single-stranded RNAi agent is WV-5301, Table 36B.

In some embodiments of a single-stranded RNAi agent, the single-stranded RNAi agent comprises a 5' terminal OH, and the first nucleoside is 2'-F G (e.g., N1=2'—F G). A non-limiting example of such a single-stranded RNAi agent is WV-5300, Table 37.

In some embodiments of a single-stranded RNAi agent, the single-stranded RNAi agent comprises a 5' terminal OH, and the first nucleoside is 2'-F C (e.g., N1=2'—F C).

In some embodiments of a single-stranded RNAi agent, the single-stranded RNAi agent comprises a 5' terminal phosphate, and the first nucleoside is 2'-deoxy.

In some embodiments of a single-stranded RNAi agent, the single-stranded RNAi agent comprises a 5' terminal phosphate, and the first nucleoside is 2'-deoxy T.

In some embodiments of a single-stranded RNAi agent, the single-stranded RNAi agent comprises a 5' terminal phosphate, and the first nucleoside is 2'-deoxy U.

In some embodiments of a single-stranded RNAi agent, the single-stranded RNAi agent comprises a 5' terminal phosphate, and the first nucleoside is 2'-deoxy A.

In some embodiments of a single-stranded RNAi agent, the single-stranded RNAi agent comprises a 5' terminal phosphate, and the first nucleoside is 2'-deoxy G.

In some embodiments of a single-stranded RNAi agent, the single-stranded RNAi agent comprises a 5' terminal phosphate, and the first nucleoside is 2'-deoxy C.

In some embodiments of a single-stranded RNAi agent, the single-stranded RNAi agent comprises a 5' terminal phosphate (e.g., PX0=phosphate), and the first nucleoside is 2'-deoxy (e.g., N1=2'-deoxy). Non-limiting examples include: WV-3021, Table 13; WV-2420, Table 18; WV-2716 to WV-2719, Table 19; WV-2720, Table 26; and many more single-stranded RNAi agents disclosed herein.

In some embodiments of a single-stranded RNAi agent, the single-stranded RNAi agent comprises a 5' terminal phosphate, and the first nucleoside is 2'-deoxy T (e.g., N1=2'-deoxy T). Non-limiting examples of such single-stranded RNAi agents include: WV-3021, Table 13; WV-2420, Table 18; WV-2716 to WV-2719, Table 19; and many more single-stranded RNAi agents disclosed herein.

In some embodiments of a single-stranded RNAi agent, the single-stranded RNAi agent comprises a 5' terminal phosphate, and the first nucleoside is 2'-deoxy U (e.g., N1=2'-deoxy U).

In some embodiments of a single-stranded RNAi agent, the single-stranded RNAi agent comprises a 5' terminal phosphate, and the first nucleoside is 2'-deoxy A (e.g., N1=2'-deoxy A). Non-limiting examples of such single-stranded RNAi agents include: WV-2720, Table 26.

In some embodiments of a single-stranded RNAi agent, the single-stranded RNAi agent comprises a 5' terminal phosphate, and the first nucleoside is 2'-deoxy G (e.g., N1=2'-deoxy G).

In some embodiments of a single-stranded RNAi agent, the single-stranded RNAi agent comprises a 5' terminal phosphate, and the first nucleoside is 2'-deoxy C (e.g., N1=2'-deoxy C).

In some embodiments of a single-stranded RNAi agent, the single-stranded RNAi agent comprises a 5' terminal phosphate, and the first nucleoside is 2'-F.

In some embodiments of a single-stranded RNAi agent, the single-stranded RNAi agent comprises a 5' terminal phosphate, and the first nucleoside is 2'-F T.

In some embodiments of a single-stranded RNAi agent, the single-stranded RNAi agent comprises a 5' terminal phosphate, and the first nucleoside is 2'-F U.

In some embodiments of a single-stranded RNAi agent, the single-stranded RNAi agent comprises a 5' terminal phosphate, and the first nucleoside is 2'-F A.

In some embodiments of a single-stranded RNAi agent, the single-stranded RNAi agent comprises a 5' terminal phosphate, and the first nucleoside is 2'-F G.

In some embodiments of a single-stranded RNAi agent, the single-stranded RNAi agent comprises a 5' terminal phosphate, and the first nucleoside is 2'-F C.

In some embodiments of a single-stranded RNAi agent, the single-stranded RNAi agent comprises a 5' terminal phosphate, and the first nucleoside is 2'-F (e.g., N1=2'—F). Non-limiting examples of such single-stranded RNAi agents include: WV-1275, WV-1277, WV-1829, and WV-1830, Table 12; and WV-1307, Table 17.

In some embodiments of a single-stranded RNAi agent, the single-stranded RNAi agent comprises a 5' terminal phosphate, and the first nucleoside is 2'-F T (e.g., N1=2'—F T).

In some embodiments of a single-stranded RNAi agent, the single-stranded RNAi agent comprises a 5' terminal phosphate, and the first nucleoside is 2'-F U (e.g., N1=2'—F U). Non-limiting examples of such single-stranded RNAi agents include: WV-1307, Table 17.

In some embodiments of a single-stranded RNAi agent, the single-stranded RNAi agent comprises a 5' terminal phosphate, and the first nucleoside is 2'-F A (e.g., N1=2'—F A). Non-limiting examples of such single-stranded RNAi agents include: WV-1275, WV-1277, WV-1829, and WV-1830, Table 12.

In some embodiments of a single-stranded RNAi agent, the single-stranded RNAi agent comprises a 5' terminal phosphate, and the first nucleoside is 2'-F G (e.g., N1=2'—F G).

In some embodiments of a single-stranded RNAi agent, the single-stranded RNAi agent comprises a 5' terminal phosphate, and the first nucleoside is 2'-F C (e.g., N1=2'—F C).

In some embodiments of a single-stranded RNAi agent, the single-stranded RNAi agent comprises a 5' terminal phosphate, and the first nucleoside is 2'-OMe.

In some embodiments of a single-stranded RNAi agent, the single-stranded RNAi agent comprises a 5' terminal phosphate, and the first nucleoside is 2'-OMe T.

In some embodiments of a single-stranded RNAi agent, the single-stranded RNAi agent comprises a 5' terminal phosphate, and the first nucleoside is 2'-OMe U.

In some embodiments of a single-stranded RNAi agent, the single-stranded RNAi agent comprises a 5' terminal phosphate, and the first nucleoside is 2'-OMe A.

In some embodiments of a single-stranded RNAi agent, the single-stranded RNAi agent comprises a 5' terminal phosphate, and the first nucleoside is 2'-OMe G.

In some embodiments of a single-stranded RNAi agent, the single-stranded RNAi agent comprises a 5' terminal phosphate, and the first nucleoside is 2'-OMe C.

In some embodiments of a single-stranded RNAi agent, the single-stranded RNAi agent comprises a 5' terminal phosphate, and the first nucleoside is 2'-OMe (e.g., N1=2'—OMe). Non-limiting examples of such single-stranded RNAi agents include: WV-2110, Tables 26 and 27; WV-1308, Table 17; WV-2712, WV-2713, WV-2714, WV-2715, Table 20; WV-2111, Table 21; WV-2154, WV-2155, Table 23; and WV-2156 and WV-2157, Table 24; and WV-1831, Table 12

In some embodiments of a single-stranded RNAi agent, the single-stranded RNAi agent comprises a 5' terminal phosphate, and the first nucleoside is 2'-OMe T (e.g., N1=2'—OMe T).

In some embodiments of a single-stranded RNAi agent, the single-stranded RNAi agent comprises a 5' terminal phosphate, and the first nucleoside is 2'-OMe U (e.g., N1=2'—OMe U). Non-limiting examples of such single-stranded RNAi agents include: WV-2110, Tables 26 and 27; WV-1308, Table 17; WV-2712, WV-2713, WV-2714, WV-2715, Table 20; WV-2111, Table 21; WV-2154, WV-2155, Table 23; and WV-2156 and WV-2157, Table 24.

In some embodiments of a single-stranded RNAi agent, the single-stranded RNAi agent comprises a 5' terminal phosphate, and the first nucleoside is 2'-OMe A (e.g., N1=2'—OMe A). Non-limiting examples of such single-stranded RNAi agents include: WV-1831, Table 12.

In some embodiments of a single-stranded RNAi agent, the single-stranded RNAi agent comprises a 5' terminal phosphate, and the first nucleoside is 2'-OMe G (e.g., N1=2'—OMe G).

In some embodiments of a single-stranded RNAi agent, the single-stranded RNAi agent comprises a 5' terminal phosphate, and the first nucleoside is 2'-OMe C (e.g., N1=2'—OMe C).

In some embodiments, an oligonucleotide comprises an additional component which binds to ASPGR. In some embodiments, the additional component is on the 5' end of the oligonucleotide.

In some embodiments, an oligonucleotide comprises an additional component which is or comprises a compound of Formula (K)

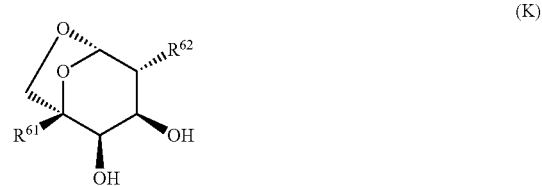

(K)

wherein $R^{61}$ is —CN, —CH$_2$—CN, —C≡CH, —CH$_2$-N$_3$, —CH$_2$—NH$_2$, —CH$_2$—N(R$^{64}$)—S(O)$_2$-R$^{65}$, —CH$_2$—CO$_2$H, —CO$_2$H, —CH$_2$—OH, —CH$_2$—SH, —CH=CH—R$^{65}$, —CH$_2$-R$^{65}$, —CH$_2$—S—R$^{65}$, —CH$_2$—N(R$^{64}$)—R$^{65}$, —CH$_2$—N(R$^{64}$)—C(O)—R$^{65}$, —CH$_2$—N(R$^{64}$)—C(O)—O—R$^{65}$, —CH$_2$—N(R$^{64}$)—C(O)—N(R$^{64}$)—R$^{65}$, —CH$_2$—O—R$^{65}$, —CH$_2$—O—C(O)—R$^{65}$, —CH$_2$—O—C(O)—N(R$^{64}$)—R$^{65}$, —CH$_2$—O—C(O)—O—R$^{65}$, —CH$_2$—S(O)—R$^{65}$, —CH$_2$—S(O)$_2$-R$^{65}$, —CH$_2$—S(O)$_2$—N(R$^{64}$)—R$^{65}$, —C(O)—NH$_2$, —C(O)—O—R$^{65}$, —C(O)—N(R$^{64}$)—R$^{65}$, or aryl or heteroaryl, wherein the aryl or heteroaryl is optionally substituted with $R^{65}$, or $R^{61}$ is -Z—X—Y wherein X is a linker or a drug delivery system, Y is absent or is a ligand selected from the group consisting of a small molecule, an amino acid sequence, a nucleic acid sequence, an antibody, an oligomer, a polymer, genetically derived material, a liposome, a nanoparticle, dye, fluorescent probe, or a combination thereof, and Z is absent or is —C≡C—, —CH=CH—, —CH$_2$—, —CH$_2$—O—, —C(O)—N(R$^{64}$)—, —CH$_2$—S—, —CH$_2$—S(O)—, —CH$_2$—S(O)$_2$—, —CH$_2$—S(O)$_2$-N(R$^{64}$)—, —C(O)—O—, —CH$_2$—N(R$^{64}$)—, —CH$_2$—N(R$^{64}$)—C(O)—, —CH$_2$—N(R$^{64}$)—S(O)$_2$—, —CH$_2$—N(R$^{64}$)—C(O)-0-, —CH$_2$—N(R$^{64}$)—C(O)—N(R$^{64}$)—, —CH$_2$—O—C(O)—, —CH$_2$—O—C(O)—N(R$^{64}$)—, —CH$_2$—O—C(O)—O—, or aryl or heteroaryl, wherein the aryl or heteroaryl is optionally substituted with $R^{65}$;

$R^{62}$ is —OH, —N$_3$, —N(R$^{63}$)$_2$, —N(R$^{63}$)—C(O)—R$^{63'}$—N(R$^{63}$)—C(O)—N(R$^{63}$)$_2$'—N(R$^{63}$)—C(O)—OR$^{63}$, tetrazole, or triazole, wherein the tetrazole and triazole are optionally substituted with $R^{63}$, and wherein when $R^{61}$ is —CH$_2$—OH, $R^{62}$ is -N$_3$, —N(R$^{63}$)$_2$, —N(R$^{63}$)—C(O)—R$^{63'}$—N(R$^{63}$)—C(O)—N $(R^{63})_2{}'$—$N(R^{63})$—$C(O)$—$OR^{63}$, tetrazole, or triazole, wherein the tetrazole and triazole are optionally substituted with $R^{63}$;

each $R^{63}$ is independently —H, —$(C_1$-$C_5)$alkyl, halo-substituted $(C_1$-$C_5)$alkyl, or $(C_3$-$C_6)$cycloalkyl, wherein a —$CH_2$— group of the alkyl or cycloalkyl may be replaced with a heteroatom group selected from —O—, —S—, and —$N(R^{64})$— and —$CH_3$ of the alkyl may be replaced with a heteroatom group selected from —$N(R^{64})_2$, —$OR^{64}$, and —$S(R^{64})$ wherein the heteroatom groups are separated by at least 2 carbon atoms;

each $R^{64}$ is independently —H, —$(C_1$-$C_{20})$alkyl, or $(C_3$-$C_6)$ cycloalkyl wherein one to six —$CH_2$-groups of the alkyl or cycloalkyl separated by at least two carbon atoms may be replaced with —O—, —S—, or —$N(R^{64})$—, and —$CH_3$ of the alkyl may be replaced with a heteroatom group selected from —$N(R^{64})_2$, —$OR^{64}$, and —$S(R^{64})$ wherein the heteroatom groups are separated by at least 2 carbon atoms; and wherein the alkyl and cycloalkyl may be substituted with one to six halo atoms; and each $R^{65}$ is independently —H, $(C_3$-$C_{20})$cycloalkyl or $(C_1$-$C_{20})$alkyl wherein one to six —$CH_2$-groups of the alkyl or cycloalkyl separated by at least two carbon atoms may be replaced with —O—, —S—, or —$N(R^{64})$—, and —$CH_3$ of the alkyl may be replaced with a heteroatom group selected from —$N(R^{64})_2$, —$OR^{64}$, and —$S(R^{64})$ wherein the heteroatom groups are separated by at least 2 carbon atoms; and wherein the alkyl and cycloalkyl may be substituted with one to six halo atoms.

In some embodiments, an oligonucleotide comprises an additional component which is or comprises a compound of Formula (M)

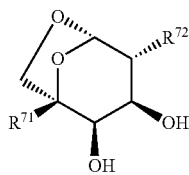

(M)

wherein $R^{71}$ is —CN, —$CH_2$—CN, —C≡CH, —$CH_2$-$N_3$, —$CH_2$—$NH_2$, —$CH_2$—$N(R^{74})$—$S(O)_2$-$R^{75}$, —$CH_2$—$CO_2H$, —$CO_2H$, —$CH_2$—OH, —$CH_2$—SH, —CH═CH—$R^{75}$, —$CH_2$-$R^{75}$, —$CH_2$—S—$R^{75}$, —$CH_2$—$N(R^{74})$—$R^{75}$, —$CH_2$—$N(R^{74})$—$C(O)$—$R^{75}$, —$CH_2$—$N(R^{74})$—$C(O)$—O—$R^{75}$, —$CH_2$—$N(R^{74})$—$C(O)$—$N(R^{74})$—$R^{75}$, —$CH_2$—O—$R^{75}$, —$CH_2$—O—$C(O)$—$R^{75}$, —$CH_2$—O—$C(O)$—N$(R^{74})$—$R^{75}$, —$CH_2$—O—$C(O)$—O—$R^{75}$, —$CH_2$—$S(O)$—$R^{75}$, —$CH_2$—$S(O)_2$-$R^{75}$, —$CH_2$—$S(O)_2$—$N(R^{74})$—$R^{75}$, —$C(O)$—$NH_2$, —$C(O)$—O—$R^{75}$, —$C(O)$—$N(R^{74})$—$R^{75}$, or aryl or heteroaryl, wherein the aryl or heteroaryl is optionally substituted with $R^{75}$, or $R^{71}$ is -Z—X—Y, —Z—Y, —X—Y, —X, —Y, or -Z-X wherein X is a linker or a drug delivery system, Y is $R^{76}$ or is a ligand selected from the group consisting of a small molecule, an amino acid sequence, a nucleic acid sequence, an antibody, an oligomer, a polymer, genetically derived material, a liposome, a nanoparticle, dye, fluorescent probe, or a combination thereof, and Z is —C≡C—, —CH═CH—, —$CH_2$—, —$CH_2$—O—, —$C(O)$—$N(R^{74})$—, —$CH_2$-S—, —$CH_2$—$S(O)$—, —$CH_2$—$S(O)_2$—, —$CH_2$—$S(O)_2$—N$(R^{74})$—, —$C(O)$—O—, —$CH_2$—$N(R^{74})$—, —$CH_2$—N$(R^{74})$—$C(O)$—, —$CH_2$—$N(R^{74})$—$S(O)_2$—, —$CH_2$—N$(R^{74})$—$C(O)$-O—, —$CH_2$—$N(R^{74})$—$C(O)$—$N(R^{74})$—,
—$CH_2$—O—$C(O)$—, —$CH_2$—O—$C(O)$—$N(R^{74})$—, —$CH_2$—O—$C(O)$—O—, or aryl or heteroaryl, wherein the aryl or heteroaryl is optionally substituted with $R^{75}$;

$R^{72}$ is —OH, —$N_3$, —$N(R^{73})_2$, —$N(R^{73})$—$C(O)$—$R^{73'}$— $N(R^{73})$—$C(O)$—$N(R^{73})_2{}'$—$N(R^{73})$—$C(O)$—$OR^{73}$, —$N(R^{73})$—$S(O)_2$-$R^{73'}$ tetrazole, or triazole, wherein the tetrazole and triazole are optionally substituted with $R^{73}$ and wherein when $R^{71}$ is —$CH_2$—OH, $R^{72}$ is -$N_3$, —N$(R^{73})_2$, —$N(R^{73})$—$C(O)$—$R^{73'}$—$N(R^{73})$—$C(O)$—N$(R^{73})_2{}'$—$N(R^{73})$—$C(O)$—$OR^{73}$, $N(R^{73})$—$S(O)_2$-$R^{73}$, tetrazole, or triazole, wherein the tetrazole and triazole are optionally substituted with $R^{73}$;

each $R^{73}$ is independently —H, —$(C_1$-$C_5)$alkyl, halo-substituted $(C_1$-$C_5)$alkyl, or $(C_3$-$C_6)$cycloalkyl, wherein one or more —$CH_2$— groups of the alkyl or cycloalkyl may each be replaced with a heteroatom group independently selected from —O—, —S—, and —$N(R^{74})$— and —$CH_3$ of the alkyl may be replaced with a heteroatom group selected from —$N(R^{74})_2$, —$OR^{74}$, and —$S(R^{74})$ wherein the heteroatom groups are separated by at least 2 carbon atoms;

each $R^{74}$ is independently —H, —$(C_1$-$C_{20})$alkyl, or $(C_3$-$C_6)$ cycloalkyl wherein one to six —$CH_2$-groups of the alkyl or cycloalkyl separated by at least two carbon atoms may each be replaced with a heteroatom independently selected from —O—, —S—, or —$N(R^{74})$—, and —$CH_3$ of the alkyl may be replaced with a heteroatom group selected from —N$(R^{74})_2$, —$OR^{74}$, and —$S(R^{74})$ wherein the heteroatom groups are separated by at least 2 carbon atoms; and wherein the alkyl and cycloalkyl may be substituted with halo atoms;

each $R^{75}$ is independently —H, $(C_3$-$C_{20})$cycloalkyl or $(C_1$-$C_{60})$alkyl wherein one to six —$CH_2$-groups of the cycloalkyl or one to 20 —$CH_2$— groups of the alkyl may each be replaced with heteroatoms independently selected from —O—, —S—, and —$N(R^{74})$— wherein the heteroatoms are separated by at least two carbon atoms, and —$CH_3$ of the alkyl may be replaced with a heteroatom group selected from —$N(R^{74})_2$, —$OR^{74}$, and —$S(R^{74})$ wherein the heteroatom groups are separated by at least 2 carbon atoms; and wherein the alkyl and cycloalkyl may be substituted with halo atoms; and each $R^{76}$ is independently H, —C═$CH_2$, —$CH_3$, —$N_3$, —$N(R^{74})_2$, —OH, —$S(O)$-$(R^{74})$, —$S(O)_2$-$(R^{74})$, —$C(O)$—OH, -S-S-aryl, —S-S-heteroaryl, heterocycyl, aryl or heteroaryl, wherein each aryl or heteroaryl is optionally substituted with $R^{75}$.

In some embodiments, $R^{61}$ or $R^{71}$ is —X—Y, and/or $R^{62}$ or $R^{72}$ is —NH—$C(O)$-$CH_3$.

In some embodiments, an oligonucleotide comprises an additional component selected from the group consisting of:

benzyl (4-((2-((1-(1-((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)ethyl)amino)-4-oxobutyl)carbamate, benzyl (4-((1,3-bis((1-(1-((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)propan-2-yl)amino)-4-oxobutyl)carbamate, benzyl (4-((1,3-bis((1-(1-((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)-2-(((1-(1-((1S,2R,3R,4R,5S)-4-acetamido-2,3-dihydroxy-6,8-dioxabicyclo[3.2.1]octan-1-yl)-2,5,8,11-tetraoxatridecan-13-yl)-$^1$H-1,2,3-triazol-4-yl)methoxy)methyl)propan-2-yl)amino)-4-oxobutyl)carbamate, N-(2-((1-(1-((1S,2R,3R,4R,5S)-4-acetamido-2,3-dihydroxy-6,8-dioxabicyclo[3.2.1]octan-1-yl)-2,5,8,11-tetraoxatridecan-13-yl)-1H-1,2,3-triazol-4-yl)methoxy)ethyl)-4-aminobutanamide, 4-amino-N-{1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]propan-2-yl}butanamide, 4-amino-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)butanamide, 4-amino-N-[1,31-bis(1-{[(1S,2R,3R,4R,5S)-4-(acetylamino)-2,3-dihydroxy-6,8-dioxabicyclo[3.2.1]oct-1-yl]methyl}-1H-1,2,3-triazol-4-yl)-2,6,10,14,18,22,26,30-octaoxahentriacontan-16-yl]butanamide, 4-amino-N-{1,31-bis(1-{[(1S,2R,3R,4R,5S)-4-(acetylamino)-2,3-dihydroxy-6,8-dioxabicyclo[3.2.1]oct-1-yl]methyl}-1H-1,2,3-triazol-4-yl)-16-[15-(1-{[(1S,2R,3R,4R,5S)-4-(acetylamino)-2,3-dihydroxy-6,8-dioxabicyclo[3.2.1]oct-1-yl]methyl}-1H-1,2,3-triazol-4-yl)-2,6,10,14-tetraoxapentadec-1-yl]-2,6,10,14,18,22,26,30-octaoxahentriacontan-16-yl}butanamide, N-{(1S,2R,3R,4R,5S)-1-[(hexyloxy)methyl]-2,3-dihydroxy-6,8-dioxabicyclo[3.2.1]oct-4-yl}acetamide, N-[(1S,2R,3R,4R,5S)-2,3-dihydroxy-1-(2,5,8,11,14-pentaoxapentadec-1-yl)-6,8-dioxabicyclo[3.2.1]oct-4-yl]acetamide, N-((1S,2R,3R,4R,5S)-2,3-dihydroxy-1-(hydroxymethyl)-6,8-dioxabicyclo[3.2.1]octan-4-yl)-2,2,2-trifluoroacetamide, compound, N-[(1S,2R,3R,4R,5S)-2,3-dihydroxy-1-(hydroxymethyl)-6,8-dioxabicyclo[3.2.1]oct-4-yl]-2,2,2-trifluoroacetamide, N-[(1S,2R,3R,4R,5S)-2,3-dihydroxy-1-(hydroxymethyl)-6,8-dioxabicyclo[3.2.1]oct-4-yl]propanamide, N-[(1S,2R,3R,4R,5S)-2,3-dihydroxy-1-(hydroxymethyl)-6,8-dioxabicyclo[3.2.1]oct-4-yl]methanesulfonamide, N-[(1S,2R,3R,4R,5S)-2,3-dihydroxy-1-(hydroxymethyl)-6,8-dioxabicyclo[3.2.1]oct-4-yl]-2,2-difluoroacetamide, N-[(1S,2R,3R,4R,5S)-2,3-dihydroxy-1-(hydroxymethyl)-6,8-dioxabicyclo[3.2.1]oct-4-yl]-3,3,3-trifluoropropanamide, N-[(1S,2R,3R,4R,5S)-2,3-dihydroxy-1-(hydroxymethyl)-6,8-dioxabicyclo[3.2.1]oct-4-yl]-N-methylacetamide, N-[(1S,2R,3R,4R,5S)-2,3-dihydroxy-1-(hydroxymethyl)-6,8-dioxabicyclo[3.2.1]oct-4-yl]-N-methylmethanesulfonamide, tert-butyl [(1S,2R,3R,4R,5S)-2,3-dihydroxy-1-(hydroxymethyl)-6,8-dioxabicyclo[3.2.1]oct-4-yl]methylcarbamate, (1S,2R,3R,4R,5S)-1-(hydroxymethyl)-4-(methylamino)-6,8-dioxabicyclo[3.2.1]octane-2,3-diol hydrochloride, N-[(1S,2R,3R,4R,5S)-2,3-dihydroxy-1-(15-phenyl-2,5,8,11,14-pentaoxapentadec-1-yl)-6,8-dioxabicyclo[3.2.1]oct-4-yl]acetamide, N-[(1S,2R,3R,4R,5S)-1-(13-azido-2,5,8,11-tetraoxatridec-1-yl)-2,3-dihydroxy-6,8-dioxabicyclo[3.2.1]oct-4-yl]acetamide, N-[(1S,2R,3R,4R,5S)-2,3-dihydroxy-1-(2,5,8,11-tetraoxatetradec-13-en-1-yl)-6,8-dioxabicyclo[3.2.1]oct-4-yl]acetamide, N-[(1S,2R,3R,4R,5S)-2,3-dihydroxy-1-(2,5,8,11-tetraoxatetradec-13-yn-1-yl)-6,8-dioxabicyclo[3.2.1]oct-4-yl]acetamide, N-[(1S,2R,3R,4R,5S)-1-(13-amino-2,5,8,11-tetraoxatridec-1-yl)-2,3-dihydroxy-6,8-dioxabicyclo[3.2.1]oct-4-yl]acetamide, N-[(1S,2R,3R,4R,5S)-2,3-dihydroxy-1-(13-hydroxy-2,5,8,11-tetraoxatridec-1-yl)-6,8-dioxabicyclo[3.2.1]oct-4-yl]acetamide, 1-[(1S,2R,3R,4R,5S)-4-(acetylamino)-2,3-dihydroxy-6,8-dioxabicyclo[3.2.1]oct-1-yl]-2,5,8,11-tetraoxatridecan-13-oic acid, S-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl} ethanethioate, N-{(1S,2R,3R,4R,5S)-2,3-dihydroxy-1-[13-(pyridin-2-yldisulfanyl)-2,5,8,11-tetraoxatridec-1-yl]-6,8-dioxabicyclo[3.2.1]oct-4-yl}acetamide, N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)-6-(pyridin-2-yldisulfanyl)hexanamide, N-[(1S,2R,3R,4R,5S)-1-(13-{4-[(3-[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}-2-aminopropoxy)methyl]-1H-1,2,3-triazol-1-yl}-2,5,8,11-tetraoxatridec-1-yl)-2,3-dihydroxy-6,8-dioxabicyclo[3.2.1]oct-4-yl]acetamide-hydrochloric acid salt, 6-azido-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)hexanamide, N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)hept-6-enamide, N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)hept-6-ynamide, 7-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-7-oxoheptanoic acid (Sodium salt), benzyl {6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11- tetraoxatridecan-13-yl}-1H-1,2,3-triazol-4-yl)methoxy] methyl}propan-2-yl)amino]-6-oxohexyl}carbamate, 6-amino-N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy] methyl}propan-2-yl)hexanamide acetate salt, N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy] methyl}propan-2-yl)amino]-6-oxohexyl}-6-(2,5-dioxo-2,5-dihydro-1H-pyrrol-1-yl)hexanamide, N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy] methyl}propan-2-yl)amino]-6-oxohexyl}-6-[(bromoacetyl)amino]hexanamide, 4-{[(2R)-5-(carbamoylamino)-2-{[(2R)-2-cyclopentyl-2-{[6-(2,5-dioxo-2,5-dihydro-1H-pyrrol-1-yl)hexanoyl]amino}acetyl]amino}pentanoyl]amino}benzyl {6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy] methyl}propan-2-yl)amino]-6-oxohexyl}carbamate, N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy] methyl}propan-2-yl)-3,19-dioxo-1-(pyridin-2-yldisulfanyl)-7,10,13,16-tetraoxa-4,20-diazahexacosan-26-amide, N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy] methyl}propan-2-yl)-3,31-dioxo-1-(pyridin-2-yldisulfanyl)-7,10,13,16,19,22,25,28-octaoxa-4,32-diazaoctatriacontan-38-amide, N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy] methyl}propan-2-yl)amino]-6-oxohexyl}-6-(pyridin-2-yldisulfanyl)hexanamide, 2-(pyridin-2-yldisulfanyl)ethyl {6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo [3.2.1]oct-1-yl]-2,5,8,11-tetraoxatridecan-13-yl}-1H-1,2,3-triazol-4-yl)methoxy]methyl}propan-2-yl)amino]-6-oxohexyl}carbamate, N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy] methyl}propan-2-yl)amino]-6-oxohexyl]-6-(4,4,5,5-tetramethyl-1,3,2-dioxaborolan-2-yl)hexanamide, N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy] methyl}propan-2-yl)amino]-6-oxohexyl}-N'-(1,3-dihydroxypropan-2-yl)heptanediamide, 6-azido-N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy] methyl}propan-2-yl)amino]-6-oxohexyl}hexanamide, 6-(benzyloxy)-N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}hexanamide, (1S,2R,3R,4R,5S)-4-(acetylamino)-1-{13-[4-({3-[(1-{1-[(1S,2R,3R,4R,5S)-4-(acetylamino)-2,3-bis(acetyloxy)-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-bis(acetyloxy)-6,8-dioxabicyclo[3.2.1]oct-1-yl]-2,5,8,11-tetraoxatridecan-13-yl}-1H-1,2,3-triazol-4-yl)methoxy]methyl}-2-({6[((6hydroxyhexanoyl)amino]hexanoyl}amino)propoxy}methyl)-1H-1,2,3-triazol-1-yl]-2,5,8,11-tetraoxatridec-1-yl}-3-(acetyloxy)-6,8-dioxabicyclo[3.2.1]oct-2-yl acetate, benzyl [6-({6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy] methyl}propan-2-yl)amino]-6-oxohexyl}amino)-6-oxohexyl]carbamate, 6-amino-N-{6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy] methyl}propan-2-yl)amino]-6-oxohexyl}hexanamide acetate, 4-(benzyloxy)-N-(1,3-bis[(1-{1-[(1S,2R,3R,4R,5S)-4-amino-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-amino-2,3-dihydroxy-6,8-dioxabicyclo[3.2.1]oct-1-yl]-2,5,8,11- tetraoxatridecan-13-yl}-1H-1,2,3-triazol-4-yl)methoxy]methyl}propan-2-yl)butanamide, N-(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)-4-hydroxybutanamide, and N-(2-{[6-({6-[(1,3-bis[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]-2-{[(1-{1-[(1S,2R,3R,4R,5S)-4-(acetylamino)-2,3-dihydroxy-6,8-dioxabicyclo[3.2.1]oct-1-yl]-2,5,8,11-tetraoxatridecan-13-yl}-1H-1,2,3-triazol-4-yl)methoxy]methyl}propan-2-yl)amino]-6-oxohexyl}amino)-6-oxohexyl]oxy}-1,3-dioxan-5-yl)-6-(pyridin-2-yldisulfanyl)hexanamide In some embodiments, an oligonucleotide comprises an additional component of Formula (N)

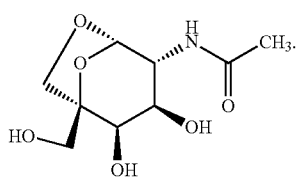

(N)

In some embodiments, an oligonucleotide comprises an additional component
selected from:

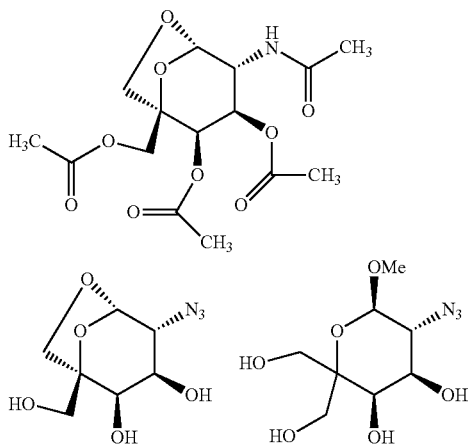

In some embodiments, an oligonucleotide comprises an additional component selected from:

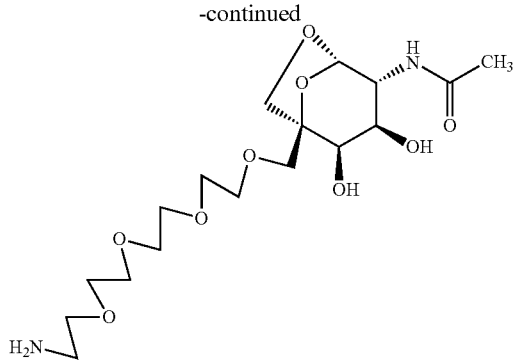

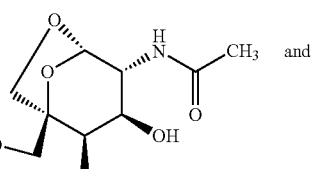 and

In some embodiments, an oligonucleotide comprises an additional component selected from any of the following formulae:

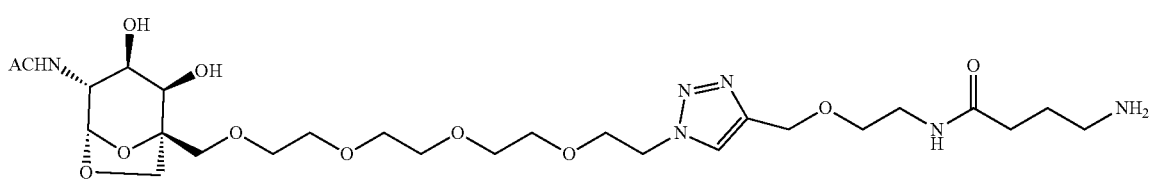

-continued
507
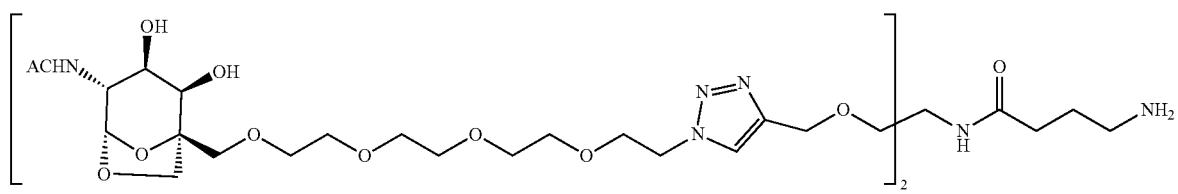
508
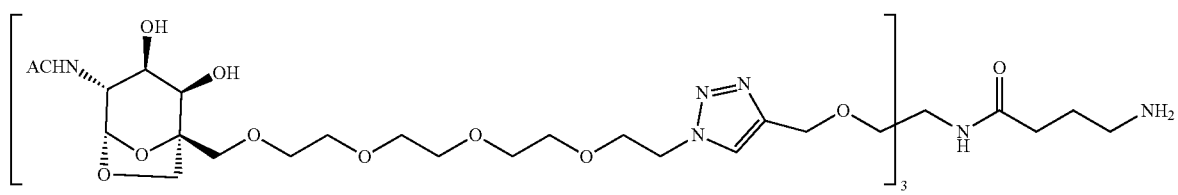
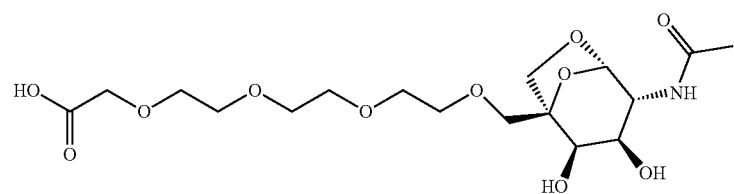
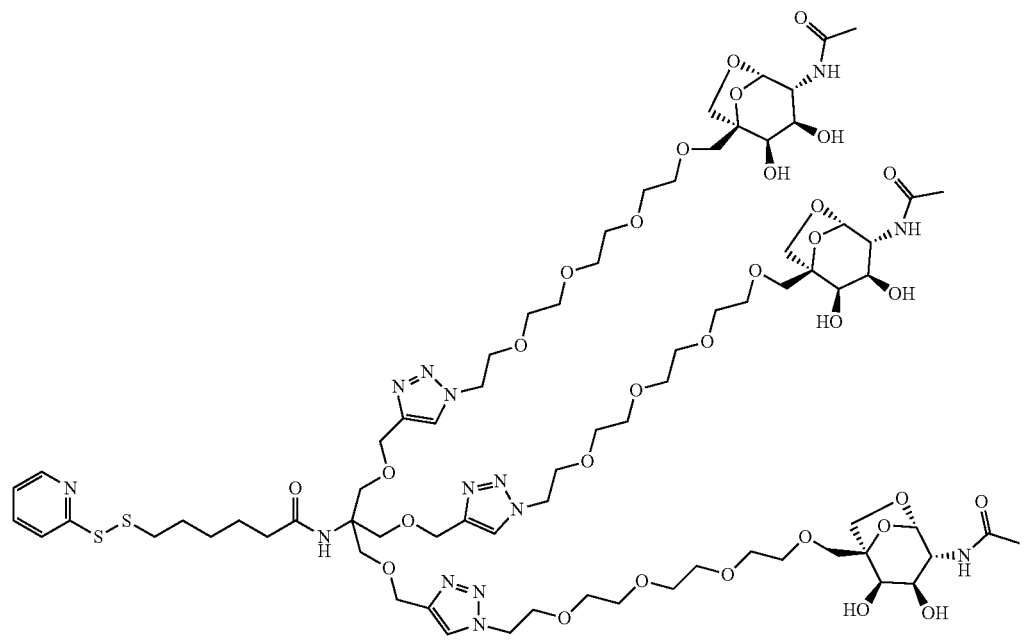

-continued
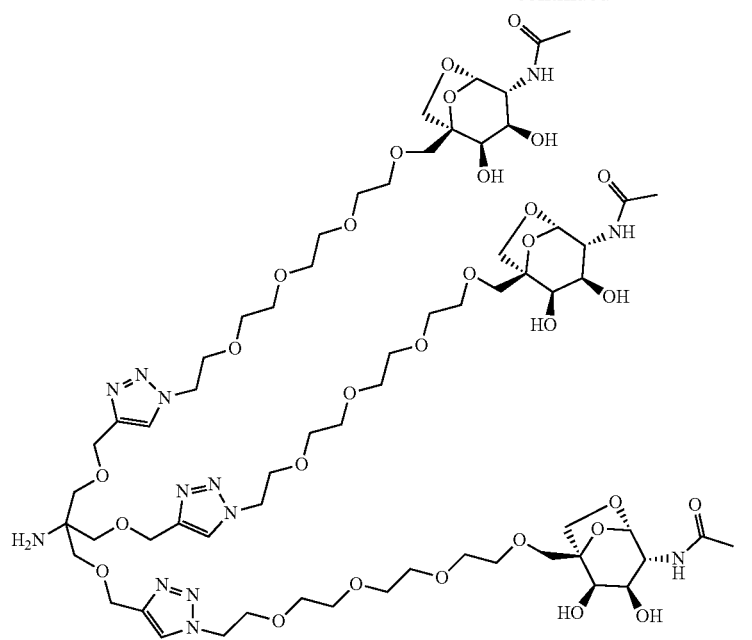
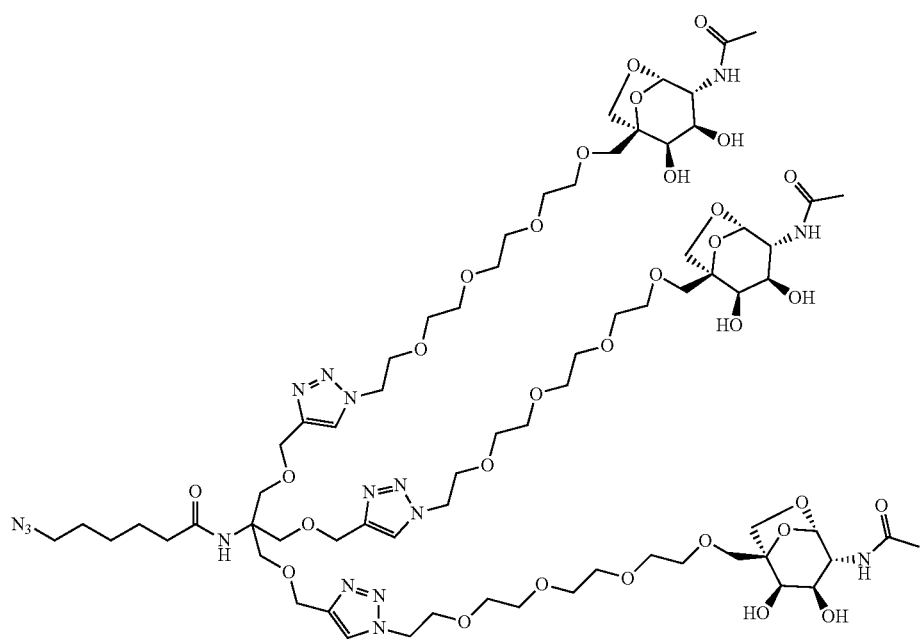

-continued
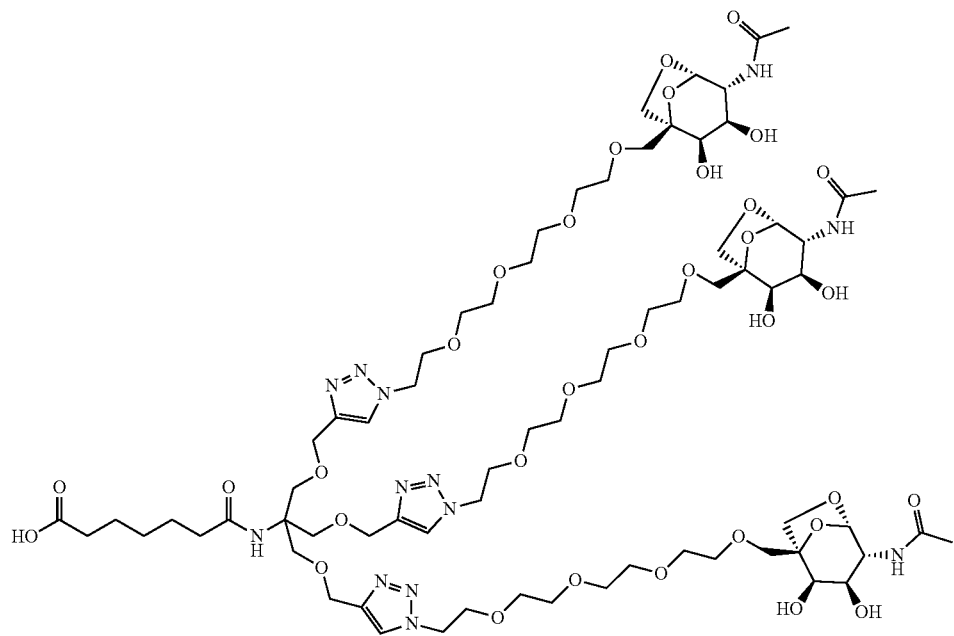
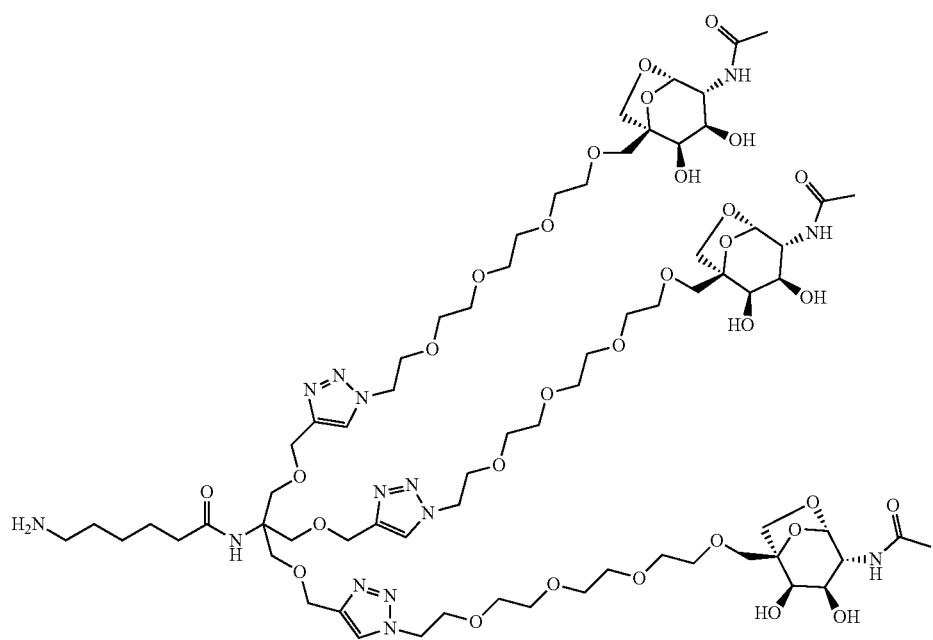

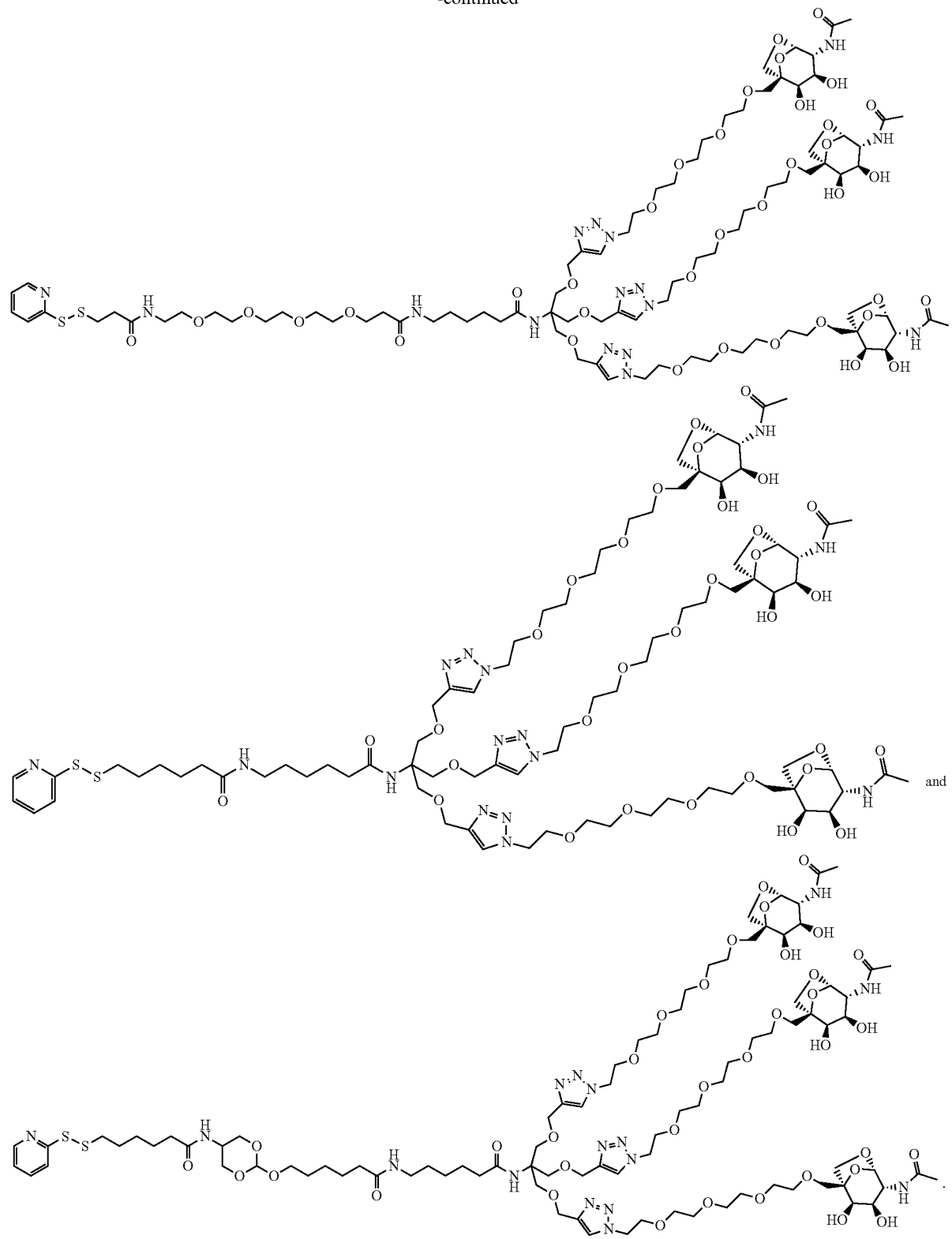

In some embodiments, a GalNAc, as the term is used herein, refers to a chemical entity which is structurally similar to a GalNAc and/or which performs at least one function of a GalNAc (e.g., binding to ASPGR).

In some embodiments, a 5'-end of a single-stranded RNAi agent comprises a GalNAc or a variant or derivative thereof.

A non-limiting example of a GalNAc moiety at the 5'-end of an oligonucleotide or single-stranded RNAi agent (e.g., 5'

GalNAc moiety) is shown below, wherein the 5' end structure, e.g., PX0-N₁-PX1-, is represented by:

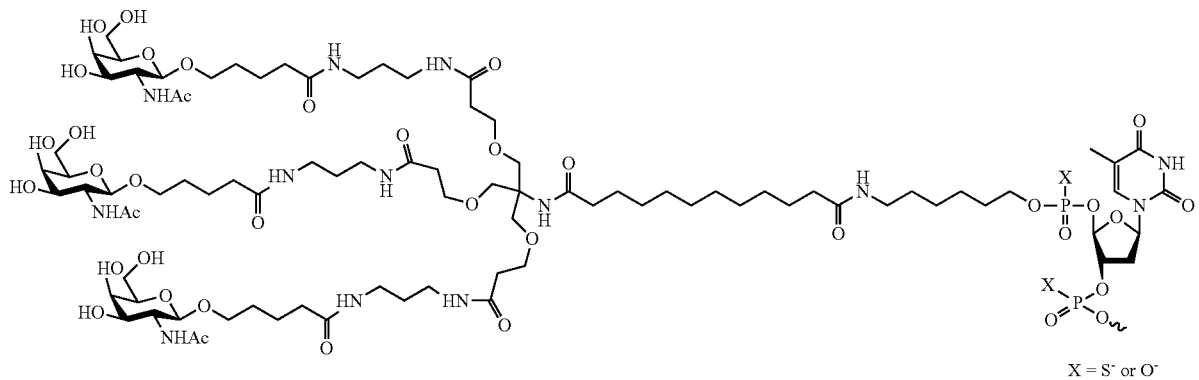

Mod001L001T

In some embodiments, a GalNAc moiety, e.g., a GalNAc or a variant or derivative thereof, is described in any of: Migawa et al. 2016 Bioorg. Med. Chem. Lett. 26: 2914-7; Ostergaard et al. 2015 Bioconjug. Chem. 26: 1451-1455; Prakash et al. 2014 Nucl. Acids Res. 42: 8796-8807; Prakash et al. 2016 J. Med. Chem. 59: 2718-33; Shemesh et al. 2016 Mol. Ther. Nucl. Acids 5: e319; St-Pierre et al. 2016 Bioorg. Med. Chem. 24: 2397-409; and/or Yu et al. 2016 Mol. Ther. Nucl. Acids 5: e317.

In some embodiments, a chemical moiety (e.g., additional component) conjugated to an oligonucleotide binds to ASPGR.

In some embodiments, a chemical moiety (e.g., additional component) conjugated to an oligonucleotide binds to ASPGR and comprises any of: Mod031, Mod034, Mod035, Mod036, Mod038, Mod039, Mod040, or Mod041.

In some embodiments, an additional component can be or comprise any of: Mod079, Mod080, Mod081, Mod082 or Mod083. In some embodiments, an additional component can be or comprise any of:

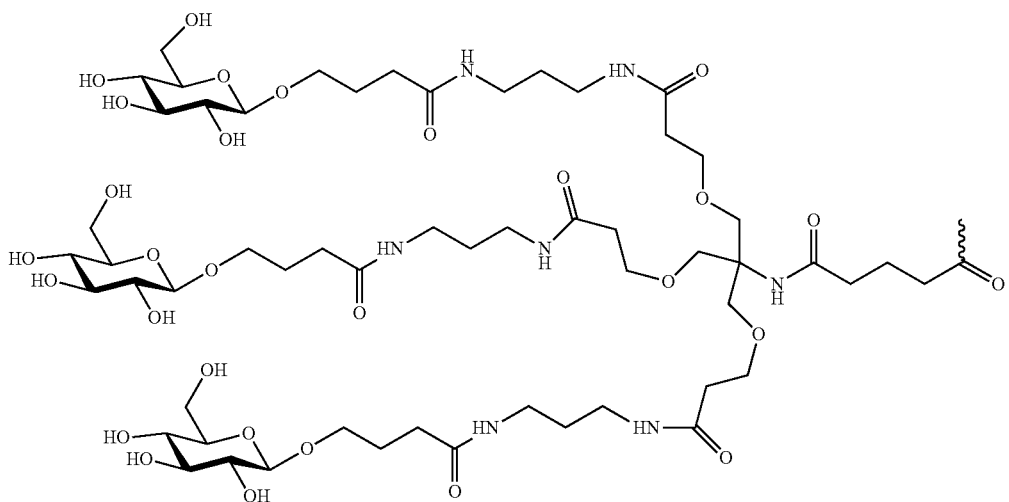

Mod059

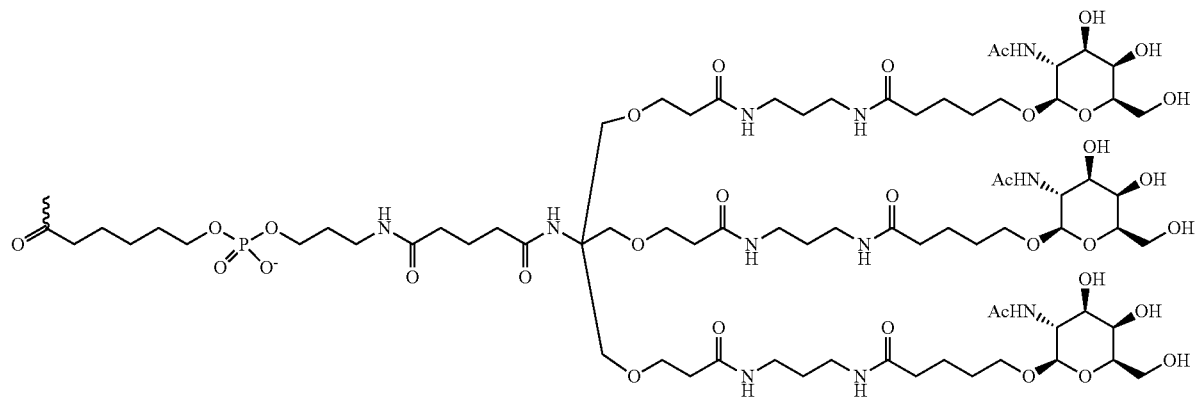
Mod060
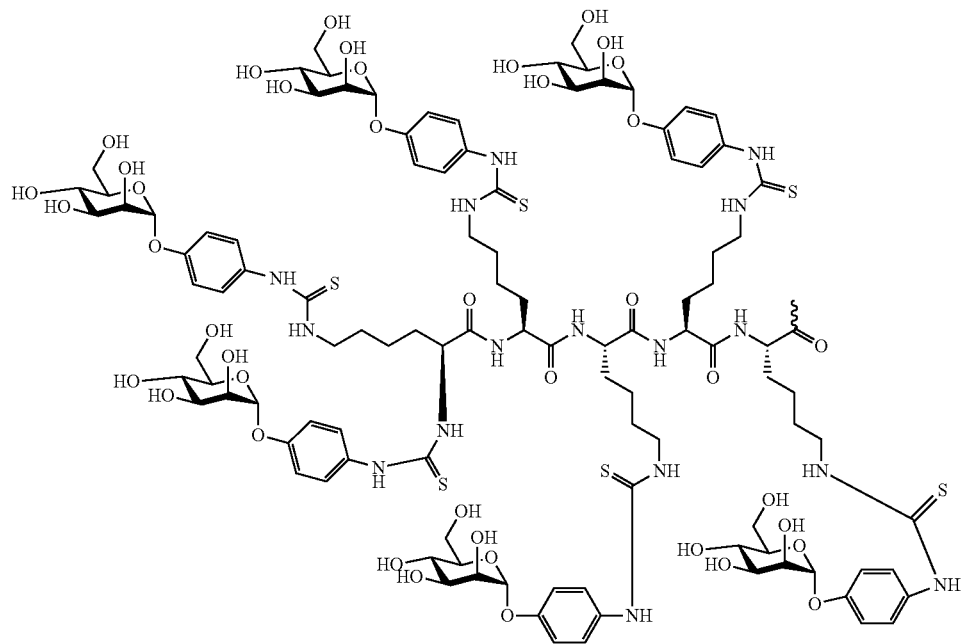
Mod065

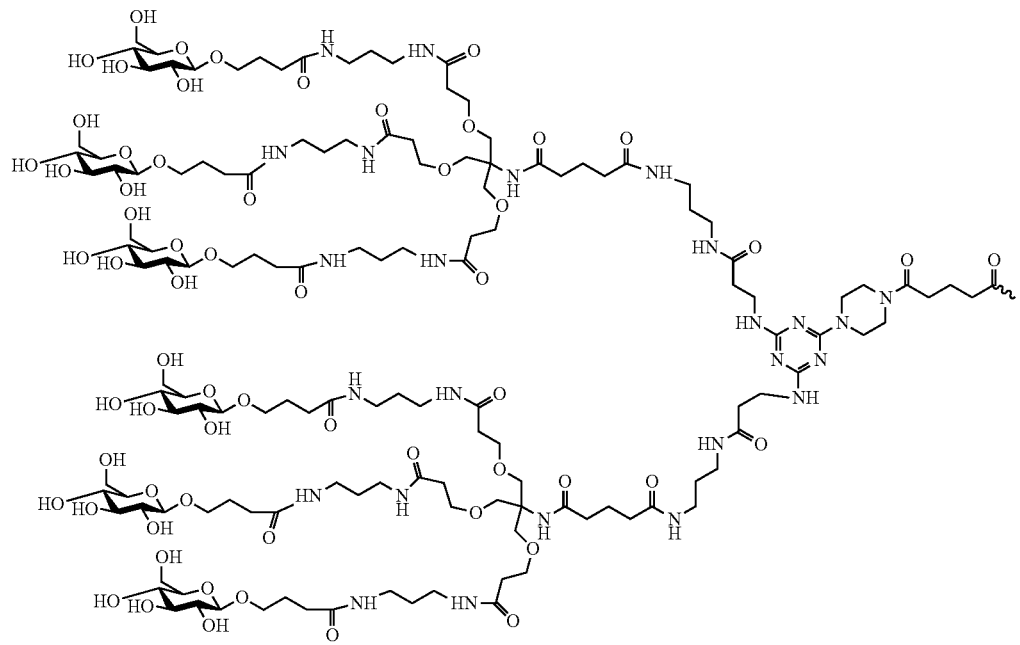
Mod070
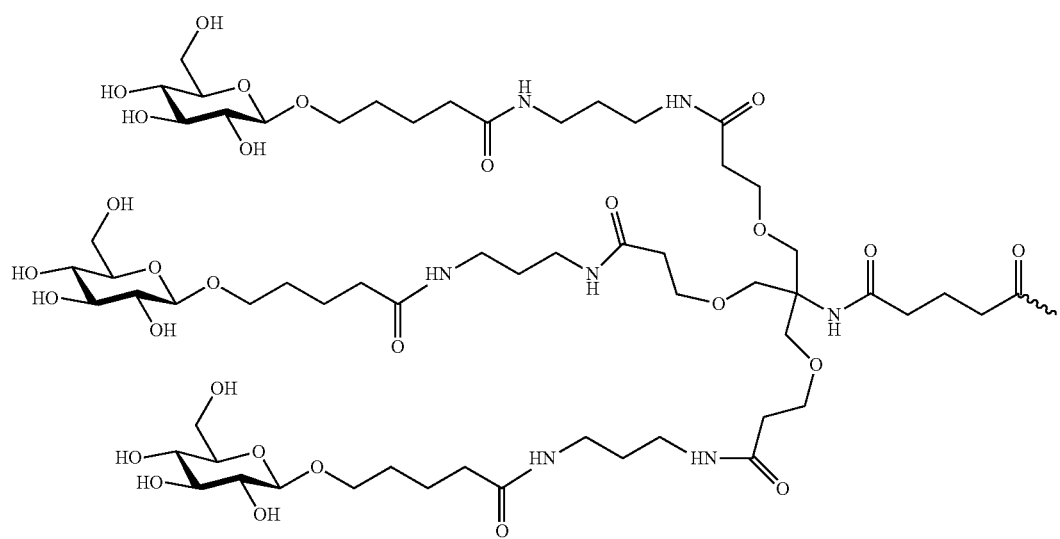
Mod071

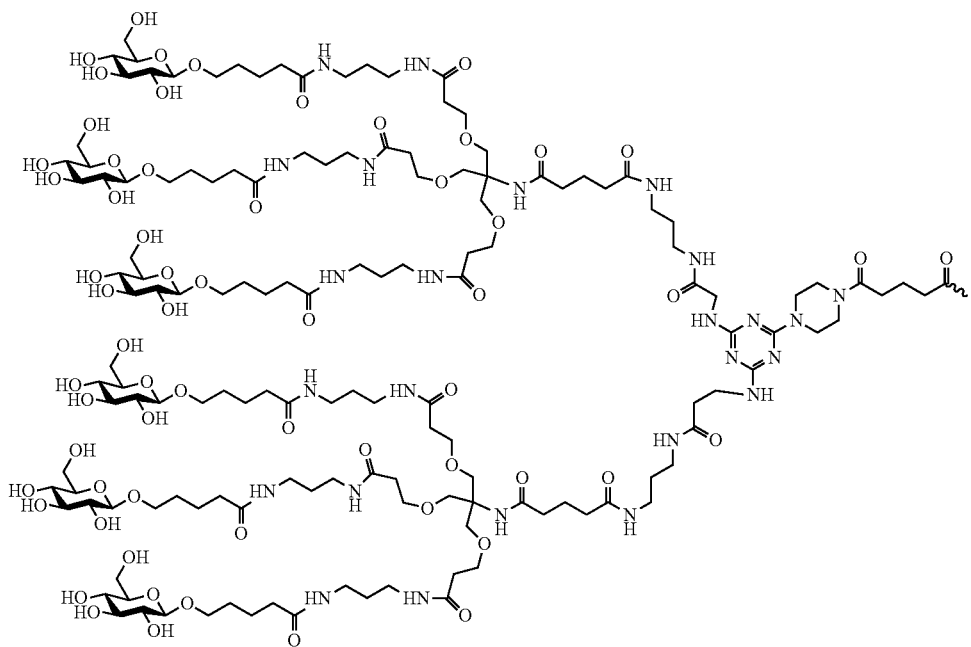
Mod072
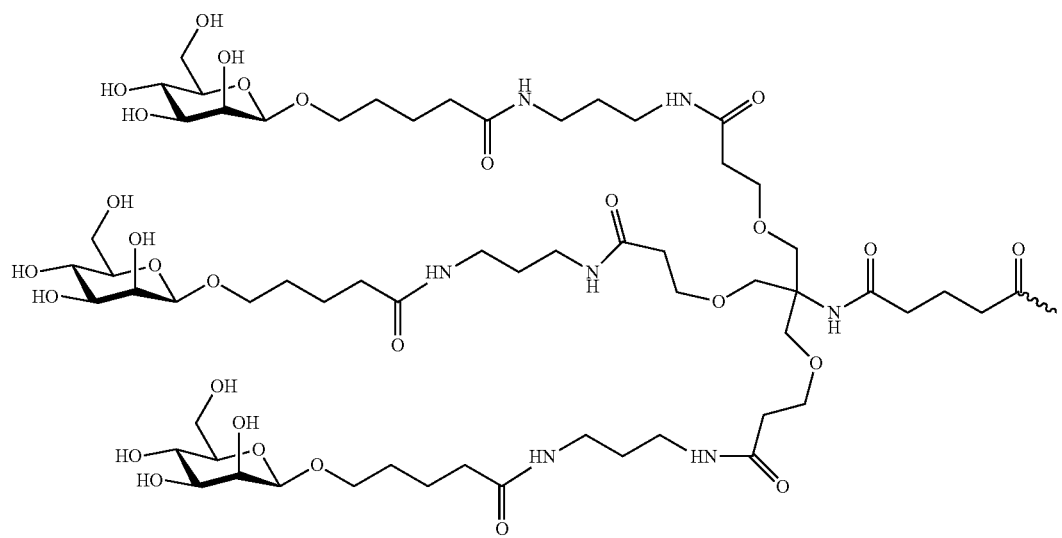
Mod073

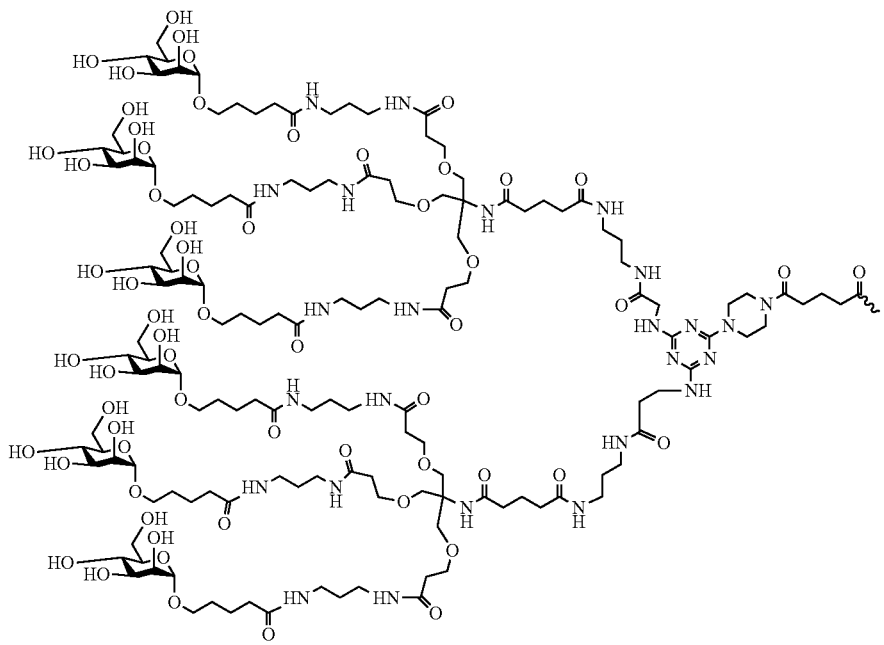
Mod074
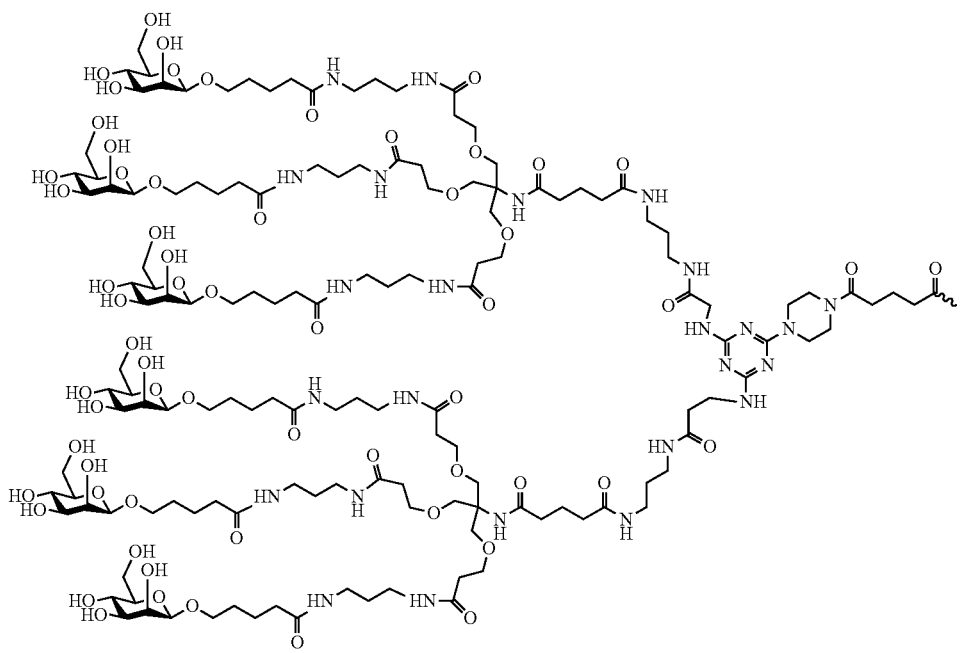
Mod075
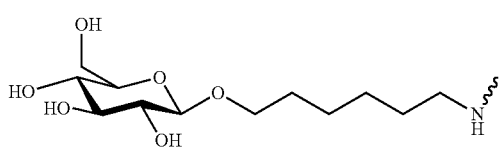
Mod076

-continued
Mod077
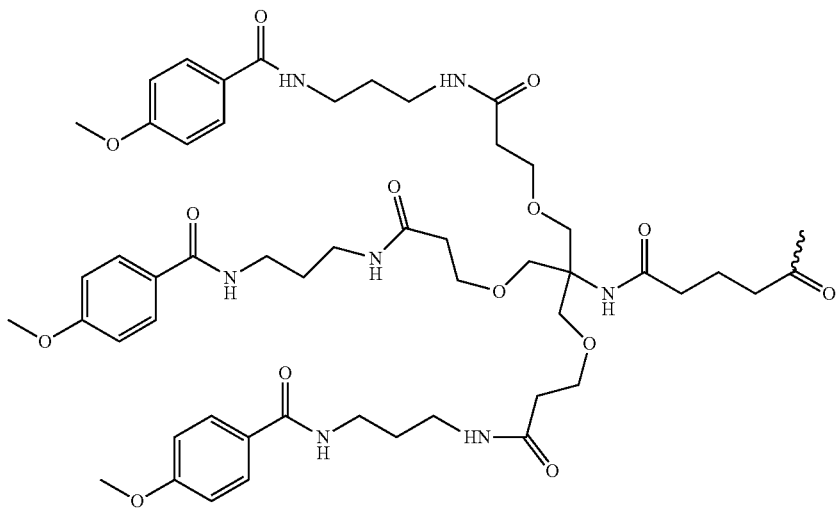
Mod084
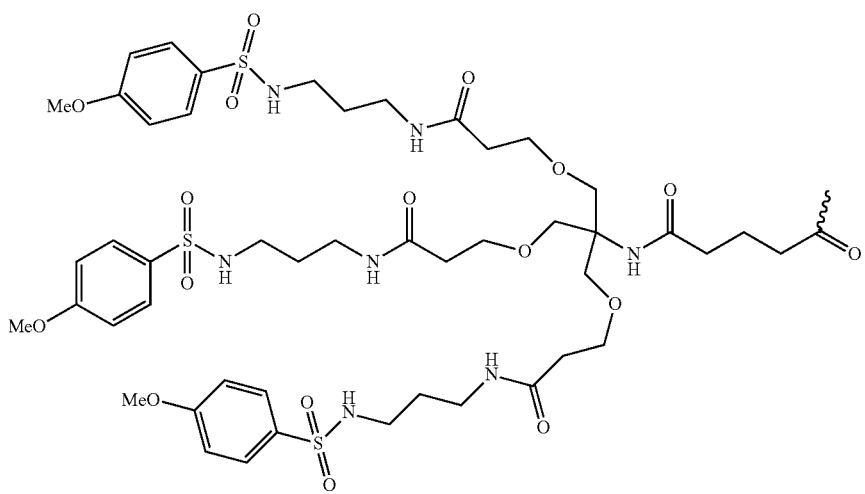
Mod085
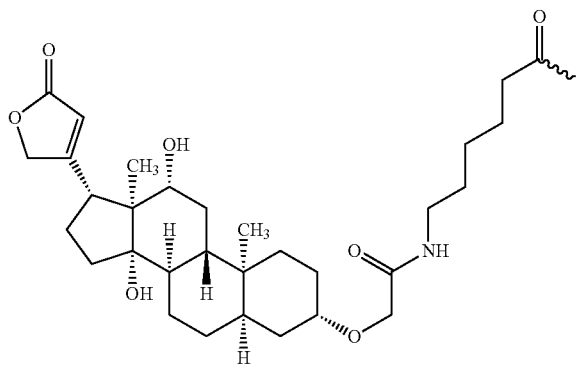

-continued

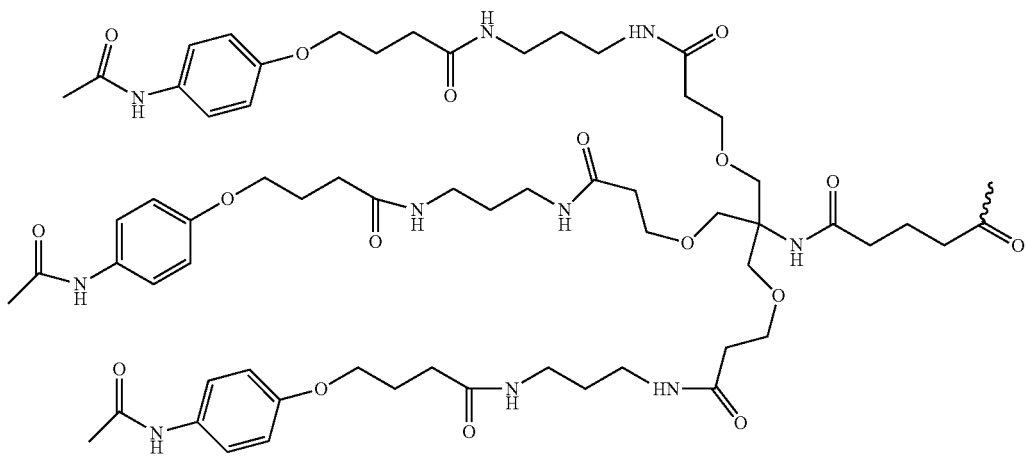

Mod087

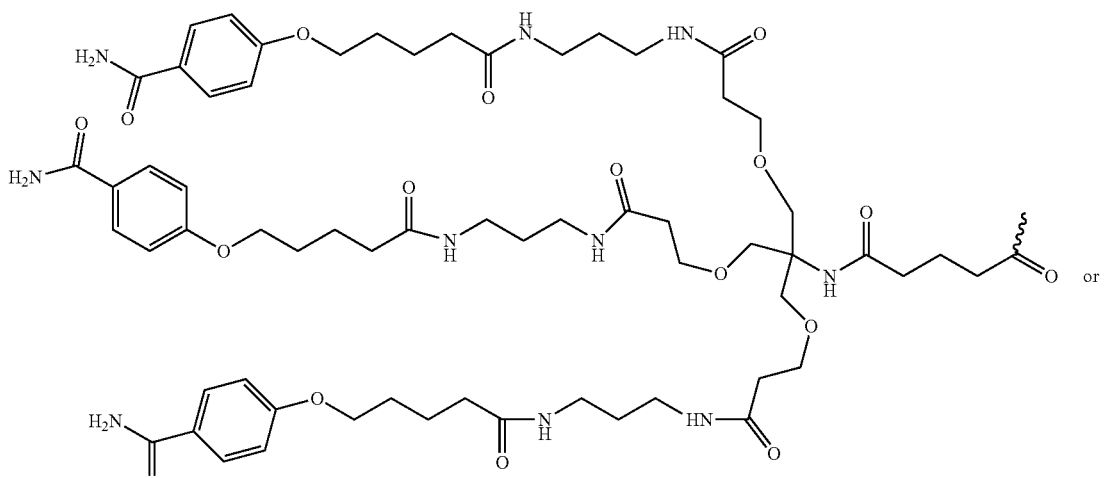

Mod088 or

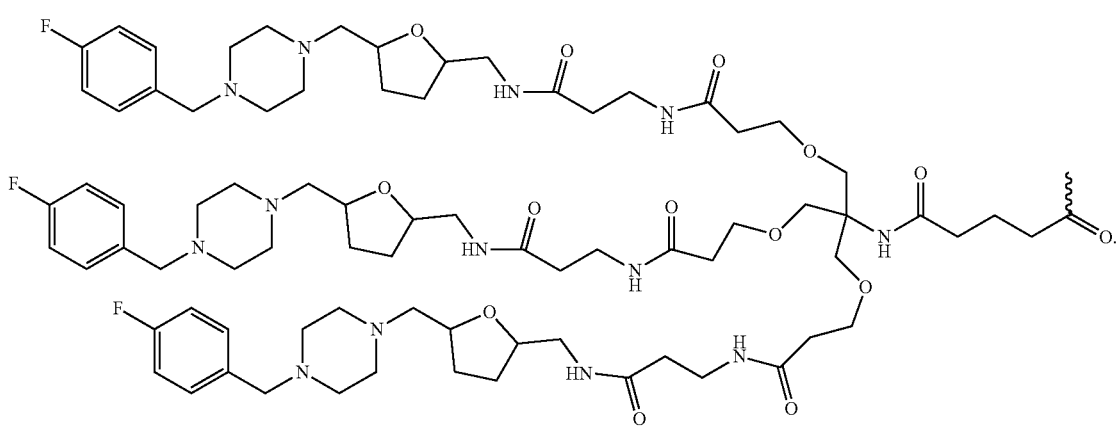

Mod089

Non-limiting examples of single-stranded RNAi agents comprising a GalNAc moiety at the 5'-end include: WV-3246, and WV-3249.

Non-limiting examples of single-stranded RNAi agents comprising a GalNAc moiety in the 5'-end structure, wherein the GalNAc moiety is Mod001 include: WV-3246, and WV-3249. In some embodiments, Mod001 is referenced as triantennary GalNAc.

Non-limiting examples of single-stranded RNAi agents comprising a GalNAc moiety at the penultimate position include: WV-3068, WV-3069, WV-3243, WV-3245, WV-3248, WV-3532, WV-6035, WV-6036, WV-6037, WV-6038, WV-6039, WV-6040, WV-6041, WV-6042, WV-6205, WV-6206, WV-6214, WV-6215, WV-7302, WV-7303, WV-7490, WV-7491, WV-7492, WV-7493, WV-7494, WV-7495, WV-7496, and WV-7497.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any 5'-end and/or any 5' nucleoside and/or any 5' nucleotide moiety described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any 5'-end and/or any 5' nucleoside and/or any 5' nucleotide moiety described herein or known in the art in combination with any other structural element or modification described herein, including but not limited to, base sequence or portion thereof, sugar, base; internucleotidic linkage; stereochemistry or pattern thereof; additional chemical moiety, including but not limited to, a targeting moiety, lipid moiety, a GalNAc moiety, etc.; seed region; post-seed region; 3'-end region; 3'-terminal dinucleotide; 3'-end cap; length; GC content; pattern of modifications of sugars, bases or internucleotidic linkages; format or any structural element thereof, and/or any other structural element or modification described herein; and in some embodiments, the present disclosure pertains to multimers of any such oligonucleotides.

5' Nucleoside or 5' Nucleotide of an Oligonucleotide

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides can comprise any 5'-nucleoside or 5'-nucleotide described herein or known in the art.

In some embodiments, the 5' nucleotide, e.g., the nucleoside at the 5'-end, of a single-stranded RNAi agent (e.g., in N1) can be any nucleoside, modified nucleoside or universal nucleoside known in the art.

In some embodiments, the 5' nucleotide, e.g., the nucleoside at the 5'-end, of a single-stranded RNAi agent (e.g., in N1) can comprise a 2' modification at the base.

In some embodiments, the nucleoside at the 5'-end of a single-stranded RNAi agent (e.g., in N1) can comprise a 2'-deoxy (DNA), 2'-F, 2'-OMe, or 2'-MOE, or an inverted nucleoside or nucleotide.

Non-limiting examples of ssRNAi agent formats in which the nucleoside at the 5'-end of the ssRNAi agent is a 2'-deoxy (DNA) include: Formats 1-5, 16-18, 22-29, 32-78, 84-93, 97, and 103-107 of FIG. 1.

Non-limiting examples of ssRNAi agent formats in which the nucleoside at the 5'-end of the ssRNAi agent is a 2'-F include: Formats 11-15, 19, 79-83, and 98-100 of FIG. 1.

Non-limiting examples of ssRNAi agent formats in which the nucleoside at the 5'-end of the ssRNAi agent is a 2'-OMe include: Formats 6-10, 20-21, 30-31, 94-96, and 101-102 of FIG. 1.

In some embodiments, the nucleobase at the 5'-end of a single-stranded RNAi agent (e.g., in N1) is T. In some embodiments, the nucleobase at the 5'-end of a single-stranded RNAi agent (e.g., in N1) is U. In some embodiments, the nucleobase at the 5'-end of a single-stranded RNAi agent (e.g., in N1) is A. In some embodiments, the nucleobase at the 5'-end of a single-stranded RNAi agent (e.g., in N1) is G. In some embodiments, the nucleobase at the 5'-end of a single-stranded RNAi agent (e.g., in N1) is C.

In some embodiments, a provided single-stranded RNAi agent has a 5' mismatch, wherein the nucleobase at the 5'-end of the single-stranded RNAi agent (position N1) has a mismatch from the corresponding position of the target transcript. As has been reported in the art, complementarity between the 5' nucleotide moiety and the corresponding position of the target transcript is not required for efficacious double-stranded siRNAs. Various example single-stranded RNAi agents described herein also have a 5' mismatch and are still capable of directing RNA interference. Efficacious ssRNAi agents have been constructed which have a mismatch with the sequence of the target mRNA at the 5' position (N1). Efficacious ssRNAi agents have been constructed which have a mismatch with the sequence of the target mRNA at the 5' position (N1) and the N1 position of the ssRNAi is T. In some embodiments, a provided single-stranded RNAi agent has a 5' mismatch at N1, wherein the nucleobase in N1 is T.

In some embodiments, the nucleoside at the 5' position (N1) is a LNA.

In some embodiments, the nucleoside at the 5' position (N1) is a 5'-H (deoxy). Efficacious ssRNAi agents have been constructed wherein the nucleoside at the 5' position (N1) is a 5'-H (deoxy). See, for example, WV-4010, WV-4270, WV-4011, WV-4271, WV-4012, WV-4272, WV-4013, and WV-4273. In some embodiments, the nucleoside at the 5' position is deoxy T, A, G, or C. In some embodiments, the nucleoside at the 5' position is deoxy T. See, for example, WV-3068, WV-2818, WV-2817, WV-3021, etc. In some embodiments, the nucleoside at the 5' position is deoxy A. See, for example, WV-2721 and WV-2720, Tables 26 and 34.

In some embodiments, the nucleoside at the 5' position (N1) is a 2'-F. Efficacious ssRNAi agents have been constructed wherein the nucleoside at the 5' position (N1) is a 2'-F. In some embodiments, the nucleoside at the 5' position (N1) is a 2'-F A. See, for example, WV-1275, WV-1277, WV-1829, WV-1830, Table 12. In some embodiments, the nucleoside at the 5' position (N1) is a 2'-F G. See, for example, WV-5300, Table 37.

In some embodiments, the nucleoside at the 5' position (N1) is a 2'-OMe. Efficacious ssRNAi agents have been constructed wherein the nucleoside at the 5' position (N1) is a 2'-OMe. See, for example, WV-2112, WV-2113, WV-2146, WV-2147, WV-2148, and WV-2149. In some embodiments, the nucleoside at the 5' position (N1) is a 2'-OMe U. See, for example, WV-2110, Tables 13, 15 and 20, inter alia; WV-1308, Tables 17 and 18; WV-2712, WV-2713, WV-2714, WV-2715, Table 20; WV-2111, Table 21; VW-2156 and WV-2157, Table 24; WV-2154 and WV-2155, Table 23; and WV-2386, Table 27. In some embodiments, the nucleoside at the 5' position (N1) is a 2'-OMe A. See, for example, WV-1828 and WV-1831, Tables 12 and 30. In some embodiments, the nucleoside at the 5' position (N1) is a 2'-OMe C. See, for example, WV-2477, Table 39.

Seed Region of an Oligonucleotide, Including a Single-Stranded RNAi Agent

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any seed region or portion or structural element thereof described herein or known in the art.

In some embodiments, a seed region of a provided single-stranded RNAi agent is a portion of the RNAi agent which is particularly important in binding of the RNAi agent to a transcript target. Lim et al. 2005 Nature 433: 769-773. In many cases, full complementarity between the seed region of the RNAi agent antisense strand and the mRNA target is reportedly required for high RNAi activity. For example, a single mismatch at position 6 in the seed region reportedly abolished double-stranded RNAi activity; Lim et al. 2005 Nature 433: 769-773. In contrast, dsRNAi antisense strands reportedly are more amenable to mismatches outside the seed region, e.g., at the 5' position, in the post-seed region, and in the 3'-terminal dinucleotide.

In some embodiments, a seed region of the structure of a single-stranded RNAi agent is represented by N2-PX2-N3-PX3-N4-PX4-N5-PX5-N6-PX6-N7-PX7. In some embodiments, a seed region of the structure of a single-stranded RNAi agent comprises the structure represented by N3-PX3-N4-PX4-N5-PX5-N6-PX6-N7-PX7. In some embodiments, a seed region of the structure of a single-stranded RNAi agent comprises the structure represented by N4-PX4-N5-PX5-N6-PX6-N7-PX7-N8-PX8-.

In some double-stranded siRNAs, in the antisense strand (and corresponding portion of the sense strand) a seed region can reportedly be replaced with DNA, while the remaining portion of the strand is RNA. Yamato et al. 2011 Cancer Gene Ther. 18: 587-597.

In some embodiments, a provided single-stranded RNAi agent comprises a seed region in which: at least 1 N is 2'-modified (e.g., where N is any of N2 to N8). In some embodiments, a provided single-stranded RNAi agent comprises a seed region in which: at least 2 N are 2'-modified. In some embodiments, a provided single-stranded RNAi agent comprises a seed region in which: at least 3 N are 2'-modified. In some embodiments, a provided single-stranded RNAi agent comprises a seed region in which: at least 4 N are 2'-modified. In some embodiments, a provided single-stranded RNAi agent comprises a seed region in which: at least 5 N are 2'-modified. In some embodiments, a provided single-stranded RNAi agent comprises a seed region in which: at least 6 N are 2'-modified.

In some embodiments, a provided single-stranded RNAi agent comprises a seed region in which: at least 1 N is 2'-deoxy (e.g., where N is any of N2 to N8). In some embodiments, a provided single-stranded RNAi agent comprises a seed region in which: at least 2 N are 2'-deoxy. In some embodiments, a provided single-stranded RNAi agent comprises a seed region in which: at least 3 N are 2'-deoxy. In some embodiments, a provided single-stranded RNAi agent comprises a seed region in which: at least 4 N are 2'-deoxy. In some embodiments, a provided single-stranded RNAi agent comprises a seed region in which: at least 5 N are 2'-deoxy. In some embodiments, a provided single-stranded RNAi agent comprises a seed region in which: at least 6 N are 2'-deoxy.

In some embodiments, a provided single-stranded RNAi agent comprises a seed region in which: at least 1 N is 2'-F (e.g., where N is any of N2 to N8). In some embodiments, a provided single-stranded RNAi agent comprises a seed region in which: at least 2 N are 2'-F. In some embodiments, a provided single-stranded RNAi agent comprises a seed region in which: at least 3 N are 2'-F. In some embodiments, a provided single-stranded RNAi agent comprises a seed region in which: at least 4 N are 2'-F. In some embodiments, a provided single-stranded RNAi agent comprises a seed region in which: at least 5 N are 2'-F. In some embodiments, a provided single-stranded RNAi agent comprises a seed region in which: at least 6 N are 2'-F.

In some embodiments, a provided single-stranded RNAi agent comprises a seed region in which: at least 1 N is 2'-OMe (e.g., where N is any of N2 to N8). In some embodiments, a provided single-stranded RNAi agent comprises a seed region in which: at least 2 N are 2'-OMe. In some embodiments, a provided single-stranded RNAi agent comprises a seed region in which: at least 3 N are 2'-OMe. In some embodiments, a provided single-stranded RNAi agent comprises a seed region in which: at least 4 N are 2'-OMe. In some embodiments, a provided single-stranded RNAi agent comprises a seed region in which: at least 5 N are 2'-OMe. In some embodiments, a provided single-stranded RNAi agent comprises a seed region in which: at least 6 N are 2'-OMe.

In some embodiments, each nucleotide in the seed region is 2'-OMe. Non-limiting examples of such an oligonucleotide are: WV-7541 and WV-7544, Tables 46M and N.

In some embodiments, each nucleotide in the seed region is 2'-OMe, and each nucleotide in the post-seed region is 2'-OMe. Non-limiting examples of such an oligonucleotide are: WV-7541 and WV-7544, Tables 46M and N.

In some embodiments, one nucleotide in the seed region is 2'-F and each other nucleotide in the seed region is 2'-OMe. Non-limiting examples of such an oligonucleotide are: WV-7540 and WV-7543, Tables 46M and N.

In some embodiments, one nucleotide in the seed region is 2'-F and each other nucleotide in the seed region is 2'-OMe, and one nucleotide in the post-seed region is 2'-F and each other nucleotide in the post-seed region is 2'-OMe. Non-limiting examples of such an oligonucleotide are: WV-7540 and WV-7543, Tables 46M and N.

In some embodiments, the nucleotide at position 2 (counting from the 5'-end) is 2'-F and each other nucleotide in the seed region is 2'-OMe, and one nucleotide in the post-seed region is 2'-F and each other nucleotide in the post-seed region is 2'-OMe. Non-limiting examples of such an oligonucleotide are: WV-7540 and WV-7543, Tables 46M and N.

In some embodiments, the nucleotide at position 2 (counting from the 5'-end) is 2'-F and each other nucleotide in the seed region is 2'-OMe, and the nucleotide at position 14 (counting from the 5'-end) is 2'-F and each other nucleotide in the post-seed region is 2'-OMe. Non-limiting examples of such an oligonucleotide are: WV-7540 and WV-7543, Tables 46M and N.

In some embodiments, a provided single-stranded RNAi agent comprises a seed region in which any number of N can be 2'-deoxy, 2'-F, 2'-OMe and/or 2'-OH, and/or have any other modification at the 2' position of the sugar.

Various non-limiting examples of seed regions of single-stranded RNAi agents are presented in Table 1A, the Figures, and elsewhere herein. Non-limiting examples of seed regions include those in which, in N2-PX2-N3-PX3-N4-PX4-N5-PX5-N6-PX6-N7-PX7: up to all 6 of PX2 to PX7 are phosphodiester; 3 of PX2 to PX7 are phosphodiester; 3 of PX2 to PX7 are phosphorothioate; 0 of PX2 to PX7 are phosphorothioate. The Figures show that efficacious single-stranded RNAi agents of various sequences, to various targets, which comprise these various structures of the seed region can mediate RNAi interference.

In some embodiments, a provided single-stranded RNAi agent comprises a seed region, N2-PX2-N3-PX3-N4-PX4-N5-PX5-N6-PX6-N7-PX7, in which: N2, N4 and N6 are 2'-OMe; and N3, N5 and N7 are 2'-F. See, for example, Formats 1, 2 and 7, FIG. 1; WV-1275 and WV-1277, Table 12; and WV-1307, Table 17.

In some embodiments, a provided single-stranded RNAi agent comprises a seed region, N2-PX2-N3-PX3-N4-PX4-N5-PX5-N6-PX6-N7-PX7, in which: N2, N4 and N6 are 2'-F; and N3, N5 and N7 are 2'-OMe. See, for example, Formats 3, 6, and 8-14, FIG. 1; and numerous single-stranded RNAi agents disclosed herein.

In some embodiments, a provided single-stranded RNAi agent comprises a seed region, N2-PX2-N3-PX3-N4-PX4-N5-PX5-N6-PX6-N7-PX7, in which: P2, P4 and P6 are phosphorothioate; and P3, P5 and P7 are phosphodiester. See, for example, Formats 3-14, FIG. 1; and numerous single-stranded RNAi agents disclosed herein.

In some embodiments, a provided single-stranded RNAi agent comprises a seed region, N2-PX2-N3-PX3-N4-PX4-N5-PX5-N6-PX6-N7-PX7, in which: P2, P4 and P6 are phosphodiester; and P3, P5 and P7 are phosphorothioate. See, for example, Format 1, FIG. 1; WV-5300 and WV-5301, Table 37 and 36; WV-1275, Table 12; and WV-2716, WV-2717, WV-2718, and WV-2719, Table 19.

In some embodiments, a provided single-stranded RNAi agent comprises a seed region, N2-PX2-N3-PX3-N4-PX4-N5-PX5-N6-PX6-N7-PX7, in which: N2, N4 and N6 are 2'-OMe; and N3, N5 and N7 are 2'-F; and P2, P4 and P6 are phosphorothioate; and P3, P5 and P7 are phosphodiester.

In some embodiments, a provided single-stranded RNAi agent comprises a seed region, N2-PX2-N3-PX3-N4-PX4-N5-PX5-N6-PX6-N7-PX7, in which: Each of PX2 to PX7 is a phosphorodiester. See, for example, Format 1, FIG. 1; and WV-1277, Table 12.

In some embodiments, a provided single-stranded RNAi agent comprises a seed region, N2-PX2-N3-PX3-N4-PX4-N5-PX5-N6-PX6-N7-PX7, in which: Each of PX2 to PX7 is a phosphodiester.

In some embodiments, a provided single-stranded RNAi agent comprises a seed region, N2-PX2-N3-PX3-N4-PX4-N5-PX5-N6-PX6-N7-PX7, in which: N2, N4 and N6 are 2'-OMe; and N3, N5 and N7 are 2'-F; and P2, P4 and P6 are phosphodiester; and P3, P5 and P7 are phosphorothioate.

In some embodiments, a provided single-stranded RNAi agent comprises a seed region, N2-PX2-N3-PX3-N4-PX4-N5-PX5-N6-PX6-N7-PX7, in which: N2, N4 and N6 are 2'-F; and N3, N5 and N7 are 2'-OMe; and P2, P4 and P6 are phosphorothioate; and P3, P5 and P7 are phosphodiester.

In some embodiments, a provided single-stranded RNAi agent comprises a seed region, N2-PX2-N3-PX3-N4-PX4-N5-PX5-N6-PX6-N7-PX7, in which: N2, N4 and N6 are 2'-F; and N3, N5 and N7 are 2'-OMe; and P2, P4 and P6 are phosphodiester; and P3, P5 and P7 are phosphorothioate.

In some embodiments, a provided single-stranded RNAi agent comprises a seed region, N2-PX2-N3-PX3-N4-PX4-N5-PX5-N6-PX6-N7-PX7, in which: N2, N4 and N6 are 2'-OMe; and N3, N5 and N7 are 2'-F; and each of P2 to P7 is a phosphorodiester.

In some embodiments, a provided single-stranded RNAi agent comprises a seed region, N2-PX2-N3-PX3-N4-PX4-N5-PX5-N6-PX6-N7-PX7, in which: N2, N4 and N6 are 2'-F; and N3, N5 and N7 are 2'-OMe; and each of P2 to P7 is a phosphodithioate.

In some embodiments, a provided single-stranded RNAi agent comprises a seed region, N2-PX2-N3-PX3-N4-PX4-N5-PX5-N6-PX6-N7-PX7, in which any 1, 2, 3, 4, 5, 6 or 7 of N2 to N7 are independently 2'-deoxy.

In some embodiments, a provided single-stranded RNAi agent comprises a seed region, in which any one or more nucleotides in the seed region are independently 2'-F. In some embodiments, a provided single-stranded RNAi agent comprises a seed region, in which any 2 or more nucleotides in the seed region are independently 2'-F. In some embodiments, a provided single-stranded RNAi agent comprises a seed region, in which any 3 or more nucleotides in the seed region are independently 2'-F. In some embodiments, a provided single-stranded RNAi agent comprises a seed region, in which any 4 or more nucleotides in the seed region are independently 2'-F. In some embodiments, a provided single-stranded RNAi agent comprises a seed region, in which any 5 or more nucleotides in the seed region are independently 2'-F. In some embodiments, a provided single-stranded RNAi agent comprises a seed region, in which any 6 or more nucleotides in the seed region are independently 2'-F.

In some embodiments, a provided single-stranded RNAi agent comprises a seed region, in which any one or more nucleotides in the seed region are independently 2'-OMe. In some embodiments, a provided single-stranded RNAi agent comprises a seed region, in which any 2 or more nucleotides in the seed region are independently 2'-OMe. In some embodiments, a provided single-stranded RNAi agent comprises a seed region, in which any 3 or more nucleotides in the seed region are independently 2'-OMe. In some embodiments, a provided single-stranded RNAi agent comprises a seed region, in which any 4 or more nucleotides in the seed region are independently 2'-OMe. In some embodiments, a provided single-stranded RNAi agent comprises a seed region, in which any 5 or more nucleotides in the seed region are independently 2'-OMe. In some embodiments, a provided single-stranded RNAi agent comprises a seed region, in which any 6 or more nucleotides in the seed region are independently 2'-OMe. In some embodiments, a provided single-stranded RNAi agent comprises a seed region, in which 7 of N2 to N7 are independently 2'-OMe.

In some embodiments, a provided single-stranded RNAi agent comprises a seed region, in which any one or more nucleotides in the seed region are independently 2'-MOE. In some embodiments, a provided single-stranded RNAi agent comprises a seed region, in which any 2 or more nucleotides in the seed region are independently 2'-MOE. In some embodiments, a provided single-stranded RNAi agent comprises a seed region, in which any 3 or more nucleotides in the seed region are independently 2'-MOE. In some embodiments, a provided single-stranded RNAi agent comprises a seed region, in which any 4 or more nucleotides in the seed region are independently 2'-MOE. In some embodiments, a provided single-stranded RNAi agent comprises a seed region, in which any 5 or more nucleotides in the seed region are independently 2'-MOE. In some embodiments, a provided single-stranded RNAi agent comprises a seed region, in which any 6 or more nucleotides in the seed region are independently 2'-MOE. In some embodiments, a provided single-stranded RNAi agent comprises a seed region, in which 7 of N2 to N7 are independently 2'-MOE.

In some embodiments, a provided single-stranded RNAi agent comprises a seed region, in which any one or more nucleotides in the seed region are independently 2'-deoxy. In some embodiments, a provided single-stranded RNAi agent comprises a seed region, in which any 2 or more nucleotides in the seed region are independently 2'-deoxy. In some embodiments, a provided single-stranded RNAi agent comprises a seed region, in which any 3 or more nucleotides in the seed region are independently 2'-deoxy. In some embodiments, a provided single-stranded RNAi agent comprises a seed region, in which any 4 or more nucleotides in the seed region are independently 2'-deoxy. In some embodiments, a provided single-stranded RNAi agent comprises a seed region, in which any 5 or more nucleotides in the seed region are independently 2'-deoxy. In some embodiments, a provided single-stranded RNAi agent comprises a seed region, in which any 6 or more nucleotides in the seed region are independently 2'-deoxy. In some embodiments, a provided single-stranded RNAi agent comprises a seed region, in which 7 of N2 to N7 are independently 2'-deoxy.

In some embodiments, a provided single-stranded RNAi agent comprises a seed region, in which any one or more non-consecutive nucleotides in the seed region are independently 2'-F. In some embodiments, a provided single-stranded RNAi agent comprises a seed region, in which any 2 or more non-consecutive nucleotides in the seed region are independently 2'-F. In some embodiments, a provided single-stranded RNAi agent comprises a seed region, in which any 3 or more non-consecutive nucleotides in the seed region are independently 2'-F. In some embodiments, a provided single-stranded RNAi agent comprises a seed region, in which any 4 or more non-consecutive nucleotides in the seed region are independently 2'-F.

In some embodiments, a provided single-stranded RNAi agent comprises a seed region, in which any one or more non-consecutive nucleotides in the seed region are independently 2'-OMe. In some embodiments, a provided single-stranded RNAi agent comprises a seed region, in which any 2 or more non-consecutive nucleotides in the seed region are independently 2'-OMe. In some embodiments, a provided single-stranded RNAi agent comprises a seed region, in which any 3 or more non-consecutive nucleotides in the seed region are independently 2'-OMe. In some embodiments, a provided single-stranded RNAi agent comprises a seed region, in which any 4 or more non-consecutive nucleotides in the seed region are independently 2'-OMe.

In some embodiments, a provided single-stranded RNAi agent comprises a seed region, in which any one or more non-consecutive nucleotides in the seed region are independently 2'-MOE. In some embodiments, a provided single-stranded RNAi agent comprises a seed region, in which any 2 or more non-consecutive nucleotides in the seed region are independently 2'-MOE. In some embodiments, a provided single-stranded RNAi agent comprises a seed region, in which any 3 or more non-consecutive nucleotides in the seed region are independently 2'-MOE. In some embodiments, a provided single-stranded RNAi agent comprises a seed region, in which any 4 or more non-consecutive nucleotides in the seed region are independently 2'-MOE.

In some embodiments, a provided single-stranded RNAi agent comprises a seed region, in which any one or more non-consecutive nucleotides in the seed region are independently 2'-deoxy. In some embodiments, a provided single-stranded RNAi agent comprises a seed region, in which any 2 or more non-consecutive nucleotides in the seed region are independently 2'-deoxy. In some embodiments, a provided single-stranded RNAi agent comprises a seed region, in which any 3 or more non-consecutive nucleotides in the seed region are independently 2'-deoxy. In some embodiments, a provided single-stranded RNAi agent comprises a seed region, in which any 4 or more non-consecutive nucleotides in the seed region are independently 2'-deoxy.

In some embodiments, a provided single-stranded RNAi agent comprises a seed region, in which any 3 of the nucleotides in the seed region are independently 2'-deoxy. In some embodiments, the seed region is or comprises: -N2-PX2-N3-PX3-N4-PX4-N5-PX5-N6-PX6-N7-PX7-. Non-limiting examples of single-stranded RNAi agents of this structure include: WV-2716, WV-2717, WV-2718, and WV-2719, Table 19.

In some embodiments, a provided single-stranded RNAi agent comprises a seed region, in which any one or more internucleotidic linkages in the seed region are independently PO (phosphodiester). In some embodiments, a provided single-stranded RNAi agent comprises a seed region, in which any 2 or more internucleotidic linkages in the seed region are independently PO. In some embodiments, a provided single-stranded RNAi agent comprises a seed region, in which any 3 or more internucleotidic linkages in the seed region are independently PO. In some embodiments, a provided single-stranded RNAi agent comprises a seed region, in which any 4 or more internucleotidic linkages in the seed region are independently PO. In some embodiments, a provided single-stranded RNAi agent comprises a seed region, in which any 5 or more internucleotidic linkages in the seed region are independently PO. In some embodiments, a provided single-stranded RNAi agent comprises a seed region, in which any 6 or more internucleotidic linkages in the seed region are independently PO. In some embodiments, a provided single-stranded RNAi agent comprises a seed region, in which 7 of N2 to N7 are independently PO.

In some embodiments, a provided single-stranded RNAi agent comprises a seed region, in which any one or more internucleotidic linkages in the seed region are independently PS (phosphorothioate). In some embodiments, a provided single-stranded RNAi agent comprises a seed region, in which any 2 or more internucleotidic linkages in the seed region are independently PS. In some embodiments, a provided single-stranded RNAi agent comprises a seed region, in which any 3 or more internucleotidic linkages in the seed region are independently PS. In some embodiments, a provided single-stranded RNAi agent comprises a seed region, in which any 4 or more internucleotidic linkages in the seed region are independently PS. In some embodiments, a provided single-stranded RNAi agent comprises a seed region, in which any 5 or more internucleotidic linkages in the seed region are independently PS. In some embodiments, a provided single-stranded RNAi agent comprises a seed region, in which any 6 or more internucleotidic linkages in the seed region are independently PS. In some embodiments, a provided single-stranded RNAi agent comprises a seed region, in which 7 of N2 to N7 are independently PS.

In some embodiments, a provided single-stranded RNAi agent comprises a seed region, in which any one or more internucleotidic linkages in the seed region are independently Sp (phosphorothioate in the Sp configuration). In some embodiments, a provided single-stranded RNAi agent comprises a seed region, in which any 2 or more internucleotidic linkages in the seed region are independently Sp. In some embodiments, a provided single-stranded RNAi agent comprises a seed region, in which any 3 or more internucleotidic linkages in the seed region are independently Sp. In some embodiments, a provided single-stranded RNAi agent comprises a seed region, in which any 4 or more internucleotidic linkages in the seed region are independently Sp. In some embodiments, a provided single-stranded RNAi agent comprises a seed region, in which any 5 or more internucleotidic linkages in the seed region are independently Sp. In some embodiments, a provided single-stranded RNAi agent comprises a seed region, in which any 6 or more internucleotidic linkages in the seed region are independently Sp. In some embodiments, a provided single-stranded RNAi agent comprises a seed region, in which 7 of N2 to N7 are independently Sp.

In some embodiments, a provided single-stranded RNAi agent comprises a seed region, in which any one or more internucleotidic linkages in the seed region are independently Rp (phosphorothioate in the Rp configuration). In some embodiments, a provided single-stranded RNAi agent comprises a seed region, in which any 2 or more internucleotidic linkages in the seed region are independently Rp. In some embodiments, a provided single-stranded RNAi agent comprises a seed region, in which any 3 or more internucleotidic linkages in the seed region are independently Rp. In some embodiments, a provided single-stranded RNAi agent comprises a seed region, in which any 4 or more internucleotidic linkages in the seed region are independently Rp. In some embodiments, a provided single-stranded RNAi agent comprises a seed region, in which any 5 or more internucleotidic linkages in the seed region are independently Rp. In some embodiments, a provided single-stranded RNAi agent comprises a seed region, in which any 6 or more internucleotidic linkages in the seed region are independently Rp. In some embodiments, a provided single-stranded RNAi agent comprises a seed region, in which 7 of N2 to N7 are independently Rp.

In some embodiments, a provided single-stranded RNAi agent comprises a seed region, in which any one or more non-consecutive internucleotidic linkages in the seed region are independently PO. In some embodiments, a provided single-stranded RNAi agent comprises a seed region, in which any 2 or more non-consecutive internucleotidic linkages in the seed region are independently PO. In some embodiments, a provided single-stranded RNAi agent comprises a seed region, in which any 3 or more non-consecutive internucleotidic linkages in the seed region are independently PO. In some embodiments, a provided single-stranded RNAi agent comprises a seed region, in which any 4 or more non-consecutive internucleotidic linkages in the seed region are independently PO.

In some embodiments, a provided single-stranded RNAi agent comprises a seed region, in which any one or more non-consecutive internucleotidic linkages in the seed region are independently Sp. In some embodiments, a provided single-stranded RNAi agent comprises a seed region, in which any 2 or more non-consecutive internucleotidic linkages in the seed region are independently Sp. In some embodiments, a provided single-stranded RNAi agent comprises a seed region, in which any 3 or more non-consecutive internucleotidic linkages in the seed region are independently Sp. In some embodiments, a provided single-stranded RNAi agent comprises a seed region, in which any 4 or more non-consecutive internucleotidic linkages in the seed region are independently Sp.

In some embodiments, a provided single-stranded RNAi agent comprises a seed region, in which any one or more non-consecutive internucleotidic linkages in the seed region are independently Rp. In some embodiments, a provided single-stranded RNAi agent comprises a seed region, in which any 2 or more non-consecutive internucleotidic linkages in the seed region are independently Rp. In some embodiments, a provided single-stranded RNAi agent comprises a seed region, in which any 3 or more non-consecutive internucleotidic linkages in the seed region are independently Rp. In some embodiments, a provided single-stranded RNAi agent comprises a seed region, in which any 4 or more non-consecutive internucleotidic linkages in the seed region are independently Rp.

In some embodiments, a provided single-stranded RNAi agent comprises a seed region, in which any one or more non-consecutive internucleotidic linkages in the seed region are independently PS. In some embodiments, a provided single-stranded RNAi agent comprises a seed region, in which any 2 or more non-consecutive internucleotidic linkages in the seed region are independently PS. In some embodiments, a provided single-stranded RNAi agent comprises a seed region, in which any 3 or more non-consecutive internucleotidic linkages in the seed region are independently PS. In some embodiments, a provided single-stranded RNAi agent comprises a seed region, in which any 4 or more non-consecutive internucleotidic linkages in the seed region are independently PS.

In some embodiments, a provided single-stranded RNAi agent comprises a seed region, in which the pattern of 2' modifications of the nucleotides comprises the pattern of 2' modifications of the nucleotides in the seed region of any single-stranded RNAi format shown in FIG. 1.

In some embodiments, a provided single-stranded RNAi agent comprises a seed region, in which the pattern of 2' modifications of the nucleotides comprises: fmfmfm, where f is 2'-F and m is 2'-OMe. Non-limiting examples of such single-stranded RNAi agents include: WV-2112, Table 2; WV-2113, Table 3; WV-2146, Table 3; WV-2147, Table 3; WV-2148, Table 3; WV-2149, Table 3; WV-4012, Table 4C; WV-4013, Table 4C; WV-4010, Table 5; WV-4270, Table 5; WV-3755, Table 6; and many more oligonucleotides disclosed herein.

In some embodiments, a provided single-stranded RNAi agent comprises a seed region, in which the pattern of 2' modifications of the nucleotides comprises: fmfmfmf, where f is 2'-F and m is 2'-OMe. Non-limiting examples of such single-stranded RNAi agents include: WV-2112, Table 2; WV-2113, Table 3; WV-2146, Table 3; WV-2147, Table 3; WV-2148, Table 3; WV-2149, Table 3; WV-4012, Table 4C; WV-4013, Table 4C; WV-4010, Table 5; WV-4270, Table 5; WV-3755, Table 6; and many more oligonucleotides disclosed herein.

In some embodiments, a provided single-stranded RNAi agent comprises a seed region, in which the pattern of 2' modifications of the nucleotides comprises: mfmfmf, where f is 2'-F and m is 2'-OMe. Non-limiting examples of such single-stranded RNAi agents include: WV-2112, Table 2; WV-2113, Table 3; WV-2146, Table 3; WV-2147, Table 3; WV-2148, Table 3; WV-2149, Table 3; WV-4012, Table 4C; WV-4013, Table 4C; WV-4010, Table 5; WV-4270, Table 5; WV-3755, Table 6; and many more oligonucleotides disclosed herein.

In some embodiments, a provided single-stranded RNAi agent comprises a seed region, in which the pattern of 2' modifications of the nucleotides comprises: fmfmf, where f is 2'-F and m is 2'-OMe. Non-limiting examples of such single-stranded RNAi agents include: WV-2112, Table 2; WV-2113, Table 3; WV-2146, Table 3; WV-2147, Table 3; WV-2148, Table 3; WV-2149, Table 3; WV-4012, Table 4C; WV-4013, Table 4C; WV-4010, Table 5; WV-4270, Table 5; WV-3755, Table 6; and many more oligonucleotides disclosed herein.

In some embodiments, a provided single-stranded RNAi agent comprises a seed region, in which the pattern of 2' modifications of the nucleotides comprises: mfmfmf, where f is 2'-F and m is 2'-OMe. Non-limiting examples of such single-stranded RNAi agents include: WV-1275, Table 12; WV-1277, Table 12; WV-1307, Table 17; WV-2656, Table 31; WV-2657, Table 31; and WV-2658, Table 31.

In some embodiments, a provided single-stranded RNAi agent comprises a seed region, in which the pattern of 2' modifications of the nucleotides comprises: mfmfm, where f is 2'-F and m is 2'-OMe. Non-limiting examples of such single-stranded RNAi agents include: WV-1275, Table 12; WV-1277, Table 12; WV-1307, Table 17; WV-2656, Table 31; WV-2657, Table 31; and WV-2658, Table 31.

In some embodiments, a provided single-stranded RNAi agent comprises a seed region, in which the pattern of 2' modifications of the nucleotides comprises: mfmfmfm, where f is 2'-F and m is 2'-OMe. Non-limiting examples of such single-stranded RNAi agents include: WV-1275, Table 12; WV-1277, Table 12; WV-1307, Table 17; WV-2656, Table 31; WV-2657, Table 31; and WV-2658, Table 31.

In some embodiments, a provided single-stranded RNAi agent comprises a seed region, in which the pattern of 2' modifications of the nucleotides comprises: fmfmf, where f is 2'-F and m is 2'-OMe. Non-limiting examples of such single-stranded RNAi agents include: WV-1275, Table 12; WV-1277, Table 12; WV-1307, Table 17; WV-2656, Table 31; WV-2657, Table 31; and WV-2658, Table 31.

In some embodiments, a provided single-stranded RNAi agent comprises a seed region, in which the pattern of 2' modifications of the nucleotides comprises: mfmfmfm, where f is 2'-F and m is 2'-OMe. Non-limiting examples of such single-stranded RNAi agents include: WV-1275, Table 12; WV-1277, Table 12; WV-1307, Table 17; WV-2656, Table 31; WV-2657, Table 31; and WV-2658, Table 31.

In some embodiments, a provided single-stranded RNAi agent comprises a seed region, in which the pattern of 2' modifications of the nucleotides comprises: mfmfmf, where f is 2'-F, m is 2'-OMe, and M is 2'-MOE. Non-limiting examples of such single-stranded RNAi agents include: WV-6427, Table 39.

In some embodiments, a provided single-stranded RNAi agent comprises a seed region, in which the pattern of 2' modifications of the nucleotides comprises: mfmfmfm, where f is 2'-F, m is 2'-OMe, and M is 2'-MOE. Non-limiting examples of such single-stranded RNAi agents include: WV-6427, Table 39.

In some embodiments, a provided single-stranded RNAi agent comprises a seed region, in which the pattern of 2' modifications of the nucleotides comprises: mfmfm, where f is 2'-F, m is 2'—OMe, and M is 2'-MOE. Non-limiting examples of such single-stranded RNAi agents include: WV-6427, Table 39.

In some embodiments, a provided single-stranded RNAi agent comprises a seed region, in which the pattern of 2' modifications of the nucleotides comprises: mfmf, where f is 2'-F, m is 2'-OMe, and M is 2'-MOE. Non-limiting examples of such single-stranded RNAi agents include: WV-6427, Table 39.

In some embodiments, a provided single-stranded RNAi agent comprises a seed region, in which the pattern of 2' modifications of the nucleotides comprises: mfmfmf, where f is 2'-F, m is 2'-OMe, and M is 2'-MOE. Non-limiting examples of such single-stranded RNAi agents include: WV-6428, Table 39.

In some embodiments, a provided single-stranded RNAi agent comprises a seed region, in which the pattern of 2' modifications of the nucleotides comprises: mfmfmfm, where f is 2'-F, m is 2'-OMe, and M is 2'-MOE. Non-limiting examples of such single-stranded RNAi agents include: WV-6428, Table 39.

In some embodiments, a provided single-stranded RNAi agent comprises a seed region, in which the pattern of 2' modifications of the nucleotides comprises: mfmfM, where f is 2'-F, m is 2'-OMe, and M is 2'-MOE. Non-limiting examples of such single-stranded RNAi agents include: WV-6428, Table 39.

In some embodiments, a provided single-stranded RNAi agent comprises a seed region, in which the pattern of 2' modifications of the nucleotides comprises: mfmfMf, where f is 2'-F, m is 2'-OMe, and M is 2'-MOE. Non-limiting examples of such single-stranded RNAi agents include: WV-6426, Table 39.

In some embodiments, a provided single-stranded RNAi agent comprises a seed region, in which the pattern of 2' modifications of the nucleotides comprises: mfmfMfM, where f is 2'-F, m is 2'-OMe, and M is 2'-MOE. Non-limiting examples of such single-stranded RNAi agents include: WV-6426, Table 39.

In some embodiments, a provided single-stranded RNAi agent comprises a seed region, in which the pattern of 2' modifications of the nucleotides comprises: mfmfM, where f is 2'-F, m is 2'-OMe, and M is 2'-MOE. Non-limiting examples of such single-stranded RNAi agents include: WV-6426, Table 39.

In some embodiments, a provided single-stranded RNAi agent comprises a seed region, in which the pattern of 2' modifications of the nucleotides comprises: fdfdfd, where d is 2'-deoxy and m is 2'-OMe. Non-limiting examples of such single-stranded RNAi agents include: WV-2716, Table 19; WV-2717, Table 19; WV-2718, Table 19; and WV-2719, Table 19.

In some embodiments, a provided single-stranded RNAi agent comprises a seed region, in which the pattern of 2' modifications of the nucleotides comprises: fdfdfdf, where d is 2'-deoxy and m is 2'-OMe. Non-limiting examples of such single-stranded RNAi agents include: WV-2716, Table 19; WV-2717, Table 19; WV-2718, Table 19; and WV-2719, Table 19.

In some embodiments, a provided single-stranded RNAi agent comprises a seed region, in which the pattern of 2' modifications of the nucleotides comprises: dfdfdf, where d is 2'-deoxy and m is 2'-OMe. Non-limiting examples of such single-stranded RNAi agents include: WV-2716, Table 19; WV-2717, Table 19; WV-2718, Table 19; and WV-2719, Table 19.

In some embodiments, a provided single-stranded RNAi agent comprises a seed region, in which the pattern of 2' modifications of the nucleotides comprises: fdfdf, where d is 2'-deoxy and m is 2'-OMe. Non-limiting examples of such single-stranded RNAi agents include: WV-2716, Table 19; WV-2717, Table 19; WV-2718, Table 19; and WV-2719, Table 19.

In some embodiments, a provided single-stranded RNAi agent comprises a seed region, in which the pattern of 2' modifications of the nucleotides comprises: ffmmmm, where f is 2'-F and m is 2'-OMe. Non-limiting examples of such single-stranded RNAi agents include: WV-1829, Table 12.

In some embodiments, a provided single-stranded RNAi agent comprises a seed region, in which the pattern of 2' modifications of the nucleotides comprises: fmmmm, where f is 2'-F and m is 2'-OMe. Non-limiting examples of such single-stranded RNAi agents include: WV-1829, Table 12.

In some embodiments, a provided single-stranded RNAi agent comprises a seed region, in which the pattern of 2' modifications of the nucleotides comprises: ffmmm, where f is 2'-F and m is 2'-OMe. Non-limiting examples of such single-stranded RNAi agents include: WV-1829, Table 12.

In some embodiments, a provided single-stranded RNAi agent comprises a seed region, in which the pattern of 2' modifications of the nucleotides comprises: ffmm, where f is 2'-F and m is 2'-OMe. Non-limiting examples of such single-stranded RNAi agents include: WV-1829, Table 12.

In some embodiments, a provided single-stranded RNAi agent comprises a seed region, in which the pattern of 2' modifications of the nucleotides comprises: ffmmmmmm, where f is 2'-F and m is 2'-OMe. Non-limiting examples of such single-stranded RNAi agents include: WV-1829, Table 12.

In some embodiments, a provided single-stranded RNAi agent comprises a seed region, in which the pattern of 2' modifications of the nucleotides comprises: ffmmmmm, where f is 2'-F and m is 2'-OMe. Non-limiting examples of such single-stranded RNAi agents include: WV-1829, Table 12.

In some embodiments, a provided single-stranded RNAi agent comprises a seed region, in which the pattern of 2' modifications of the nucleotides comprises: mmmm, where m is 2'-OMe. Non-limiting examples of such single-stranded RNAi agents include: WV-1829, Table 12.

In some embodiments, a provided single-stranded RNAi agent comprises a seed region, in which the pattern of 2' modifications of the nucleotides comprises: mmmmm, where m is 2'-OMe. Non-limiting examples of such single-stranded RNAi agents include: WV-1829, Table 12.

In some embodiments, a provided single-stranded RNAi agent comprises a seed region, in which the pattern of 2' modifications of the nucleotides comprises: mmmmmm, where m is 2'-OMe. Non-limiting examples of such single-stranded RNAi agents include: WV-1829, Table 12.

In some embodiments, a provided single-stranded RNAi agent comprises a seed region, in which the pattern of 2' modifications of the nucleotides comprises: mfmfm, where f is 2'-F and m is 2'-OMe. Non-limiting examples of such single-stranded RNAi agents include: WV-2112, Table 2; WV-2113, Table 3; WV-2146, Table 3; WV-2147, Table 3; WV-2148, Table 3; WV-2149, Table 3; WV-4012, Table 4C; WV-4013, Table 4C; WV-4010, Table 5; WV-4270, Table 5; WV-3755, Table 6; and many more oligonucleotides disclosed herein.

In some embodiments, a provided single-stranded RNAi agent comprises a seed region, in which the pattern of internucleotidic linkages comprises the pattern of internucleotidic linkages in the seed region of any single-stranded RNAi format shown in FIG. 1.

In some embodiments, a provided single-stranded RNAi agent comprises a seed region, in which the pattern of internucleotidic linkages comprises: XOXOXO, where X is phosphorothioate and O is phosphodiester. Non-limiting examples of such single-stranded RNAi agents include: WV-2112, Table 2; WV-2113, Table 3; WV-2146, Table 3; WV-2147, Table 3; WV-2148, Table 3; WV-2149, Table 3; WV-4012, Table 4C; WV-4013, Table 4C; WV-4010, Table 5; WV-4270, Table 5; WV-3755, Table 6; and many more oligonucleotides disclosed herein.

In some embodiments, a provided single-stranded RNAi agent comprises a seed region, in which the pattern of internucleotidic linkages comprises: XOXOXOX, where X is phosphorothioate and O is phosphodiester. Non-limiting examples of such single-stranded RNAi agents include: WV-2112, Table 2; WV-2113, Table 3; WV-2146, Table 3; WV-2147, Table 3; WV-2148, Table 3; WV-2149, Table 3; WV-4012, Table 4C; WV-4013, Table 4C; WV-4010, Table 5; WV-4270, Table 5; WV-3755, Table 6; and many more oligonucleotides disclosed herein.

In some embodiments, a provided single-stranded RNAi agent comprises a seed region, in which the pattern of internucleotidic linkages comprises: OXOXOX, where X is phosphorothioate and O is phosphodiester. Non-limiting examples of such single-stranded RNAi agents include: WV-2112, Table 2; WV-2113, Table 3; WV-2146, Table 3; WV-2147, Table 3; WV-2148, Table 3; WV-2149, Table 3; WV-4012, Table 4C; WV-4013, Table 4C; WV-4010, Table 5; WV-4270, Table 5; WV-3755, Table 6; and many more oligonucleotides disclosed herein.

In some embodiments, a provided single-stranded RNAi agent comprises a seed region, in which the pattern of internucleotidic linkages comprises: XOXOX, where X is phosphorothioate and O is phosphodiester. Non-limiting examples of such single-stranded RNAi agents include: WV-2112, Table 2; WV-2113, Table 3; WV-2146, Table 3; WV-2147, Table 3; WV-2148, Table 3; WV-2149, Table 3; WV-4012, Table 4C; WV-4013, Table 4C; WV-4010, Table 5; WV-4270, Table 5; WV-3755, Table 6; and many more oligonucleotides disclosed herein.

In some embodiments, a provided single-stranded RNAi agent comprises a seed region, in which the pattern of internucleotidic linkages comprises: OXOXOX, where X is phosphorothioate and O is phosphodiester. Non-limiting examples of such single-stranded RNAi agents include: WV-5300, Table 37; and WV-5301, Table 36.

In some embodiments, a provided single-stranded RNAi agent comprises a seed region, in which the pattern of internucleotidic linkages comprises: OXOXOXO, where X is phosphorothioate and O is phosphodiester. Non-limiting examples of such single-stranded RNAi agents include: WV-5300, Table 37; and WV-5301, Table 36.

In some embodiments, a provided single-stranded RNAi agent comprises a seed region, in which the pattern of internucleotidic linkages comprises: OXOXO, where X is phosphorothioate and O is phosphodiester. Non-limiting examples of such single-stranded RNAi agents include: WV-5300, Table 37; and WV-5301, Table 36.

In some embodiments, a provided single-stranded RNAi agent comprises a seed region, in which the pattern of internucleotidic linkages comprises: OXOX, where X is phosphorothioate and O is phosphodiester. Non-limiting examples of such single-stranded RNAi agents include: WV-5300, Table 37; and WV-5301, Table 36.

In some embodiments, a provided single-stranded RNAi agent comprises a seed region, in which the pattern of internucleotidic linkages comprises: XXOXOX, where X is phosphorothioate and O is phosphodiester. Non-limiting examples of such single-stranded RNAi agents include: WV-2655, Table 31.

In some embodiments, a provided single-stranded RNAi agent comprises a seed region, in which the pattern of internucleotidic linkages comprises: XXOXOXO, where X is phosphorothioate and O is phosphodiester. Non-limiting examples of such single-stranded RNAi agents include: WV-2655, Table 31.

In some embodiments, a provided single-stranded RNAi agent comprises a seed region, in which the pattern of internucleotidic linkages comprises: XXOXO, where X is phosphorothioate and O is phosphodiester. Non-limiting examples of such single-stranded RNAi agents include: WV-2655, Table 31.

In some embodiments, a provided single-stranded RNAi agent comprises a seed region, in which the pattern of internucleotidic linkages comprises: XXOX, where X is phosphorothioate and O is phosphodiester. Non-limiting examples of such single-stranded RNAi agents include: WV-2655, Table 31.

In some embodiments, a provided single-stranded RNAi agent comprises a seed region, in which the pattern of internucleotidic linkages comprises: 000000, where O is phosphodiester. Non-limiting examples of such single-stranded RNAi agents include: WV-1277, Table 12.

In some embodiments, a provided single-stranded RNAi agent comprises a seed region, in which the pattern of internucleotidic linkages comprises: 00000, where O is phosphodiester. Non-limiting examples of such single-stranded RNAi agents include: WV-1277, Table 12.

In some embodiments, a provided single-stranded RNAi agent comprises a seed region, in which the pattern of internucleotidic linkages comprises: 0000, where O is phosphodiester. Non-limiting examples of such single-stranded RNAi agents include: WV-1277, Table 12.

In some embodiments, a provided single-stranded RNAi agent comprises a seed region, in which the pattern of internucleotidic linkages comprises: SOSOSO, where S is a phosphorothioate in the Sp configuration and O is phosphodiester. Non-limiting examples of such single-stranded RNAi agents include: WV-6763, Table 38; and WV-6763, Table 39.

In some embodiments, a provided single-stranded RNAi agent comprises a seed region, in which the pattern of internucleotidic linkages comprises: SOSOSOS, where S is a phosphorothioate in the Sp configuration and O is phosphodiester. Non-limiting examples of such single-stranded RNAi agents include: WV-6763, Table 38; and WV-6763, Table 39.

In some embodiments, a provided single-stranded RNAi agent comprises a seed region, in which the pattern of internucleotidic linkages comprises: OSOSOS, where S is a phosphorothioate in the Sp configuration and O is phosphodiester. Non-limiting examples of such single-stranded RNAi agents include: WV-6763, Table 38; and WV-6763, Table 39.

In some embodiments, a provided single-stranded RNAi agent comprises a seed region, wherein the seed region comprises a phosphorothioate in the Sp configuration. Non-limiting examples of such single-stranded RNAi agents include: WV-6763, Table 38; and WV-6764, Table 39.

In some embodiments, a provided single-stranded RNAi agent comprises a seed region, wherein the seed region comprises a phosphorothioate in the Sp configuration and a phosphodiester. Non-limiting examples of such single-stranded RNAi agents include: WV-6763, Table 38; and WV-6764, Table 39.

In some embodiments, a provided single-stranded RNAi agent comprises a seed region, in which the pattern of internucleotidic linkages comprises: SOSOS, where S is a phosphorothioate in the Sp configuration and O is phosphodiester. Non-limiting examples of such single-stranded RNAi agents include: WV-6763, Table 38; and WV-6763, Table 39.

In some embodiments, a provided single-stranded RNAi agent comprises a seed region, in which the pattern of internucleotidic linkages comprises: SOSSSS, where S is a phosphorothioate in the Sp configuration and O is phosphodiester. Non-limiting examples of such single-stranded RNAi agents include: WV-6764, Table 39.

In some embodiments, a provided single-stranded RNAi agent comprises a seed region, in which the pattern of internucleotidic linkages comprises: SOSSS, where S is a phosphorothioate in the Sp configuration and O is phosphodiester. Non-limiting examples of such single-stranded RNAi agents include: WV-6764, Table 39.

In some embodiments, a provided single-stranded RNAi agent comprises a seed region, in which the pattern of internucleotidic linkages comprises: SOSS, where S is a phosphorothioate in the Sp configuration and O is phosphodiester. Non-limiting examples of such single-stranded RNAi agents include: WV-6764, Table 39.

In some embodiments, a provided single-stranded RNAi agent comprises a seed region, in which the pattern of internucleotidic linkages comprises the pattern of internucleotidic linkages in the seed region of a first single-stranded RNAi format shown in FIG. 1; and the pattern of 2' modifications of the nucleotides comprises the pattern of 2' modifications of the nucleotides in the seed region of a second single-stranded RNAi format shown in FIG. 1.

In some embodiments, a provided single-stranded RNAi agent comprises a seed region, in which the pattern of internucleotidic linkages comprises the pattern of internucleotidic linkages in the seed region of a first single-stranded RNAi format shown in FIG. 1; and the pattern of 2' modifications of the nucleotides comprises the pattern of 2' modifications of the nucleotides in the seed region of the first single-stranded RNAi format shown in FIG. 1.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any seed region or portion or structural element thereof described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any seed region or portion or structural element thereof described herein or known in the art in combination with any other structural element or modification described herein, including but not limited to, base sequence or portion thereof, sugar, base; internucleotidic linkage; stereochemistry or pattern thereof; additional chemical moiety, including but not limited to, a targeting moiety, lipid moiety, a GalNAc moiety, etc.; post-seed region; 5'-end structure; 5'-end region; 5' nucleotide moiety; 3'-end region; 3'-terminal dinucleotide; 3'-end cap; length; GC content; pattern of modifications of sugars, bases or internucleotidic linkages; format or any structural element thereof, and/or any other structural element or modification described herein; and in some embodiments, the present disclosure pertains to multimers of any such oligonucleotides.

Post-Seed Region of an Oligonucleotide, Including a Single-Stranded RNAi Agent

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any post-seed region or portion or structural element thereof described herein or known in the art.

In some embodiments of a provided single-stranded RNAi agent, a post-seed region (a region between a seed region and either a 3'-terminal dinucleotide or a 3'-end cap) is represented by: -N8-PX8-N9-PX9-N10-PX10-N11-PX11-N12-PX12-N13-PX13-N14-PX14-N15-PX15-N16-

PX16-N17-PX17-(N18-PX18)$_{mz}$-(N19-PX19)$_{mz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-.

In some embodiments, each of $_{mz, nz}$ and $_{pz}$ is an integer from 0 to 10.

In some embodiments, each of $_{mz, nz}$ and $_{pz}$ is an integer from 0 to 10, and the total of $_{mz}+_{nz}+_{pz}$ is an integer from 8 to 20.

In some embodiments, each of N1 to N27 independently represents a nucleotide. In some embodiments, each of PX1 to PX27 independently represents a internucleotidic linkage. In some embodiments, if any of mz to wz is at least 2, each of N18 to N25 and each of PX18 to PX25 can be the same or different. As a non-limiting example, in some embodiments, if mz>2, each N18 can be the same or different nucleotide. As a non-limiting example, in some embodiments, if mz>2, each PX18 can be the same or different internucleotidic linkage.

In some embodiments of a single-stranded RNAi agent, a post-seed region comprises: a sequence of nucleotides comprising at least 1 2'-modifications. In some embodiments of a single-stranded RNAi agent, a post-seed region comprises: a sequence of nucleotides comprising at least 2 2'-modifications. In some embodiments of a single-stranded RNAi agent, a post-seed region comprises: a sequence of nucleotides comprising at least 3 2'-modifications. In some embodiments of a single-stranded RNAi agent, a post-seed region comprises: a sequence of nucleotides comprising at least 4 2'-modifications. In some embodiments of a single-stranded RNAi agent, a post-seed region comprises: a sequence of nucleotides comprising at least 5 2'-modifications. In some embodiments of a single-stranded RNAi agent, a post-seed region comprises: a sequence of nucleotides comprising at least 6 2'-modifications. In some embodiments of a single-stranded RNAi agent, a post-seed region comprises: a sequence of nucleotides comprising at least 7 2'-modifications. In some embodiments of a single-stranded RNAi agent, a post-seed region comprises: a sequence of nucleotides comprising at least 8 2'-modifications. In some embodiments of a single-stranded RNAi agent, a post-seed region comprises: a sequence of nucleotides comprising at least 9 2'-modifications. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 10 2'-modifications. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{mz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 11 2'-modifications. In some embodiments of a single-stranded RNAi agent, a post-seed region comprises: a sequence of nucleotides comprising at least 12 2'-modifications. In some embodiments of a single-stranded RNAi agent, a post-seed region comprises: a sequence of nucleotides comprising at least 13 2'-modifications. In some embodiments of a single-stranded RNAi agent, a post-seed region comprises: a sequence of nucleotides comprising at least 14 2'-modifications. In some embodiments of a single-stranded RNAi agent, a post-seed region comprises: a sequence of nucleotides comprising at least 15 2'-modifications. In some embodiments of a single-stranded RNAi agent, a post-seed region comprises: a sequence of nucleotides comprising at least 16 2'-modifications. In some embodiments of a single-stranded RNAi agent, a post-seed region comprises: a sequence of nucleotides comprising at least 17 2'-modifications. In some embodiments of a single-stranded RNAi agent, a post-seed region comprises: a sequence of nucleotides comprising at least 18 2'-modifications. In some embodiments of a single-stranded RNAi agent, a post-seed region comprises: a sequence of nucleotides comprising at least 19 2'-modifications. In some embodiments of a single-stranded RNAi agent, a post-seed region comprises: a sequence of nucleotides comprising 20 2'-modifications.

In some embodiments of a single-stranded RNAi agent, a post-seed region comprises: a sequence of nucleotides comprising at least 1 2'—F modifications. In some embodiments of a single-stranded RNAi agent, a post-seed region comprises: a sequence of nucleotides comprising at least 2 to 20 2'—F modifications. In some embodiments of a single-stranded RNAi agent, a post-seed region comprises: a sequence of nucleotides comprising at least 2, 3, 4, 5, 6, 7, 8, 9, 10, 11, 12, 13, 14, 15, 16, 17, 18, 19, or 20 2'—F modifications.

In some embodiments of a single-stranded RNAi agent, a post-seed region comprises: a sequence of nucleotides comprising at least 1 2'—OMe modifications. In some embodiments of a single-stranded RNAi agent, a post-seed region comprises: a sequence of nucleotides comprising at least 2 to 20 2'—OMe modifications. In some embodiments of a single-stranded RNAi agent, a post-seed region comprises: a sequence of nucleotides comprising at least 2, 3, 4, 5, 6, 7, 8, 9, 10, 11, 12, 13, 14, 15, 16, 17, 18, 19, or 20 2'—OMe modifications.

In some embodiments of a single-stranded RNAi agent, a post-seed region comprises: a sequence of nucleotides comprising at least 1 total 2'-OMe and/or 2'-F modifications. In some embodiments of a single-stranded RNAi agent, a post-seed region comprises: a sequence of nucleotides comprising at least 2 to 20 total 2'-OMe and/or 2'-F modifications. In some embodiments of a single-stranded RNAi agent, a post-seed region comprises: a sequence of nucleotides comprising at least 2, 3, 4, 5, 6, 7, 8, 9, 10, 11, 12, 13, 14, 15, 16, 17, 18, 19, or 20 total 2'-OMe and/or 2'-F modifications.

In some embodiments of a single-stranded RNAi agent, a post-seed region comprises: at least 2 to 10 consecutive pairs of nucleotides having 2'-F and 2'-OMe or 2'-OMe and 2'-F modifications. In some embodiments of a single-stranded RNAi agent, a post-seed region comprises: at least 2, 3, 4, 5, 6, 7, 8, 9, or 10 consecutive pairs of nucleotides having 2'-F and 2'-OMe or 2'-OMe and 2'-F modifications.

In some embodiments of a single-stranded RNAi agent, a post-seed region comprises a pattern of alternating 2'-modifications, wherein the pattern comprises 2'-F, 2'-OMe, 2'-F, 2'-OMe. In some embodiments of a single-stranded RNAi agent, a post-seed region comprises a pattern of alternating 2'-modifications, wherein the pattern comprises 2'-F, 2'-OMe, 2'-F, 2'-OMe, 2'-F, 2'-OMe. In some embodiments of a single-stranded RNAi agent, a post-seed region comprises a pattern of alternating 2'-modifications, wherein the pattern comprises 2'-F, 2'-OMe, 2'-F, 2'-OMe, 2'-F, 2'-OMe, 2'-F, 2'-OMe. In some embodiments of a single-stranded RNAi agent, a post-seed region comprises a pattern of alternating 2'-modifications, wherein the pattern comprises 2'-F, 2'-OMe, 2'-F, 2'-OMe, 2'-F, 2'-OMe, 2'-F, 2'-OMe. In some embodiments of a single-stranded RNAi agent, a post-seed region comprises a pattern of alternating 2'-modifications, wherein the pattern comprises 2'-F, 2'-OMe, 2'-F, 2'-OMe, 2'-F, 2'-OMe, 2'-F, 2'-OMe, 2'-F, 2'-OMe, 2'-F, 2'-OMe. In some embodiments of a single-stranded RNAi agent, a post-seed region comprises a pattern of alternating 2'-modifications, wherein the pattern comprises 2'-F, 2'-OMe, 2'-F, 2'-OMe, 2'-F, 2'-OMe, 2'-F, 2'-OMe, 2'-F, 2'-OMe, 2'-F, 2'-OMe. In some embodiments of a single-stranded RNAi agent, a post-seed region comprises a pattern of alternating 2'-modifications, wherein the pattern comprises 2'-F, 2'-OMe, 2'-F, 2'-OMe, 2'-F, 2'-OMe, 2'-F, 2'-OMe, 2'-F, 2'-OMe, 2'-F, 2'-OMe, 2'-F, 2'-OMe. In some embodiments of a single-stranded RNAi agent, a post-seed region comprises a pattern of alternating 2'-modifications, wherein the pattern comprises 2'-F, 2'-OMe, 2'-F, 2'-OMe, 2'-F, 2'-OMe, 2'-F, 2'-OMe, 2'-F, 2'-OMe, 2'-F, 2'-OMe, 2'-F, 2'—OMe, 2'-F, 2'-OMe, 2'-F, 2'-OMe. In some embodiments of a single-stranded RNAi agent, a post-seed region comprises a pattern of alternating 2'-modifications, wherein the pattern comprises fmfmfmfm In some embodiments of a single-stranded RNAi agent, a post-seed region comprises a pattern of alternating 2'-modifications, wherein the pattern comprises mfmf, mfmfmf, mfmfmfmf, mfmfmfmfmf, mfmfmfmfmfmf, mfmfmfmfmfmfmf, mfmfmfmfmfmfmfmf, mfmfmfmfmfmfmfmfmf, where m is 2'-OMe and f is 2'-F.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{mz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 1 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 2 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{mz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 3 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 4 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 5 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 6 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 7 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 8 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 9 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 10 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 11 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$4N24-PX24)$_{vz}$-(N25-PX25)$_{wz}$- comprises: a sequence of nucleotides comprising at least 12 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 13 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 14 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 15 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 16 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 17 2'-deoxy. In some embodiments of a single-stranded RNAi agent, —N8-PX8-N9-PX9-N10-PX10-N11-PX11-N12-

PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 18 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 19 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising 20 2'-deoxy.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 1 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 2 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 3 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 4 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 5 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 6 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 7 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 8 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 9 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 10 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 11 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 12 consecutive 2'-deoxy. In some embodiments of a single-stranded RNAi agent, -N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 13 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 14 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 15 consecutive 2'-deoxy. In some embodiments of a single-stranded RNAi agent, -N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 16 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 17 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: a sequence of nucleotides comprising at least 18 consecutive 2'-deoxy. In some embodiments of a single-stranded RNAi agent, -N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising at least 19 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: a sequence of nucleotides comprising 20 consecutive 2'-deoxy.

Non-limiting examples of a single-stranded RNAi agent, in which -N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 1 2'-deoxy include: WV-2417; WV-2151, Table 29; and WV-2155, Table 23.

Non-limiting examples of a single-stranded RNAi agent, in which -N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 5 2'-deoxy include: WV-2718, Table 19.

Non-limiting examples of a single-stranded RNAi agent, in which -N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 6 2'-deoxy include: WV-2719 and WV-2716, Table 19.

Non-limiting examples of a single-stranded RNAi agent, in which -N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 7 2'-deoxy include: WV-2717, Table 19.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 1 2'-deoxy, wherein at least 1 2'-deoxy is at the most 3' position of a post-seed region.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 1 2'-deoxy, wherein at least 1 2'-deoxy is at the most 3' position of a post-seed region, wherein the 2'-deoxy can be further modified to comprise a linker.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 1 2'-deoxy, wherein at least 1 2'-deoxy is at the most 3' position of a post-seed region, wherein the 2'-deoxy can be further modified to comprise a linker comprising a free amino group.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 1 2'-deoxy, wherein at least 1 2'-deoxy is at the most 3' position of a post-seed region, wherein the 2'-deoxy can be further modified to comprise a linker and an additional chemical moiety.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 1 2'-deoxy, wherein at least 1 2'-deoxy is at the most 3' position of a post-seed region, wherein the 2'-deoxy can be further modified to comprise a linker and an additional chemical moiety which is a GalNAc moiety.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{m}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 1 2'-deoxy, wherein at least 1 2'-deoxy is at the most 3' position of a post-seed region, wherein the 2'-deoxy can be further modified to comprise a linker which is AMC6, and an additional chemical moiety which is a GalNAc moiety.

Non-limiting examples of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 1 2'-deoxy, wherein at least 1 2'-deoxy is at the most 3' position of a post-seed region include: WV-2716, WV-2717, WV-2718, and WV-2719, Table 19; WV-2111, Table 21; WV-2155, Table 23; WV-2111, WV-2156, and WV-2157, Table 24; WV-3069, Table 25; and various other oligonucleotides disclosed herein.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 9 consecutive 2'-deoxy. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 10 consecutive 2'-deoxy. Non-limiting examples of these single-stranded RNAi agents include WV-2111, Table 24; WV-2113, Table 3; WV-2114, Table 29; WV-2146, WV-2147, WV-2148, WV-2149, Table 3; WV-2152, and WV-2153, Table 29; WV-2156 and WV-2157, Table 24; WV-2819; WV-3069, Table 25.

In some embodiments, each nucleotide in the seed region is 2'-OMe. Non-limiting examples of such an oligonucleotide are: WV-7541 and WV-7544, Tables 46M and N.

In some embodiments, each nucleotide in the seed region is 2'-OMe, and each nucleotide in the post-seed region is 2'-OMe. Non-limiting examples of such an oligonucleotide are: WV-7541 and WV-7544, Tables 46M and N.

In some embodiments, one nucleotide in the seed region is 2'-F and each other nucleotide in the seed region is 2'-OMe. Non-limiting examples of such an oligonucleotide are: WV-7540 and WV-7543, Tables 46M and N.

In some embodiments, one nucleotide in the seed region is 2'-F and each other nucleotide in the seed region is 2'-OMe, and one nucleotide in the post-seed region is 2'-F and each other nucleotide in the post-seed region is 2'-OMe. Non-limiting examples of such an oligonucleotide are: WV-7540 and WV-7543, Tables 46M and N.

In some embodiments, the nucleotide at position 2 (counting from the 5'-end) is 2'-F and each other nucleotide in the seed region is 2'-OMe, and one nucleotide in the post-seed region is 2'-F and each other nucleotide in the post-seed region is 2'-OMe. Non-limiting examples of such an oligonucleotide are: WV-7540 and WV-7543, Tables 46M and N.

In some embodiments, the nucleotide at position 2 (counting from the 5'-end) is 2'-F and each other nucleotide in the seed region is 2'-OMe, and the nucleotide at position 14 (counting from the 5'-end) is 2'-F and each other nucleotide in the post-seed region is 2'-OMe. Non-limiting examples of such an oligonucleotide are: WV-7540 and WV-7543, Tables 46M and N.

Without wishing to be bound by any particular theory, the present disclosure suggests that, in at least some cases, reducing the number of 2'-F nucleotides (e.g., replacing them with 2'-OMe, 2'-deoxy or any other nucleotide which is not 2'-F) can allow in vitro potency, and allow or increase stability, while reducing potential toxicity related to 2'-F.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 2 consecutive pairs of internucleotidic linkages, wherein each pair comprises a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 3 consecutive pairs of internucleotidic linkages, wherein each pair comprises a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 4 consecutive pairs of internucleotidic linkages, wherein each pair comprises a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 5 consecutive pairs of internucleotidic linkages, wherein each pair comprises a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 6 consecutive pairs of internucleotidic linkages, wherein each pair comprises a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 7 consecutive pairs of internucleotidic linkages, wherein each pair comprises a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 8 consecutive pairs of internucleotidic linkages, wherein each pair comprises a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 9 consecutive pairs of internucleotidic linkages, wherein each pair comprises a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: 10 consecutive pairs of internucleotidic linkages, wherein each pair comprises a phosphodithioate and a phosphodiester.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 2 consecutive pairs of internucleotidic linkages, wherein each pair comprises a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 3 consecutive pairs of internucleotidic linkages, wherein each pair comprises a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 4 consecutive pairs of internucleotidic linkages, wherein each pair comprises a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 5 consecutive pairs of internucleotidic linkages, wherein each pair comprises a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 6 consecutive pairs of internucleotidic linkages, wherein each pair comprises a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-

PX23)$_{tz}$-(N24-PX24)$_{vz}$-(N25-PX25)$_{wz}$- comprises: at least 7 consecutive pairs of internucleotidic linkages, wherein each pair comprises a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 8 consecutive pairs of internucleotidic linkages, wherein each pair comprises a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 9 consecutive pairs of internucleotidic linkages, wherein each pair comprises a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: 10 consecutive pairs of internucleotidic linkages, wherein each pair comprises a phosphorodiester and a phosphorothioate.

In some embodiments, a post-seed region comprises at least 1, 2, 3, 4, 5 6, 7, 8 or 9 phosphorothioates and/or at least 1, 2, 3, 4, 5 6, 7, 8 or 9 phosphodiester internucleotidic linkages.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises, in 5' to 3' order: at least 2 consecutive pairs of internucleotidic linkages, wherein each pair comprises, in 5' to 3' order: a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises, in 5' to 3' order: at least 3 consecutive pairs of internucleotidic linkages, wherein each pair comprises, in 5' to 3' order: a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises, in 5' to 3' order: at least 4 consecutive pairs of internucleotidic linkages, wherein each pair comprises, in 5' to 3' order: a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises, in 5' to 3' order: at least 5 consecutive pairs of internucleotidic linkages, wherein each pair comprises, in 5' to 3' order: a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises, in 5' to 3' order: at least 6 consecutive pairs of internucleotidic linkages, wherein each pair comprises, in 5' to 3' order: a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises, in 5' to 3' order: at least 7 consecutive pairs of internucleotidic linkages, wherein each pair comprises, in 5' to 3' order: a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises, in 5' to 3' order: at least 8 consecutive pairs of internucleotidic linkages, wherein each pair comprises, in 5' to 3' order: a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises, in 5' to 3' order: at least 9 consecutive pairs of internucleotidic linkages, wherein each pair comprises, in 5' to 3' order: a phosphodithioate and a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{m}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises, in 5' to 3' order: 10 consecutive pairs of internucleotidic linkages, wherein each pair comprises, in 5' to 3' order: a phosphodithioate and a phosphodiester.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 2 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 3 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{mz}$-(N20-PX20)$_{pz}$-(N21-PX21)$_{rz}$ (N22-PX22)$_{sz}$-(N23-PX23)$_{tz}$-(N24-PX24)$_{vz}$-(N25-PX25)$_{wz}$- comprises: at least 4 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 5 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-

PX25)$_{wz}$- comprises: at least 6 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 7 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 8 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 9 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: 10 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 11 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 12 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 13 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 14 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 15 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 16 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 17 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 18 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 19 consecutive internucleotidic linkages which are each a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: 20 consecutive internucleotidic linkages which are each a phosphorothioate.

In some embodiments of a single-stranded RNAi agent, a post seed region, e.g., —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 2 consecutive phosphorothioates. Non-limiting examples of such a provided single-stranded RNAi agent include: WV-2714 and WV-2715, Table 20;

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 3 consecutive phosphorothioates. Non-limiting examples of such a provided single-stranded RNAi agent include: WV-2717, WV-2718 and WV-2719, Table 19;

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 4 consecutive phosphorothioates. Non-limiting examples of such a provided single-stranded RNAi agent include: WV-2712 and WV-2713, Table 20.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 5 consecutive phosphorothioates. Non-limiting examples of such a provided single-stranded RNAi agent include: Formats 4, 5 and 6, FIG. 1; WV-3068, Tables 13 and 25; WV-3245, WV-3248, WV-3249, and WV-3532; WV-1828, WV-2819, WV-1830, and WV-1831, Table 12.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 6 consecutive phosphorothioates. Non-limiting examples of such a provided single-stranded RNAi agent include: Formats 2, 3, 7, 8, 9, 12, and 13, FIG. 1; WV-5288, WV-5289, WV-5292, WV-5293, WV-5296, WV-5297, WV-5300, WV-5301, Tables 37 and 36; WV-1277 and WV-1828, Table 12; WV-2110; WV-3068, Tables 13 and 25; WV-2817, WV-2818, WV-2720, WV-2721 and WV-3021, Table 35; WV-2817 and WV-3021, Tables 13, 16; WV-2112, Table 3; and various other single-stranded RNAi agents disclosed herein.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_m$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 8 consecutive phosphorothioates. Non-limiting examples of such a provided single-stranded RNAi agent include: WV-5290, WV-5291, WV-5294, WV-5295, WV-5298, and WV-5299, Tables 37 and 38.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 10 consecutive phosphorothioates. Non-limiting examples of such a provided single-stranded RNAi agent include: WV-2111, Table 21; WV-2111, WV-2156, and WV-2157, Table 24; WV-3069, Table 25; WV-2819; WV-2114, WV-2152, and WV-2153, Table 29; and various other single-stranded RNAi agents disclosed herein.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 2 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 3 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 4 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 5 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_m$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 6 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 7 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 8 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 9 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: 10 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 11 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 12 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 13 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 14 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_m$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 15 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-

PX25)$_{wz}$- comprises: at least 16 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 17 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 18 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 19 consecutive internucleotidic linkages which are each a phosphodiester. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: 20 consecutive internucleotidic linkages which are each a phosphodiester.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 2 consecutive phosphodiesters. Non-limiting examples of such a provided single-stranded RNAi agent include: Formats 4, 5 and 6, FIG. 1; and WV-1829, WV-1830, WV-1831, Table 12.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 3 consecutive phosphodiesters. Non-limiting examples of such a provided single-stranded RNAi agent include: Formats 4, 5 and 6, FIG. 1; WV-1829, WV-1830, WV-1831, Table 12; and WV-2718 and WV-2719, Table 19.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises: at least 4 consecutive phosphodiesters. Non-limiting examples of such a provided single-stranded RNAi agent include: Formats 10, 11 and 14, FIG. 1; and WV-4054, Table 61 and 66.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{m}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$- comprises: at least 6 consecutive phosphodiesters. Non-limiting examples of such a provided single-stranded RNAi agent include: Format 2, FIG. 1; WV-1277, Table 12; and WV-4098, Tables 61 and 68.

In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{m}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises, in 5' to 3' order: at least 2 consecutive pairs of internucleotidic linkages, wherein each pair comprises, in 5' to 3' order: a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises, in 5' to 3' order: at least 3 consecutive pairs of internucleotidic linkages, wherein each pair comprises, in 5' to 3' order: a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises, in 5' to 3' order: at least 4 consecutive pairs of internucleotidic linkages, wherein each pair comprises, in 5' to 3' order: a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises, in 5' to 3' order: at least 5 consecutive pairs of internucleotidic linkages, wherein each pair comprises, in 5' to 3' order: a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises, in 5' to 3' order: at least 6 consecutive pairs of internucleotidic linkages, wherein each pair comprises, in 5' to 3' order: a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises, in 5' to 3' order: at least 7 consecutive pairs of internucleotidic linkages, wherein each pair comprises, in 5' to 3' order: a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises, in 5' to 3' order: at least 8 consecutive pairs of internucleotidic linkages, wherein each pair comprises, in 5' to 3' order: a phosphorodiester and a phosphorothioate. In some embodiments of a single-stranded RNAi agent, —N8-PX8-N9-PX9-N10-PX10-N11-PX11-N12-PX12-N13-PX13-N14-PX14-N15-PX15-N16-PX16-N17-PX17-(N18-PX18)$_{mz}$-(N19-PX19)$_{nz}$-(N20-PX20)$_{pz}$-(N21-PX21)$_{rz}$-(N22-PX22)$_{sz}$-(N23-PX23)$_{tz}$-(N24-PX24)$_{vz}$-(N25-PX25)$_{wz}$-comprises, in 5' to 3' order: at least 9 consecutive pairs of internucleotidic linkages, wherein each pair comprises, in 5' to 3' order: a phosphorodiester and a phosphorothioate. In some embodiments of a single-stranded RNAi agent, a post-seed region comprises, in 5' to 3' order: 10 consecutive pairs of internucleotidic linkages, wherein each pair comprises, in 5' to 3' order: a phosphorodiester and a phosphorothioate.

In some embodiments of a single-stranded RNAi agent, a post-seed region comprises: a set of at least 2 consecutive internucleotidic linkages which are each a phosphorothioate; and a set of at least 2 consecutive internucleotidic linkages which are each a phosphodiester. In some embodiments of a single-stranded RNAi agent, a post-seed region comprises: a set of at least 3 consecutive internucleotidic linkages which are each a phosphorothioate; and a set of at least 2 consecutive internucleotidic linkages which are each a phosphodiester. In some embodiments of a single-stranded RNAi agent, a post-seed region comprises: a set of at least 4 consecutive internucleotidic linkages which are each a phosphorothioate; and a set of at least 2 consecutive internucleotidic linkages which are each a phosphodiester. In some embodiments of a single-stranded RNAi agent, a post-seed region comprises: a set of at least 5 consecutive internucleotidic linkages which are each a phosphorothioate; and a set of at least 2 consecutive internucleotidic linkages which are each a phosphodiester. In some embodiments of a single-stranded RNAi agent, a post-seed region comprises: a set of at least 6 consecutive internucleotidic linkages which are each a phosphorothioate; and a set of at least 2 consecutive internucleotidic linkages which are each a phosphodiester. In some embodiments of a single-stranded RNAi agent, a post-seed region comprises: a set of at least 2 consecutive internucleotidic linkages which are each a phosphorothioate; and a set of at least 3 consecutive internucleotidic linkages which are each a phosphodiester. In some embodiments of a single-stranded RNAi agent, a post-seed region comprises: a set of at least 2 consecutive internucleotidic linkages which are each a phosphorothioate; and a set of at least 4 consecutive internucleotidic linkages which are each a phosphodiester. In some embodiments of a single-stranded RNAi agent, a post-seed region comprises: a set of at least 2 consecutive internucleotidic linkages which are each a phosphorothioate; and a set of at least 5 consecutive internucleotidic linkages which are each a phosphodiester. In some embodiments of a single-stranded RNAi agent, a post-seed region comprises: a set of at least 2 consecutive internucleotidic linkages which are each a phosphorothioate; and a set of at least 6 consecutive internucleotidic linkages which are each a phosphodiester.

In some embodiments of a single-stranded RNAi agent, a post-seed region comprises: a set of at least 2 consecutive internucleotidic linkages which are each a phosphorothioate; and at least two sets, each set of at least 2 consecutive internucleotidic linkages which are each a phosphodiester. In some embodiments of a single-stranded RNAi agent, a post-seed region comprises: a set of at least 3 consecutive internucleotidic linkages which are each a phosphorothioate; and at least two sets, each set of at least 2 consecutive internucleotidic linkages which are each a phosphodiester. In some embodiments of a single-stranded RNAi agent, a post-seed region comprises: a set of at least 4 consecutive internucleotidic linkages which are each a phosphorothioate; and at least two sets, each set of at least 2 consecutive internucleotidic linkages which are each a phosphodiester. In some embodiments of a single-stranded RNAi agent, a post-seed region comprises: a set of at least 5 consecutive internucleotidic linkages which are each a phosphorothioate; and at least two sets, each set of at least 2 consecutive internucleotidic linkages which are each a phosphodiester. In some embodiments of a single-stranded RNAi agent, a post-seed region comprises: a set of at least 6 consecutive internucleotidic linkages which are each a phosphorothioate; and at least two sets, each set of at least 2 consecutive internucleotidic linkages which are each a phosphodiester. In some embodiments of a single-stranded RNAi agent, a post-seed region comprises: a set of at least 2 consecutive internucleotidic linkages which are each a phosphorothioate; and at least two sets, each set of at least 3 consecutive internucleotidic linkages which are each a phosphodiester. In some embodiments of a single-stranded RNAi agent, a post-seed region comprises: a set of at least 2 consecutive internucleotidic linkages which are each a phosphorothioate; and at least two sets, each set of at least 4 consecutive internucleotidic linkages which are each a phosphodiester. In some embodiments of a single-stranded RNAi agent, a post-seed region comprises: a set of at least 2 consecutive internucleotidic linkages which are each a phosphorothioate; and at least two sets, each set of at least 5 consecutive internucleotidic linkages which are each a phosphodiester. In some embodiments of a single-stranded RNAi agent, a post-seed region comprises: a set of at least 2 consecutive internucleotidic linkages which are each a phosphorothioate; and at least two sets, each set of at least 6 consecutive internucleotidic linkages which are each a phosphodiester.

In some embodiments of a single-stranded RNAi agent, a post-seed region comprises one or more sets of consecutive phosphorothioates and/or one or more sets of consecutive phosphodiesters.

In some embodiments of a single-stranded RNAi agent, a post-seed region comprises: at least two sets, each set of at least 2 consecutive internucleotidic linkages which are each a phosphorothioate; and a set of at least 2 consecutive internucleotidic linkages which are each a phosphodiester. In some embodiments of a single-stranded RNAi agent, a post-seed region comprises: at least two sets, each set of at least 3 consecutive internucleotidic linkages which are each a phosphorothioate; and a set of at least 2 consecutive internucleotidic linkages which are each a phosphodiester. In some embodiments of a single-stranded RNAi agent, a post-seed region comprises: at least two sets, each set of at least 4 consecutive internucleotidic linkages which are each a phosphorothioate; and a set of at least 2 consecutive internucleotidic linkages which are each a phosphodiester. In some embodiments of a single-stranded RNAi agent, a post-seed region comprises: at least two sets, each set of at least 5 consecutive internucleotidic linkages which are each a phosphorothioate; and a set of at least 2 consecutive internucleotidic linkages which are each a phosphodiester. In some embodiments of a single-stranded RNAi agent, a post-seed region comprises: at least two sets, each set of at least 6 consecutive internucleotidic linkages which are each a phosphorothioate; and a set of at least 2 consecutive internucleotidic linkages which are each a phosphodiester. In some embodiments of a single-stranded RNAi agent, a post-seed region comprises: at least two sets, each set of at least 2 consecutive internucleotidic linkages which are each a phosphorothioate; and a set of at least 3 consecutive internucleotidic linkages which are each a phosphodiester. In some embodiments of a single-stranded RNAi agent, a post-seed region comprises: at least two sets, each set of at least 2 consecutive internucleotidic linkages which are each a phosphorothioate; and a set of at least 4 consecutive internucleotidic linkages which are each a phosphodiester. In some embodiments of a single-stranded RNAi agent, a post-seed region comprises: at least two sets, each set of at least 2 consecutive internucleotidic linkages which are each a phosphorothioate; and a set of at least 5 consecutive internucleotidic linkages which are each a phosphodiester.

In some embodiments of a single-stranded RNAi agent, a post-seed region comprises: at least two sets, each set of at least 2 consecutive internucleotidic linkages which are each a phosphorothioate; and a set of at least 6 consecutive internucleotidic linkages which are each a phosphodiester.

In some embodiments, a single-stranded RNAi agent comprises a post-seed region which comprises a span of sugars having a pattern of modifications of any of: mfmfmfmfmfmfm, mfmfmfmfmfm, mfmfmfmfm, mfmfmfm, mfmfm, mfm, fmfmfmfmfmfm, fmfmfmfmfm, fmfmfmfm, mfmfm, and fmfm, wherein m is 2'-OMe and f is 2'-F. Non-limiting examples of oligonucleotides of these types include: WV-4270, Table 5A; WV-2112, Table 2; WV-2146, Table 3; and many other oligonucleotides disclosed herein.

In some embodiments, a single-stranded RNAi agent comprises a post-seed region which comprises a span of sugars having a pattern of modifications of any of: dddfdfdfdfdfd, dddfdfdfdfd, dddfdfdfd, dddfdfd, and dddfd, wherein d is 2'-deoxy and f is 2'-F. Non-limiting examples of oligonucleotides of these types include: WV-2717, Table 19.

In some embodiments, a single-stranded RNAi agent comprises a post-seed region which comprises a span of sugars having a pattern of modifications of any of: dfdfdfdfdfdfd, fdfdfdfdfdfd, and fdfdfdfdfd. Non-limiting examples of oligonucleotides of these types include: WV-2716, Table 19.

In some embodiments, a single-stranded RNAi agent comprises a post-seed region which comprises a span of sugars having a pattern of modifications of any of: fdfdfdfd, fdfdfd, and fdfd. Non-limiting examples of oligonucleotides of these types include: WV-2716, WV-2718, WV-2719, Table 19.

In some embodiments, a single-stranded RNAi agent comprises a post-seed region which comprises a span of internucleotidic linkages having a pattern of any of: XOXOXOXOOOO, OXOXOXOOOO, XOXOXOXOOO, XOXOXOXOO, XOXOXOOOO, OXOXOXOO, XOXOXOOO, OXOXOOOO, OXOXOOO, and XOXOOO, wherein O is phosphodiester and X is a stereorandom phosphorothioate. Non-limiting examples of oligonucleotides of these types include: WV-4275, Table 4; WV-4271, Table 4; and many other oligonucleotides disclosed herein.

In some embodiments, a single-stranded RNAi agent comprises a post-seed region which comprises a span of internucleotidic linkages having a pattern of OOOOOOO. Non-limiting examples of oligonucleotides of these types include: WV-1277, Table 12.

In some embodiments, a single-stranded RNAi agent comprises a post-seed region which comprises a span of internucleotidic linkages having a pattern of any of: OOOOOO, OOOOO, OOOO, and OOO. Non-limiting examples of oligonucleotides of these types include: WV-1277, Table 12; WV-6434, Table 38; WV-6438, Table 38.

In some embodiments, a single-stranded RNAi agent comprises a post-seed region which comprises a span of internucleotidic linkages having a pattern of any of: OOOOOOOOXXXXXX, OOOOOOOOXXXXX, OOOOOOOOXXXX, OOOOOOOOXXX, OOOOOOOXX, OOOOOOOX, OOOOOOOXXXXXX, OOOOOOXXXXXX, OOOOOXXXXXX, OOOOXXXXXX, OOOXXXXXX, OOXXXXXX, OXXXXXX, OOOOOOX, OOOOOX,
OOOOX, and OOOX. Non-limiting examples of oligonucleotides of these types include: WV-1277, Table 12.

In some embodiments, a single-stranded RNAi agent comprises a post-seed region which comprises a span of internucleotidic linkages having a pattern of any of: OOOOOOOXXXXX, OOOOOOOXXXX, OOOOOOOXXX, OOOOOOXXXXX, OOOOOOXXXX, OOOOOXXXXX, OOOOOXXXX, OOOOOXXX, OOOOXXXX, OOOXXX, OOOXXXXX, OOOXXXX, and OOOXXX. Non-limiting examples of oligonucleotides of these types include: WV-1277, Table 12.

In some embodiments, a single-stranded RNAi agent comprises a post-seed region which comprises at least one chiral internucleotidic linkage. In some embodiments, a single-stranded RNAi agent comprises a post-seed region which comprises at least one chirally controlled internucleotidic linkage. In some embodiments, a single-stranded RNAi agent comprises a post-seed region which comprises at least one chirally controlled internucleotidic linkage which is a phosphorothioate. In some embodiments, a single-stranded RNAi agent comprises a post-seed region which comprises at least one chirally controlled internucleotidic linkage which is a phosphorothioate in the Sp configuration. In some embodiments, a single-stranded RNAi agent comprises a post-seed region which comprises at least one chirally controlled internucleotidic linkage which is a phosphorothioate in the Rp configuration.

In some embodiments, a single-stranded RNAi agent comprises a post-seed region which comprises a span of internucleotidic linkages having a pattern of any of: OSSSOSSSSSSSSS, OSSSOSSSSSSSS, OSSSOSSSSSSS, OSSSOSSSSSS, OSSSOSSSSS, OSSSOSSSS, OSSSOSSS, OSSSOSS, OSSSOS, and OSSSO, wherein O is phosphodiester and S is a phosphorothioate in the Sp configuration. Non-limiting examples of oligonucleotides of these types include: WV-6431, Table 44B.

In some embodiments, a single-stranded RNAi agent comprises a post-seed region which comprises a span of internucleotidic linkages having a pattern of any of: OSOSOSOSSSSSSSS, OSOSOSOSSSSSSS, OSOSOSOSSSSSS, OSOSOSOSSSSS, OSOSOSOSSSS, OSOSOSOSSS, OSOSOSOSS, and OSOSOSOSS. Non-limiting examples of oligonucleotides of these types include: WV-6765, Table 39; WV-6763, Table 44B.

In some embodiments, a single-stranded RNAi agent comprises a post-seed region which comprises a span of internucleotidic linkages having a pattern of any of: SOSOSOSSSSSSSS, OSOSOSSSSSSS, SOSOSSSSSSS, OSOSSSSSSS, SOSSSSSSSS, and OSSSSSSSS. Non-limiting examples of oligonucleotides of these types include: WV-6765, Table 39; WV-6763, Table 44B.

In some embodiments, a single-stranded RNAi agent comprises a post-seed region which comprises a span of internucleotidic linkages having a pattern of any of: SOSOSOSSSSSSSS, SOSOSOSSSSSSS, SOSOSOSSSSSS, SOSOSOSSSSS, SOSOSOSSSS, SOSOSOSSS, SSSSSSSS, SSSSSSS, SSSSSS, SSSSS, SSSS, SSS, and SS. Non-limiting examples of oligonucleotides of these types include: WV-6765, Table 39; WV-6764, Table 39; WV-7465, Table 69A.

In some embodiments, a single-stranded RNAi agent comprises a post-seed region which comprises a span of internucleotidic linkages having a pattern of any of: OSSSSSO, OSSSSS, OSSSS, SSSSSO, SSSSO, and SSSO.

Non-limiting examples of oligonucleotides of these types include: WV-7467, Table 68; WV-6764, Table 39; WV-7466, Table 69A.

In some embodiments, a single-stranded RNAi agent comprises a post-seed region which comprises a span of internucleotidic linkages having a pattern of any of: SOSOSOSOSOOOOOOS, SOSOSOSOSOOOOOO, SOSOSOSOSOOOOO, SOSOSOSOSOOOO, SOSOSOSOSOOO, and SOSOSOSOSOO. Non-limiting examples of oligonucleotides of these types include: WV-7464, Table 68.

In some embodiments, a single-stranded RNAi agent comprises a post-seed region which comprises a span of internucleotidic linkages having a pattern of any of: OSOSOSOSOOOOOOS, SOSOSOSOOOOOOS, OSOSOSOOOOOOS, SOSOSOOOOOOS, OSOSOOOOOOS, SOSOOOOOOS, and OSOOOOOOS. Non-limiting examples of oligonucleotides of these types include: WV-7464, Table 68.

In some embodiments, a single-stranded RNAi agent comprises a post-seed region which comprises a span of internucleotidic linkages having a pattern of any of: XOOOXOOXXXXX, XOOOXOOXXXX, XOOOXOOXXX, XOOOXOOXX, XOOOXOOX, XOOOXOO, OOOXOOXXXXX, OOXOOXXXXX, OXOOXXXXX, XOOXXXXX, and OOXXXXX. Non-limiting examples of oligonucleotides of these types include: WV-1831, Table 12; WV-1830, Table 12; WV-1829, Table 12.

In some embodiments, a single-stranded RNAi agent comprises a post-seed region which comprises a span of internucleotidic linkages having a pattern of any of: XOXOXOXXXXXX, XOXOXOXXXXX, XOXOXOXXXX, XOXOXOXXX, XOXOXOXX, XOXOXOX, OXOXOXXXXXX, XOXOXXXXXX, OXOXXXXXX, XOXXXXXX, and OXXXXXX. Non-limiting examples of oligonucleotides of these types include: WV-2110, Table 15; WV-2818, WV-2817, WV-2821, WV-2720, WV-2110, WV-3021, Table 16.

In some embodiments, a single-stranded RNAi agent comprises a post-seed region which comprises a span of internucleotidic linkages having a pattern of any of: XXXOOOXOXOXXX, XXXOOOXOXOXX, XXXOOOXOXOX, XXXOOOXOXO, XXXOOOXOX, XXXOOOXO, XXOOOXOXOXXX, XOOOXOXOXXX, OOOXOXOXXX, OOXOXOXXX, OXOXOXXX, XOXOXXX, XXOOOXOXOXX, XXOOOXOXOX, XOOOXOXOXX, and XOOOXOXOX. Non-limiting examples of oligonucleotides of these types include: WV-2719, Table 19.

In some embodiments, a single-stranded RNAi agent comprises a post-seed region which comprises a span of internucleotidic linkages having a pattern of any of: XOOOXOXO, XOOOXOX, XOOOXO, OOOXOXO, OOOXOX, and OOOXO. Non-limiting examples of oligonucleotides of these types include: WV-2719, Table 19; WV-2718, Table 19.

In some embodiments, a single-stranded RNAi agent comprises a post-seed region which comprises a span of internucleotidic linkages having a pattern of any of: XOXOOOXOXOXXX, XOXOOOXOXOXX, XOXOOOXOXOX, XOXOOOXOXO, XOXOOOXOX, XOXOOOXO, XOXOOOX, OXOOOXOXOXXX, XOOOXOXOXXX, OOOXOXOXXX, OOXOXOXXX, OXOXOXXX, OXOXOXXX, OXOOOXOXOXX, OXOOOXOXOX, and OXOOOXOXOX. Non-limiting examples of oligonucleotides of these types include: WV-2718, Table 19.

In some embodiments, a single-stranded RNAi agent comprises a post-seed region which comprises a span of internucleotidic linkages having a pattern of any of: OOOOOOS, OOOOOSO, OOOOSOO, OOOSOOO, OOSOOOO, OSOOOOO, and SOOOOOO. Non-limiting examples of oligonucleotides of these types include: Formats 50 to 64.

In some embodiments, a hybrid oligonucleotide comprises a (a) seed region capable of annealing to a first complementary target mRNA region; and (b) a post-seed region comprising a 2'-deoxy region, wherein the hybrid oligonucleotide is capable of directing both RNA interference and RNase H-mediated knockdown, wherein the 2'-deoxy region comprises at least 5 consecutive 2'-deoxy. In some embodiments, the 2'-deoxy can be DNA, or a modified nucleotide, e.g., a modified nucleotide with a 2'-deoxy, wherein the DNA or modified nucleotide comprise a natural sugar and/or a natural base, and/or a modified base, and/or any internucleotidic linkage. In some embodiments, the 2'-deoxy region comprises a stretch of consecutive nucleotides, wherein each nucleotide is 2'-deoxy and each internucleotidic linkage is a phosphorothioate. In some embodiments, the 2'-deoxy region comprises a stretch of consecutive nucleotides of at least 5, 6, 7, 8, 9, 10, 11, 12, 13, 14, 15, 16, 17, 18, 19, 20 or 21 nucleotides, wherein each nucleotide is 2'-deoxy and each internucleotidic linkage is a phosphorothioate.

As non-limiting examples of a post-seed region in a single-stranded RNAi agent: Formats 2, 7, 8, 9, 12 and 13 (which each comprise a set of 6 consecutive phosphodiesters; and a set of 6 consecutive phosphodithioates), Format 3 (6 consecutive phosphorodithioates), Formats 4, 5 and 6 and WV-1829, WV-1830, and WV-1831 (3 consecutive phosphodiesters; 2 consecutive phosphodiesters; and 5 consecutive phosphorodithioates), Formats 10 and 11 (4 consecutive phosphodiesters), FIG. 1; WV-3069 (11 consecutive phosphorothioates), Table 25; WV-3245, WV-3248, WV-3249, and WV-3532 (6 consecutive phosphorothioates); WV-5290, WV-5291, WV-5294, and WV-5295 (8 consecutive phosphorothioates), Tables 36 and 37; and various other single-stranded RNAi agents disclosed herein.

In some embodiments of a single-stranded RNAi agent, a post-seed region comprises a mismatch at the most 3' position (e.g., the most 3' N25).

Non-limiting examples of a single-stranded RNAi agent, a post-seed region comprises a mismatch at the most 3' position (e.g., the most 3' N25) include: WV-2155, Table 23; and WV-2157, Table 24.

In some embodiments, a provided single-stranded RNAi agent can comprise a mismatch at any one or more of: the 5' position (N1), either or both of the 3'-terminal dinucleotide (N12 and N13), and the most 3' position of the region between the seed region and the 3'-end region (e.g., the most 3' N25).

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any post-seed region or portion or structural element thereof described herein or known in the art.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any post-seed region or portion or structural element thereof described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any post-seed region or portion or structural element thereof described herein or known in the art in combination with any other structural element or modification described herein, including but not limited to, base sequence or portion thereof, sugar, base; internucleotidic linkage; stereochemistry or pattern thereof; additional chemical moiety, including but not limited to, a targeting moiety, lipid moiety, a GalNAc moiety, etc.; seed region; 5'-end structure; 5'-end region; 5' nucleotide moiety; 3'-end region; 3'-terminal dinucleotide; 3'-end cap; length; GC content; pattern of modifications of sugars, bases or internucleotidic linkages; format or any structural element thereof, and/or any other structural element or modification described herein; and in some embodiments, the present disclosure pertains to multimers of any such oligonucleotides.

3'-End Region of an Oligonucleotide, Including a Single-Stranded RNAi Agent

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides can comprise any 3'-end region described herein or known in the art.

In some embodiments, the 3'-end region of an oligonucleotide is such that the oligonucleotide is capable of directing a decrease in the expression and/or level of a target gene or its gene product.

In some embodiments, the 3'-end region of a RNAi agent is such that the RNAi agent is capable of directing RNA interference of a specific target transcript in a sequence-specific manner.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any 3'-end region and/or 3'-terminal dinucleotide and/or 3'-end cap described herein or known in the art. In some embodiments, a 3'-end region can comprise a GalNAc moiety. In some embodiments, a GalNAc moiety is any GalNAc, or variant, derivative or modification thereof, as described herein or known in the art.

In some embodiments, a 3'-end region and/or 3'-terminal dinucleotide and/or 3'-end cap performs two functions: (a) decreasing the sensitivity of the oligonucleotide to exo- and/or endonucleases; and (b) allowing the function of the oligonucleotide, wherein the function is directing RNA interference, directing RNase H-mediated knockdown, or directing both RNA interference and RNase H-mediated knockdown.

In some embodiments, a provided oligonucleotide capable of directing single-stranded RNA interference has the structure of:

5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)$_{mz}$—(N19-PX19)$_{nz}$—(N20-PX20)$_{pz}$—(N21-PX21)$_{rz}$—(N22-PX22)$_{sz}$—(N23-PX23)$_{tz}$—(N24-PX24)$_{vz}$—(N25-PX25)$_{wz}$—(N26-PX26-N27-PX27)$_{yz}$-(CAP)$_{zz}$-3' or a salt thereof, wherein (N26-PX26-N27-PX27)$_{yz}$ is a 3'-terminal dinucleotide, and (CAP)$_{zz}$ is a 3'-end cap, and wherein either yz=1 and $_{zz}$=0; or $_{yz}$=0 and zz=1; or yz=1 and zz=1.

Thus, the 3'-end region of the single-stranded RNAi agent can comprise a 3'-terminal dinucleotide and/or a 3'-end cap.

In a mammalian cell, Dicer reportedly processes double-stranded RNA (dsRNA) into 19-23 base pair siRNAs, which comprise a double-stranded region, with each strand terminating in a single-stranded 3' overhang, which can be 1 to 4 nt long, but is typically a 3'-terminal dinucleotide. Bernstein et al. 2001 Nature 409: 363; Elbashir et al. 2001 Nature 411: 494-498; Elbashir et al. 2001 EMBO J. 20: 6877. The two dinucleotide overhangs reportedly do not contribute to target specificity. They do, however, reportedly help protect the ends of the siRNA from nuclease degradation and sometimes improve activity. Elbashir et al. 2001 Nature 411: 494-498; Elbashir et al. 2001 EMBO J. 20: 6877-6888; and Kraynack et al. 2006 RNA 12:163-176. Thus, it is reportedly not necessary for a functional double-stranded RNAi agent for a 3'-terminal dinucleotide to comprise a sequence complementary to the target gene sequence.

In artificial double-stranded RNAi agents, the 3' single-stranded dinucleotide overhangs have reportedly been experimentally replaced with various moieties, including other single-stranded dinucleotides, nucleotides, and 3'-end caps. The 3'-terminal dinucleotides of a 21-mer are reportedly often replaced by an artificial dinucleotide, such as UU, TT, dTdT, sdT, dTsdT, sdTsdT, or sdTdT. Replacing up to four nucleotides on each end of the siRNA with deoxyribonucleotides has reportedly been well tolerated, whereas complete substitution with deoxyribonucleotides results in no RNAi activity. International PCT Publication No. WO 00/44914, and Beach et al. International PCT Publication No. WO 01/68836 preliminarily reported that siRNA may include modifications to either the phosphate-sugar backbone or the nucleoside to include at least one of a nitrogen or sulfur heteroatom. Kreutzer et al. Canadian Patent Application No. 2,359,180, also report certain chemical modifications for use in dsRNA constructs in order to counteract activation of double-stranded RNA-dependent protein kinase PKR, specifically 2'-amino or 2-O-methyl nucleotides, and nucleotides containing a 2'-0 or 4'-C methylene bridge. Additional 3'-terminal nucleotide overhangs include dT (deoxythimidine), 2'-0,4'-C-ethylene thymidine (eT), and 2-hydroxyethyl phosphate (hp). Other artificial 3' overhangs (3'-terminal dinucleotides) include dinucleotides of sequences AA, CC, GG, and UG. Elbashir et al. 2001

EMBO J. 20: 6877-6888. In some embodiments, a 3'-terminal dinucleotide reportedly is AA.

Alternatively, in a double-stranded RNAi agent, one or both of the 3'-terminal dinucleotides can reportedly be deleted (and not replaced), leaving a functional siRNA comprising two 19-nt strands forming a 19-bp blunt-ended duplex. Deleting and not replacing the 3'-terminal dinucleotide in a double-stranded RNAi agent reportedly leaves the ends of the strands vulnerable to nucleases; to compensate for this, an artificial 3'-end cap can be added. The 3'-end caps are reportedly non-nucleotidic; they are not nucleotides as they do not comprise all components of a nucleotide (phosphate, sugar and base). The dinucleotide overhangs in a double-stranded RNAi agent can reportedly sometimes functionally be replaced by a 3'-end cap, leaving a blunt-ended 19-bp duplex with one or two 3'-end caps, which can protect the molecule from nucleases. In general, a 3'-end cap reportedly must not prevent RNA interference mediated by the RNAi agent; many 3'-end caps also impart an added advantage, such as increased RNAi activity and/or stability against nucleases.

Without wishing to be bound by any particular theory, the present application notes that in at least some cases, previously-described 3'-end caps reportedly are theorized to interact with a PAZ domain. In some embodiments, a 3'-end cap is reportedly a PAZ ligand. WO 2015/051366. Reportedly, Dicer is an RNase III enzyme and is composed of six recognizable domains. Reportedly, at or near the N-terminus is an approx. 550 aa DExH-box RNA helicase domain, which is immediately followed by a conserved approx. 100 aa domain called DUF283; just C-terminal to DUF283 domain is the PAZ (for Piwi/Argonaute/Zwille) domain, which recognizes single stranded dinucleotide overhangs. Myers et al. 2005. in RNA interference Technology, ed. Appasani, Cambridge University Press, Cambridge UK, p. 29-54; Bernstein et al. 2001 Nature 409: 363-366; and Schauer et al. 2002 Trends Plant Sci. 7: 487-491; Lingel et al. 2003 Nature 426: 465-469; Song et al. 2003 Nature Struct. Biol. 10: 1026-1032; Yan et al. 2003 Nature 426: 468-474; Lingel et al. 2004 Nature Struct. Mol. Biol. 1 1: 576-577; Ma et al. 2004 Nature 429: 318-322. Reportedly, the PAZ domain in Dicer could also bind RNA to position the catalytic domains for cleavage. Zhang et al. 2004 Cell 1 18: 57-68. In some embodiments, a 3'-end cap is a PAZ ligand which interacts with a PAZ domain.

In some embodiments, a 3'-end cap can allow two functions: (1) allowing RNA interference; and (2) increasing duration of activity and/or biological half-life, which may be accomplished, for example, by increased binding to the PAZ domain of Dicer and/or reducing or preventing degradation of the RNAi agent (e.g., by nucleases such as those in the serum or intestinal fluid).

In the present disclosure:

In some embodiments, a provided single-stranded RNAi agent comprises a 3'-terminal dinucleotide represented by:

-(N26-PX26-N27-PX27)$_{yz}$ wherein the RNAi agent does not comprise a 3'-end cap. When yz=1, a 3'-terminal dinucleotide is present.

Various 3'-terminal dinucleotides are described in the oligonucleotides listed in Table 1A.

In some embodiments of a single-stranded RNAi agent, N26 is a 2'-OMe. In some embodiments of a single-stranded RNAi agent, N27 is a 2'-OMe. In some embodiments of a single-stranded RNAi agent, each of N26 and N27 is a 2'-OMe. Non-limiting examples of such a single-stranded RNAi agent include: Formats 1 to 9, and 12, FIG. 1; and various oligonucleotides disclosed herein.

In some embodiments of a single-stranded RNAi agent, N26 is a 2'-deoxy. In some embodiments of a single-stranded RNAi agent, N27 is a 2'-OMe. In some embodiments of a single-stranded RNAi agent, N26 is a 2'-deoxy and N27 is a 2'-OMe. Non-limiting examples of such a single-stranded RNAi agent include: Formats 10, 11, 13 and 14, FIG. 1; and various oligonucleotides disclosed herein.

In some embodiments of a single-stranded RNAi agent, (N26-PX26-N27-PX27)$_{yz}$ is represented by a structure of formula VI-a or VI-b:

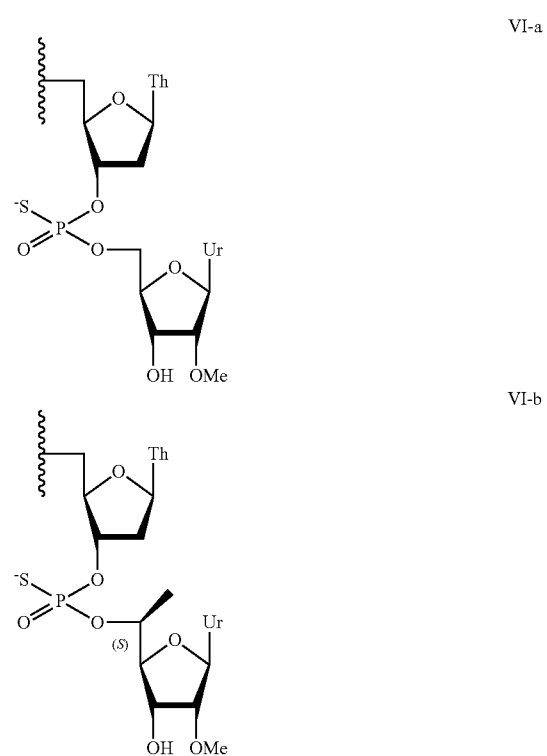

Wherein yz=1, and Th and Ur=nucleobases Thymine or Uracil, respectively, wherein yz=1 and PX27 is —OH.

In some embodiments, a provided single-stranded RNAi agent comprises a pair of 3'-terminal nucleotides, e.g, (N26-PX26-N27-PX27)yz, wherein yz=1. The penultimate nucleotide (e.g., N26) is 2'-OMe and the 5' nucleotide (e.g., N27) is 2'-OMe. Non-limiting examples of single-stranded RNAi agents disclosed herein of this structure include: Formats 1 to 9 and 12, FIG. 1; WV-1275, WV-1277, WV-1828, WV-1829, WV-1830, and WV-1831, Table 12; WV-2110, WV-2720, WV-2721, Table 13; and various other single-stranded RNAi agents disclosed herein.

In some embodiments, a provided single-stranded RNAi agent comprises a pair of 3'-terminal nucleotides, e.g, (N26-PX26-N27-PX27)yz, wherein yz=1, and the penultimate nucleotide (e.g., N26) is 2'-deoxy and the 5' nucleotide (e.g., N27) is 2'-OMe. Non-limiting examples of single-stranded RNAi agents disclosed herein of this structure include: Formats 10, 11, 13 and 14, FIG. 1; WV-3249; and various other single-stranded RNAi agents disclosed herein.

In some embodiments, a provided single-stranded RNAi agent comprises a pair of 3'-terminal nucleotides, e.g, (N26-PX26-N27-PX27)yz, wherein yz=1, and the penultimate nucleotide (e.g., N26) is 2'-deoxy and the 5' nucleotide (e.g., N27) is 2'-OMe, and wherein the penultimate nucleotide (e.g., N26) comprises a linker.

In some embodiments, a provided single-stranded RNAi agent comprises a pair of 3'-terminal nucleotides, e.g, (N26-PX26-N27-PX27)yz, wherein yz=1, and wherein the penultimate nucleotide (e.g., N26) comprises a linker.

In some embodiments, a provided single-stranded RNAi agent comprises a pair of 3'-terminal nucleotides, e.g, (N26-PX26-N27-PX27)yz, wherein yz=1, and the penultimate nucleotide (e.g., N26) is 2'-deoxy and the 5' nucleotide (e.g., N27) is 2'-OMe, and wherein the penultimate nucleotide (e.g., N26) comprises a linker conjugated to an additional chemical moiety.

In some embodiments, a provided single-stranded RNAi agent comprises a pair of 3'-terminal nucleotides, e.g, (N26-PX26-N27-PX27)yz, wherein yz=1, and the penultimate nucleotide (e.g., N26) is 2'-deoxy T and the 5' nucleotide (e.g., N27) is 2'-OMe U, and wherein the penultimate nucleotide (e.g., N26) comprises a linker conjugated to an additional chemical moiety.

In some embodiments, a provided single-stranded RNAi agent comprises a pair of 3'-terminal nucleotides, e.g, (N26-PX26-N27-PX27)yz, wherein yz=1, and wherein the penultimate nucleotide (e.g., N26) comprises a linker conjugated to an additional chemical moiety selected from: a targeting moiety, a lipid moiety, a carbohydrate moiety, a bicyclic ketal, and a GalNAc moiety.

In some embodiments, a provided single-stranded RNAi agent comprises a pair of 3'-terminal nucleotides, e.g, (N26-PX26-N27-PX27)yz, wherein yz=1, and the penultimate nucleotide (e.g., N26) is 2'-deoxy and the 5' nucleotide (e.g., N27) is 2'-OMe, and wherein the penultimate nucleotide (e.g., N26) comprises a linker conjugated to an additional chemical moiety selected from: a targeting moiety, a lipid moiety, a carbohydrate moiety, a bicyclic ketal, and a GalNAc moiety.

In some embodiments, a provided single-stranded RNAi agent comprises a pair of 3'-terminal nucleotides, e.g, (N26-PX26-N27-PX27)yz, wherein yz=1, and the penultimate nucleotide (e.g., N26) is 2'-deoxy T and the 5' nucleotide (e.g., N27) is 2'-OMe U, and wherein the penultimate nucleotide (e.g., N26) comprises a linker conjugated to an additional chemical moiety selected from: a targeting moiety, a lipid moiety, a carbohydrate moiety, a bicyclic ketal, and a GalNAc moiety.

In some embodiments, a provided single-stranded RNAi agent comprises a 3'-end cap represented by:

(CAP)$_{zz}$ wherein the RNAi agent does not comprise a 3'-terminal dinucleotide.

In some embodiments, a 3'-end region or 3'-end cap comprises a GN3, or any other suitable RNAi agent 3'-end region compound as described in, for example, Allerson et al. 2005 J. Med. Chem. 48: 901-04; Lima et al. 2012 Cell 150: 883-894; Prakash et al. 2015 Nucl. Acids Res. 43: 2993-3011; and/or Prakash et al. 2016 Bioorg. Med. Chem. Lett. 26: 26: 2817-2820.

Various 3'-end caps have been described in the literature.

Generally, a 3'-end cap is joined to the 3'-terminal internucleotidic linkage (e.g., the 3' PX27 if yz=1). The 3'-terminal internucleotidic linkage can be selected from: a phosphodiester, a phosphorothioate, a phosphodithioate, and any internucleotidic linkage described herein.

A 3'-end cap for a provided single-stranded RNAi agent can be selected from, for example, any 3'-end cap described herein.

In some embodiments, a 3'-end cap is selected from: 2',3'-cyclic phosphate, C3 (or C6, C7, C12) aminolinker, thiol linker, carboxyl linker, non-nucleotidic spacers (C3, C6, C9, C12, abasic, triethylene glycol, hexaethylene glycol), biotin, and fluoresceine.

In some embodiments, a 3'-end cap is triethylene glycol, cyclohexyl, phenyl, BP (biphenyl), lithochol (lithocholic acid), adamantane, C3 amino, C7 amino, C3, C6, C8, C10, C12, C3pC6, X027, X038, X050, X051, X052, X058, X059, X060, X061, X062, X063, X064, X065, X066, X067, X068, X069, X097, X098, X109, X110, X111, X112, X113, X1009, X1010, X1011, X1012, X1013, X1015, X1016, X1017, X1018, X1019, X1020, X1021, X1022, X1024, X1025, X1026, X1027, X1028, X1047, X1048, X1049, X1062, X1063, X1064, diribitol, 2'-methoxyethoxy ribitol, or ribitol, as described in, for example, WO 2015/051366, or any 3'-end cap disclosed herein or known in the art.

In some embodiments, a 3'-end cap has the structure of —R', -L-R', or —OR'. In some embodiments, a 3'-end cap has the structure of —R'. In some embodiments, a 3'-end cap has the structure of -L-R'. In some embodiments, a 3'-end cap has the structure of —OR'. In some embodiments, R' is an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon. In some embodiments, R' is an optionally substituted group selected from C3-30 cycloaliphatic, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon. In some embodiments, R' is optionally substituted 5-30 membered heteroaryl having 1-10 heteroatoms independently selected from oxygen, nitrogen, sulfur, phosphorus and silicon. In some embodiments, R' is optionally substituted 9-30 membered, bicyclic or polycyclic, heteroaryl having 1-10 heteroatoms independently selected from oxygen, nitrogen, sulfur, phosphorus and silicon. In some embodiments, R' is optionally substituted 10-30 membered, bicyclic or polycyclic, aryl. In some embodiments, R' is optionally substituted bicyclic, 9-membered heteroaryl having 1-10 heteroatoms independently selected from oxygen, nitrogen, sulfur. In some embodiments, R' is optionally substituted bicyclic, 10-membered heteroaryl having 1-10 heteroatoms independently selected from oxygen, nitrogen, sulfur. In some embodiments, R' is optionally substituted 10-membered, bicyclic aryl.

In some embodiments, a 3'-end cap has of the structure of formula Ib:

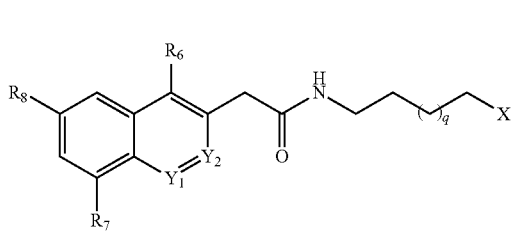

in which:

X is the 3'-end of a single-stranded RNAi agent (e.g., PX27 if yz=1 or PX25 if yz=0 and wz=at least 1);

q is selected from 0, 1 and 2;

$R_6$ is selected from phenyl which is unsubstituted or substituted with a group selected from benzoxy and 3,4-dihydroxybutyl;

$R_7$ is selected from hydrogen and hydroxy-ethyl, wherein if $R_7$ is hydroxy-ethyl, the hydroxyl can be optionally functionalized as succinate or attached to a solid support; $R_8$ is selected from hydrogen and methoxy;

$Y_1$ is selected from CH and N; and $Y_2$ is selected from N and $CR_9$; wherein $R_9$ is selected from hydrogen and methyl.

See, for example, WO 2015/051366.

In some embodiments, a 3'-end cap is selected from any 3'-end cap described in WO 2015/051366, including but not limited to C3, amino C3, C6, C8, C10, and C12. In some embodiments, a 3'-end cap is selected from: Triethylene glycol, Cyclohexyl (or Cyclohex), Phenyl, BP (Biphenyl), Adamantane and Lithocholic acid (or Lithochol), as described in U.S. Pat. Nos. 8,097,716; 8,084,600; 8,344,128; 8,404,831; and 8,404,832.

Various functional 3'-end caps suitable for a provided RNAi agent are described in, for example, EP 1520022 B1; U.S. Pat. Nos. 8,097,716, 8,084,600; 8,404,831; 8,404,832, and 8,344,128; and WO 2015/051366.

In addition, the present disclosure notes that disclosed herein are various 5'-end structures and 3'-end regions, and combinations thereof, which function in single-stranded RNAi agents. However, it is noted, in contrast, many 5'-end structures and 3'-end caps, and combinations thereof, have previously been reported to reduce or eliminate the RNA interference ability of various double-stranded RNAi agents. See, for example, Czauderna et al. 2003 Nucl. Acids Res. 31:2705-2716; Hadwiger et al. 2005, pages 194-206, in RNA interference Technology, ed. K. Appasani, Cambridge University Press, Cambridge, UK; Deleavey et al. 2009 Curr. Prot. Nucl. Acid Chem. 16.3.1-16.3.22; Terrazas et al. 2009 Nucleic Acids Res. 37: 346-353; Harboth et al. 2003 Antisense Nucl. Acid Drug Dev 13: 83-105; Song et al. 2003 Nature Med. 9: 347-351; U.S. Pat. No. 5,998,203; Lipardi et al. 2001 Cell 107: 299-307; Schwarz et al. 2002 Mol. Cell 10: 537-548; and WO 2015/051366.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any 3'-end region and/or 3'-terminal dinucleotide and/or 3'-end cap described herein or known in the art. In some embodiments, a GalNAc moiety is any GalNAc, or variant or modification thereof, as described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any 3'-end region and/or 3'-terminal dinucleotide and/or 3'-end cap described herein or known in the art in combination with any other structural element or modification described herein, including but not limited to, base sequence or portion thereof; sugar, base; internucleotidic linkage; stereochemistry or pattern thereof; additional chemical moiety, including but not limited to, a targeting moiety, a lipid moiety, a carbohydrate moiety, a bicyclic ketal, a GalNAc moiety, etc.; seed region; post-seed region; 5'-end structure; 5'-end region; 5' nucleotide moiety; length; GC content; pattern of modifications of sugars, bases or internucleotidic linkages; format or any structural element thereof, and/or any other structural element or modification described herein; and in some embodiments, the present disclosure pertains to multimers of any such oligonucleotides.

Additional Optional Structural Elements of an Oligonucleotide

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides can comprise any additional optional structural element described herein or known in the art.

In some embodiments, the optional additional structural elements of a RNAi agent is such that the RNAi agent is capable of directing RNA interference of a specific target transcript in a sequence-specific manner.

In some embodiments, an oligonucleotide, an oligonucleotide capable of directing a decrease in the expression and/or level of a target gene or its gene product can comprise any structural element or pattern thereof described herein or known in the art.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any structural element or pattern thereof described herein or known in the art.

In some embodiments, a chirally controlled oligonucleotide is a blockmer. In some embodiments, a chirally controlled oligonucleotide is a stereoblockmer. In some embodiments, a chirally controlled oligonucleotide is a P-modification blockmer. In some embodiments, a chirally controlled oligonucleotide is a linkage blockmer.

In some embodiments, a chirally controlled oligonucleotide is an altmer. In some embodiments, a chirally controlled oligonucleotide is a stereoaltmer. In some embodiments, a chirally controlled oligonucleotide is a P-modification altmer. In some embodiments, a chirally controlled oligonucleotide is a linkage altmer.

In some embodiments, a chirally controlled oligonucleotide is a unimer. In some embodiments, a chirally controlled oligonucleotide is a stereounimer. In some embodiments, a chirally controlled oligonucleotide is a P-modification unimer. In some embodiments, a chirally controlled oligonucleotide is a linkage unimer.

In some embodiments, a chirally controlled oligonucleotide is a gapmer.

In some embodiments, a chirally controlled oligonucleotide is a skipmer.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any structural element described herein or known in the art. In some embodiments, a GalNAc moiety is any GalNAc, or variant or modification thereof, as described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any structural element described herein or known in the art in combination with any other structural element or modification described herein, including but not limited to, base sequence or portion thereof; sugar, base; internucleotidic linkage; stereochemistry or pattern thereof; additional chemical moiety, including but not limited to, a targeting moiety, a lipid moiety, a carbohydrate moiety, a bicyclic ketal, a GalNAc moiety, etc.; seed region; post-seed region; 5'-end structure; 5'-end region; 5' nucleotide moiety; 3'-end region; 3'-terminal dinucleotide; 3'-end cap; length; GC content; pattern of modifications of sugars, bases or internucleotidic linkages; format or any structural element thereof, and/or any other structural element or modification described herein; and in some embodiments, the present disclosure pertains to multimers of any such oligonucleotides.

Optional Additional Chemical Moiety Conjugated to an Oligonucleotide

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides can comprise any optional additional chemical moiety, including but not limited to, a targeting moiety, a lipid moiety, a carbohydrate moiety, a bicyclic ketal, a GalNAc moiety, etc., described herein or known in the art.

In some embodiments, an oligonucleotide, an oligonucleotide that is capable of directing a decrease in the expression and/or level of a target gene or its gene product can comprise any optional additional chemical moiety, including but not limited to, a targeting moiety, a lipid moiety, a carbohydrate moiety, a bicyclic ketal, a GalNAc moiety, etc., described herein or known in the art.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any optional additional chemical moiety, including but not limited to, a targeting moiety, a lipid moiety, a carbohydrate moiety, a bicyclic ketal, a GalNAc moiety, etc., described herein or known in the art.

In some embodiments, an additional chemical moiety is conjugated to single-stranded RNAi agent.

Optional Additional Chemical Moiety Conjugated to an Oligonucleotide: A Targeting Moiety In some embodiments, a provided oligonucleotide composition further comprises a targeting moiety (e.g., a targeting compound, agent, ligand, or component). A targeting moiety can be either conjugated or not conjugated to a lipid or an oligonucleotide or single-stranded RNAi agent. In some embodiments, a targeting moiety is conjugated to an oligonucleotide or single-stranded RNAi agent. In some embodiments, an oligonucleotide or single-stranded RNAi agent is conjugated to both a lipid and a targeting moiety. As described in here, in some embodiments, an oligonucleotide or single-stranded RNAi agent is a provided oligonucleotide. Thus, in some embodiments, a provided oligonucleotide composition further comprises, besides a lipid and oligonucleotides, a target elements. Various targeting moieties can be used in accordance with the present disclosure, e.g., lipids, antibodies, peptides, carbohydrates, etc.

Targeting moieties can be incorporated into provided technologies through many types of methods in accordance with the present disclosure. In some embodiments, targeting moieties are physically mixed with provided oligonucleotides to form provided compositions. In some embodiments, targeting moieties are chemically conjugated with oligonucleotides.

In some embodiments, provided compositions comprise two or more targeting moieties. In some embodiments, provided oligonucleotides comprise two or more conjugated targeting moieties. In some embodiments, the two or more conjugated targeting moieties are the same. In some embodiments, the two or more conjugated targeting moieties are different. In some embodiments, provided oligonucleotides comprise no more than one target component. In some embodiments, oligonucleotides of a provided composition comprise different types of conjugated targeting moieties. In some embodiments, oligonucleotides of a provided composition comprise the same type of targeting moieties.

In some embodiments, provided compositions comprise two or more targeting moieties. In some embodiments, provided oligonucleotides capable of directing single-stranded RNA interference comprise two or more conjugated targeting moieties. In some embodiments, the two or more conjugated targeting moieties are the same. In some embodiments, the two or more conjugated targeting moieties are different. In some embodiments, provided oligonucleotides capable of directing single-stranded RNA interference comprise no more than one target component. In some embodiments, oligonucleotides of a provided composition comprise different types of conjugated targeting moieties. In some embodiments, oligonucleotides of a provided composition comprise the same type of targeting moieties.

Targeting moieties can be conjugated to oligonucleotides optionally through linkers. Various types of linkers in the art can be utilized in accordance of the present disclosure. In some embodiments, a linker comprise a phosphate group, which can, for example, be used for conjugating targeting moieties through chemistry similar to those employed in oligonucleotide synthesis. In some embodiments, a linker comprises an amide, ester, or ether group. In some embodiments, a linker has the structure of -L-. Targeting moieties can be conjugated through either the same or different linkers compared to lipids.

Targeting moieties, optionally through linkers, can be conjugated to oligonucleotides at various suitable locations. In some embodiments, targeting moieties are conjugated through the 5'—OH group (e.g., PX0=OH). In some embodiments, targeting moieties are conjugated through the 3'-OH group (e.g., yz=1 and zz=0, and the 3' terminal internucleotidic linkage, e.g., PX27, comprises or is a phosphorodiester, phosphorothioate, H-phosphonate or phosphodithioate or OH; or zz=1 and the 3'-end cap comprises a 3'-OH). In some embodiments, targeting moieties are conjugated through one or more sugar moieties. In some embodiments, targeting moieties are conjugated through one or more bases. In some embodiments, targeting moieties are incorporated through one or more internucleotidic linkages. In some embodiments, an oligonucleotide may contain multiple conjugated targeting moieties which are independently conjugated through its 5'-OH, 3'-OH, sugar moieties, base moieties and/or internucleotidic linkages. Targeting moieties and lipids can be conjugated either at the same, neighboring and/or separated locations. In some embodiments, a target component is conjugated at one end of an oligonucleotide, and a lipid is conjugated at the other end.

In some embodiments, a provided composition further comprises a targeting component or moiety. A targeting component can be either incorporated into (targeting moiety) or not incorporated into an oligonucleotide. In some embodiments, a targeting component is a lipid. In some embodiments, a targeting component is a carbohydrate or a bicyclic ketal. In some embodiments, a targeting component is —$R^{LD}$ as described in the present disclosure. In some embodiments, a targeting component is —$R^{CD}$ as described in the present disclosure.

Targeting components can be incorporated into provided technologies through many types of methods in accordance with the present disclosure, for example, those described for lipids and carbohydrates. In some embodiments, targeting components are physically mixed with provided oligonucleotides to form provided compositions. In some embodiments, targeting components are chemically conjugated with oligonucleotide moieties.

In some embodiments, provided compositions comprise two or more targeting components. In some embodiments, provided oligonucleotides comprise two or more conjugated targeting components. In some embodiments, the two or more conjugated targeting components are the same. In some embodiments, the two or more conjugated targeting components are different. In some embodiments, provided oligonucleotides comprise no more than one targeting component. In some embodiments, oligonucleotides of a provided composition comprise different types of conjugated targeting components. In some embodiments, oligonucleotides of a provided composition comprise the same type of targeting components.

Targeting components can be conjugated to oligonucleotides optionally through linkers, for example, as described for lipids and carbohydrates. Various types of linkers in the art can be utilized in accordance of the present disclosure. In some embodiments, a linker comprise a phosphate group, which can, for example, be used for conjugating targeting components through chemistry similar to those employed in oligonucleotide synthesis. In some embodiments, a linker comprises an amide, ester, or ether group. In some embodiments, a linker has the structure of -L-. Targeting components can be conjugated through either the same or different linkers compared to lipids.

Targeting components, optionally through linkers, can be conjugated to oligonucleotides at various suitable locations. In some embodiments, targeting components are conjugated through the 5'-OH group. In some embodiments, targeting components are conjugated through the 3'-OH group. In some embodiments, targeting components are conjugated through one or more sugar moieties. In some embodiments, targeting components are conjugated through one or more bases. In some embodiments, targeting components are incorporated through one or more internucleotidic linkages. In some embodiments, an oligonucleotide may contain multiple conjugated targeting components which are independently conjugated through its 5'-OH, 3'-OH, sugar moieties, base moieties and/or internucleotidic linkages. Targeting components and lipids can be conjugated either at the same, neighboring and/or separated locations. In some embodiments, a targeting component is conjugated at one end of an oligonucleotide, and a lipid is conjugated at the other end.

In some embodiments, a targeting component interacts with a protein on the surface of targeted cells. In some embodiments, such interaction facilitates internalization into targeted cells. In some embodiments, a targeting component comprises a sugar moiety. In some embodiments, a targeting component comprises a polypeptide moiety. In some embodiments, a targeting component comprises an antibody. In some embodiments, a targeting component is an antibody. In some embodiments, a targeting component comprises an inhibitor. In some embodiments, a targeting component is a moiety from a small molecule inhibitor. In some embodiments, an inhibitor is an inhibitor of a protein on the surface of targeted cells. In some embodiments, an inhibitor is a carbonic anhydrase inhibitor. In some embodiments, an inhibitor is a carbonic anhydrase inhibitor expressed on the surface of target cells. In some embodiments, a carbonic anhydrase is I, II, III, IV, V, VI, VII, VIII, IX, X, XI, XII, XIII, XIV, XV or XVI. In some embodiments, a carbonic anhydrase is membrane bound. In some embodiments, a carbonic anhydrase is IV, IX, XII or XIV. In some embodiments, an inhibitor is for IV, IX, XII and/or XIV. In some embodiments, an inhibitor is a carbonic anhydrase III inhibitor. In some embodiments, an inhibitor is a carbonic anhydrase IV inhibitor. In some embodiments, an inhibitor is a carbonic anhydrase IX inhibitor. In some embodiments, an inhibitor is a carbonic anhydrase XII inhibitor. In some embodiments, an inhibitor is a carbonic anhydrase XIV inhibitor. In some embodiments, an inhibitor comprises or is a sulfonamide (e.g., those described in Supuran, CT. *Nature Rev Drug Discover* 2008, 7, 168-181, which sulfonamides are incorporated herein by reference). In some embodiments, an inhibitor is a sulfonamide. In some embodiments, targeted cells are muscle cells.

In some embodiments, a targeting component is $R^{TD}$, wherein $R^{TD}$ is $R^{LD}$ or $R^{CD}$ as described in the present disclosure.

In some embodiments, a targeting component is $R^{LD}$ as defined and described in the present disclosure. In some embodiments, the present disclosure provides oligonucleotides comprising $R^{LD}$. In some embodiments, the present disclosure provides oligonucleotide compositions comprising oligonucleotides comprising $R^{LD}$. In some embodiments, the present disclosure provides oligonucleotide compositions comprising a first plurality of oligonucleotides comprising $R^{LD}$. In some embodiments, the present disclosure provides chirally controlled oligonucleotide compositions of oligonucleotides comprising $R^{LD}$.

In some embodiments, a targeting component is $R^{CD}$ as defined and described in the present disclosure. In some embodiments, the present disclosure provides oligonucleotides comprising $R^{CD}$. In some embodiments, the present disclosure provides oligonucleotide compositions comprising oligonucleotides comprising $R^{CD}$. In some embodiments, the present disclosure provides oligonucleotide compositions comprising a first plurality of oligonucleotides comprising $R^{CD}$. In some embodiments, the present disclosure provides chirally controlled oligonucleotide compositions of oligonucleotides comprising $R^{CD}$.

In some embodiments, $R^{TD}$ comprises or is

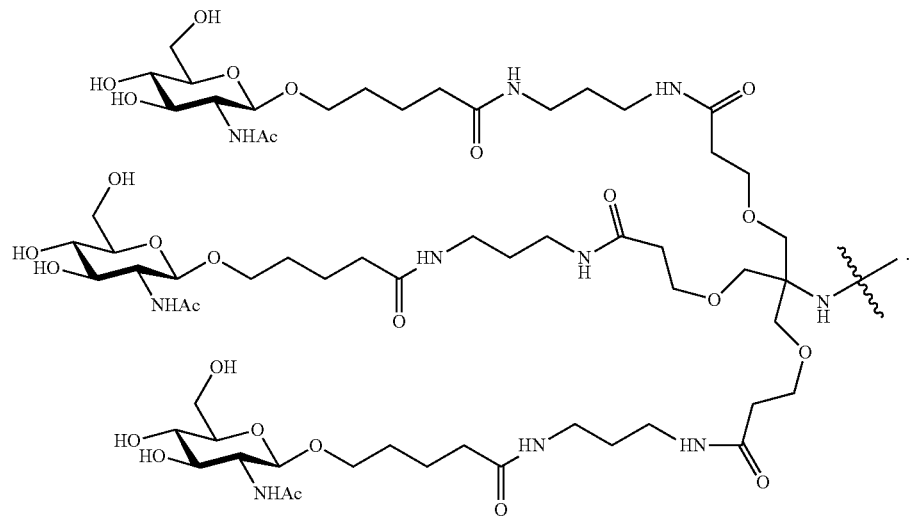

In some embodiments, $R^{TD}$ comprises or is

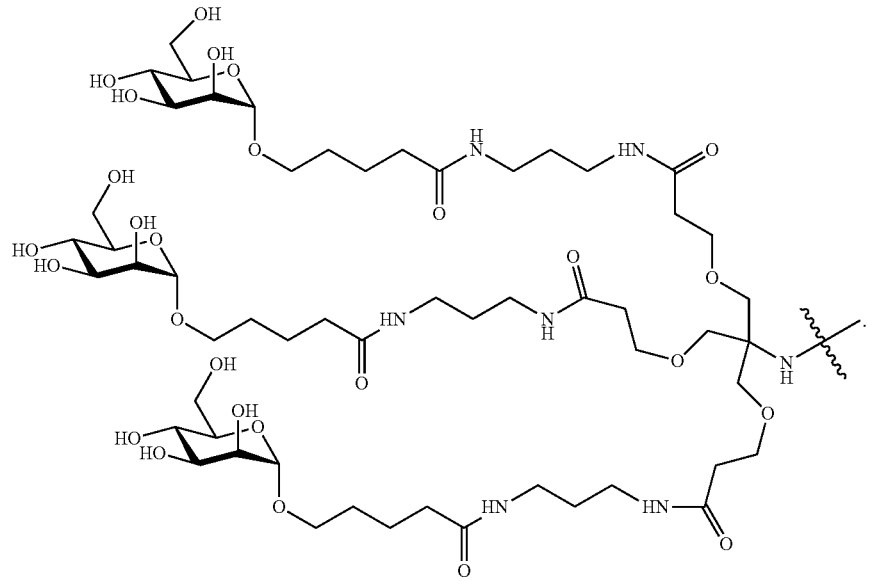

In some embodiments, $R^{TD}$ comprises or is
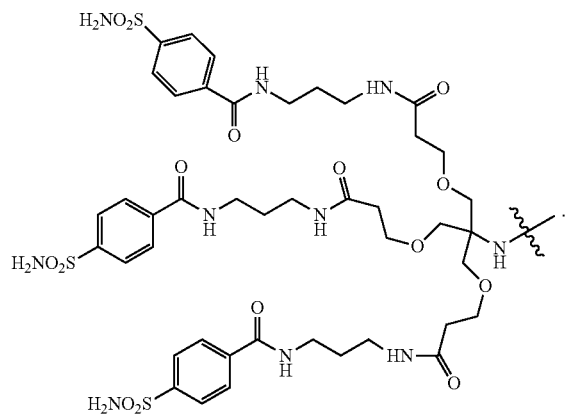 [SMILES: *NC(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]
In some embodiments, $R^{TD}$ comprises or is
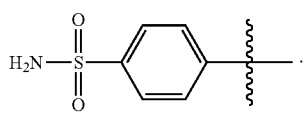 [SMILES: *c1ccc(S(N)(=O)=O)cc1]
In some embodiments, $R^{TD}$ comprises or is
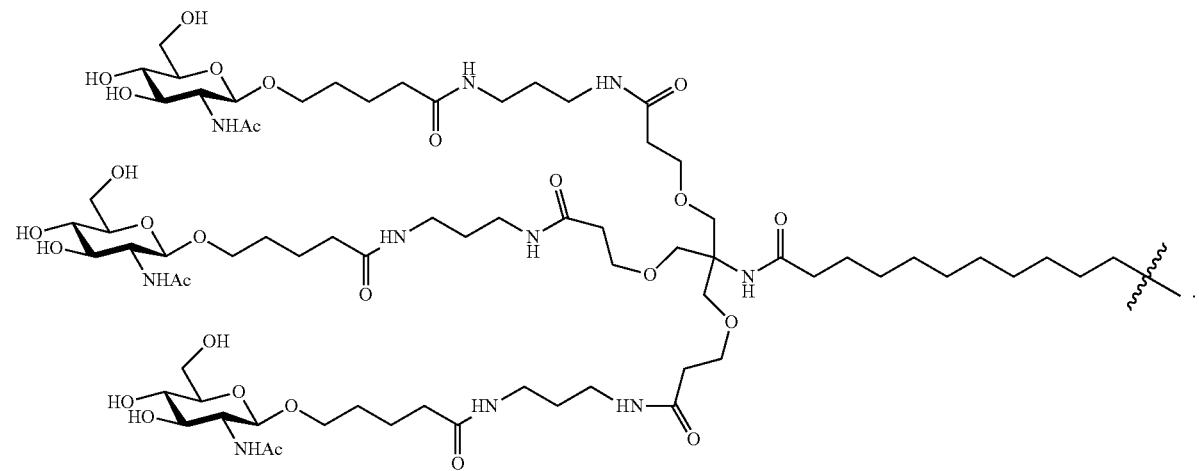
In some embodiments, $R^{TD}$ comprises or is
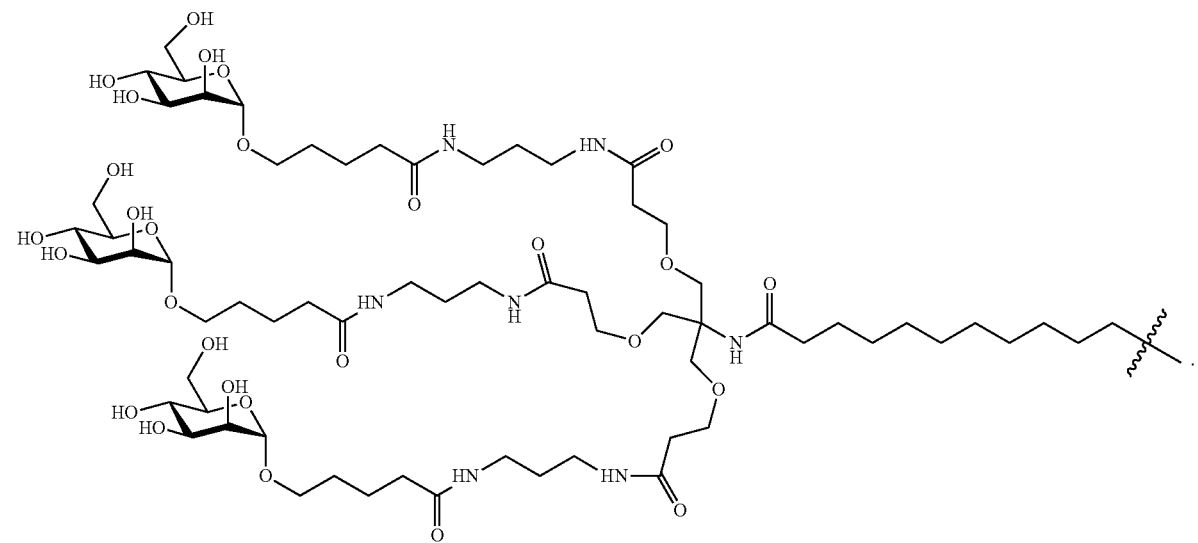

In some embodiments, $R^{TD}$ comprises or is
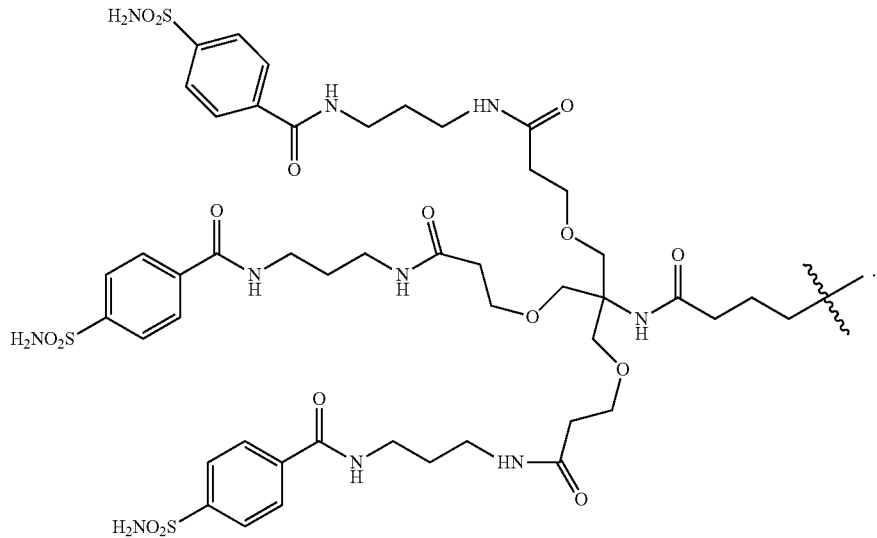 [SMILES: *CCCC(=O)NC(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]
In some embodiments, $R^{TD}$ comprises or is
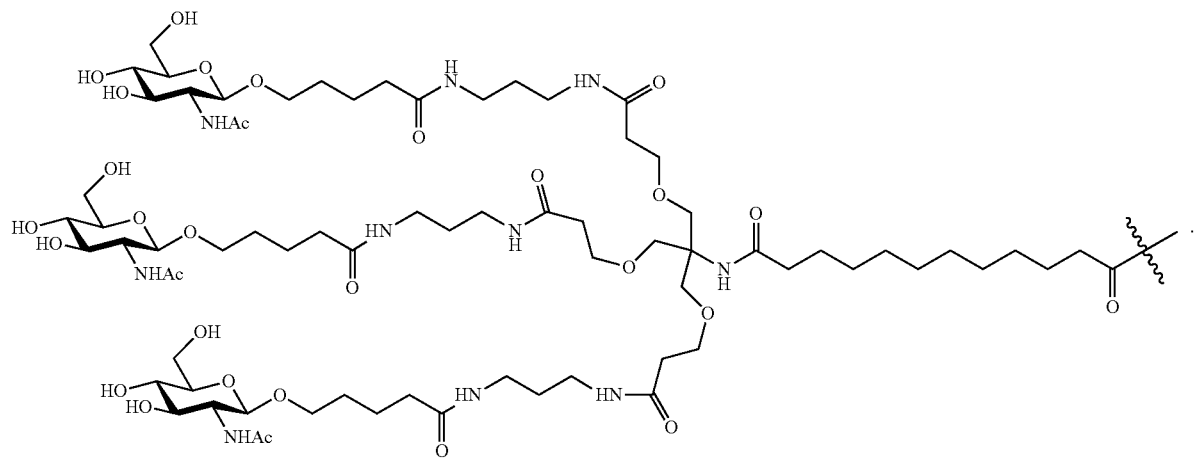

In some embodiments, $R^{TD}$ comprises or is
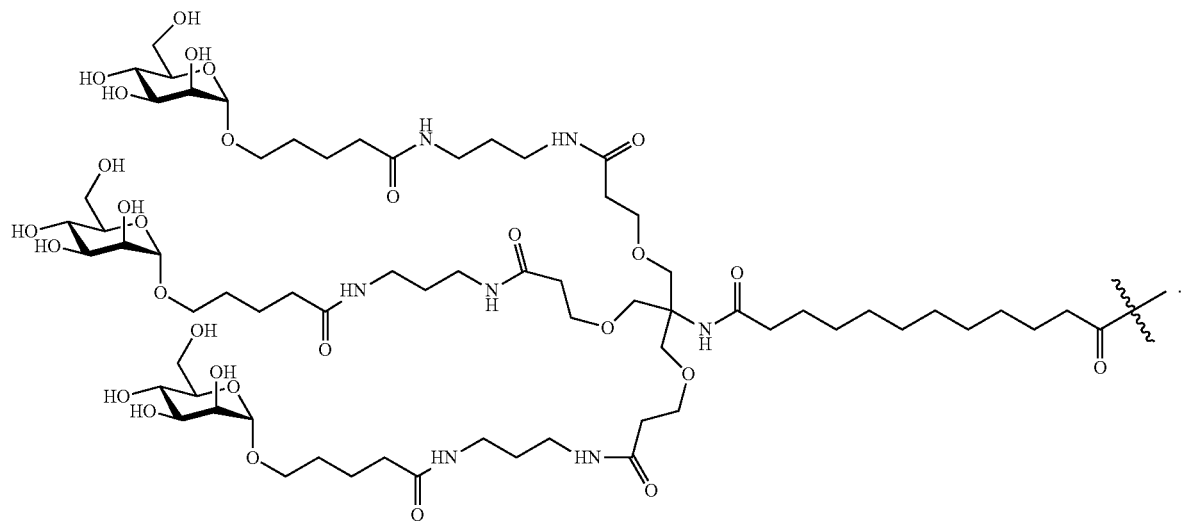
In some embodiments, $R^{TD}$ comprises or is
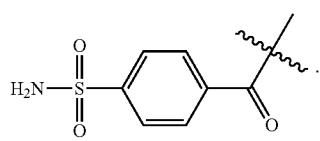 [SMILES: *C(=O)c1ccc(S(N)(=O)=O)cc1]
In some embodiments, $R^{TD}$ comprises or is
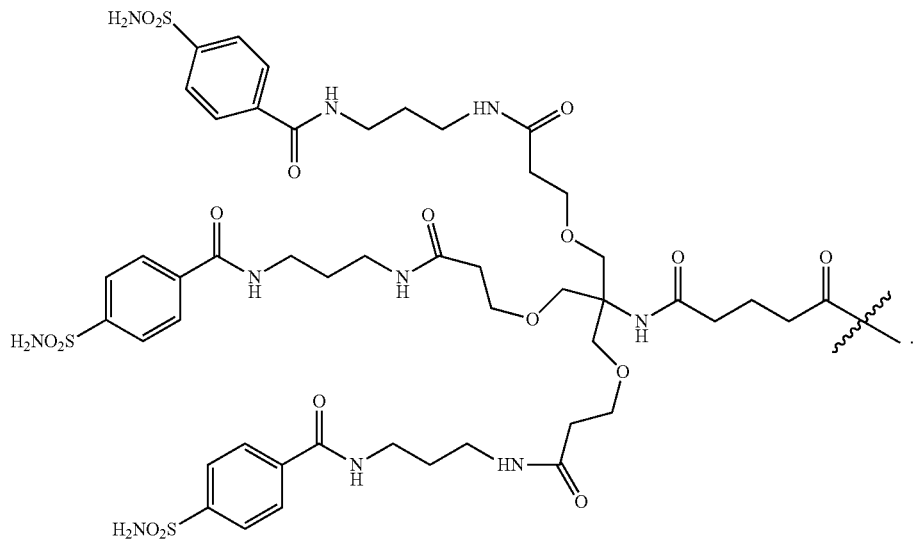 [SMILES: *C(=O)CCCC(=O)NC(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]

In some embodiments, $R^{TD}$ comprises or is
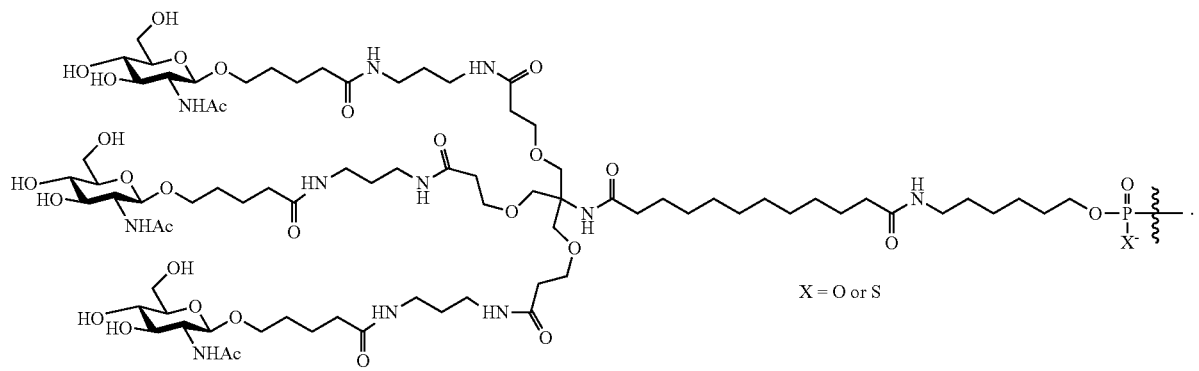
In some embodiments, $R^{TD}$ comprises or is

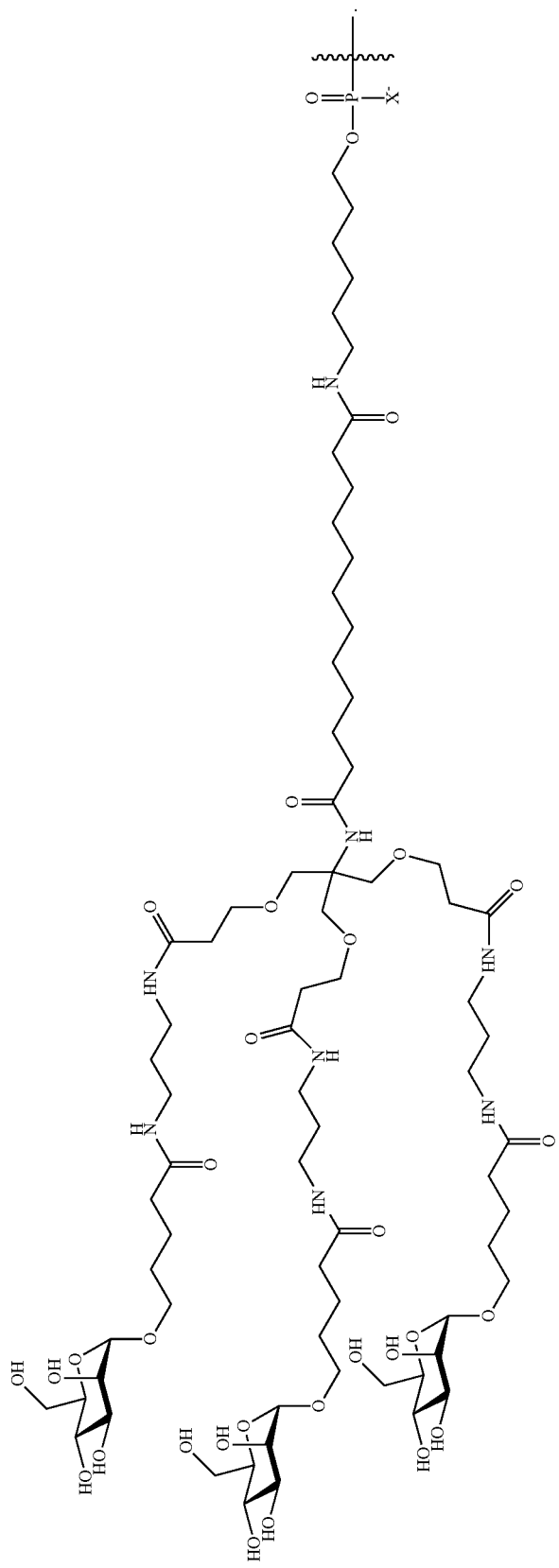
X = O or S

In some embodiments, $R^{TD}$ comprises or is

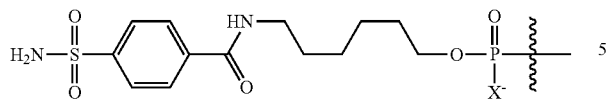

X=O or S.
In some embodiments, $R^{TD}$ comprises or is

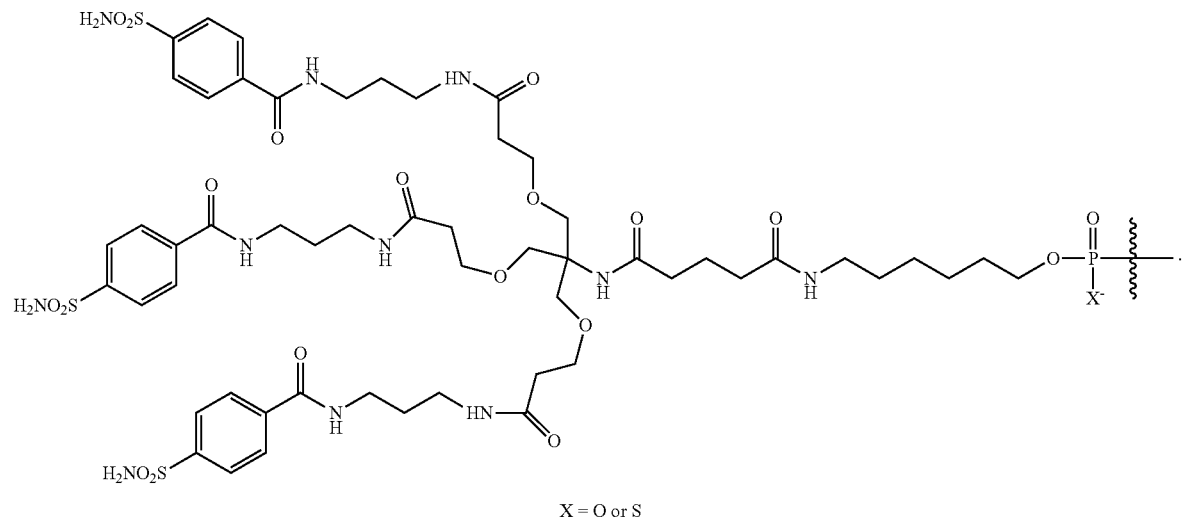

X = O or S

In some embodiments, $R^{TD}$ is a targeting component that comprises or is a lipid moiety. In some embodiments, X is O. In some embodiments, X is S.

In some embodiments, the present disclosure provides technologies (e.g., reagents, methods, etc.) for conjugating various moieties to oligonucleotide moieties. In some embodiments, the present disclosure provides technologies for conjugating targeting component to oligonucleotide moieties. In some embodiments, the present disclosure provides acids comprising targeting components for conjugation, e.g., $R^{LD}$—COOH. In some embodiments, the present disclosure provides linkers for conjugation, e.g., $L^M$. A person having ordinary skill in the art understands that many known and widely practiced technologies can be utilized for conjugation with oligonucleotide moieties in accordance with the present disclosure. In some embodiments, a provided acid is

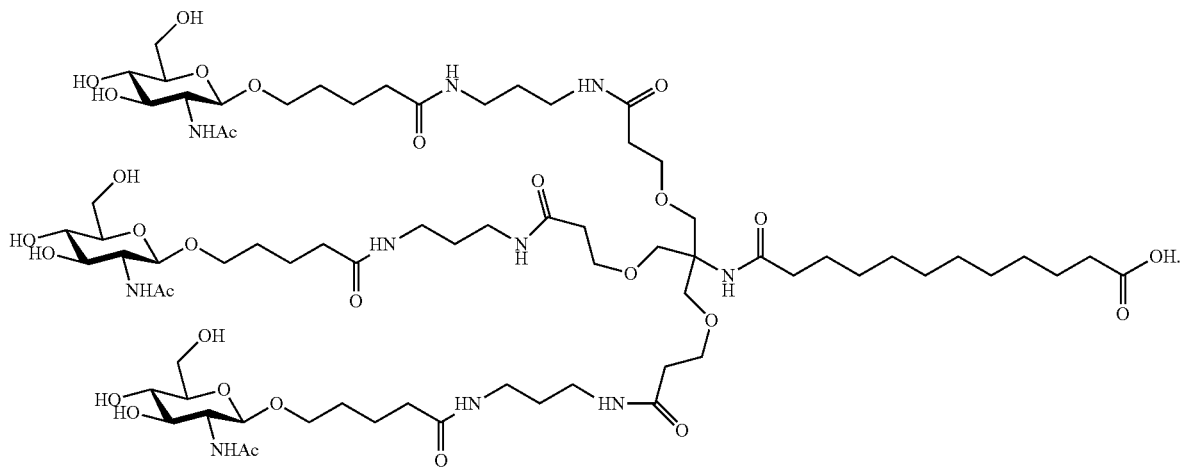

In some embodiments, a provided acid is

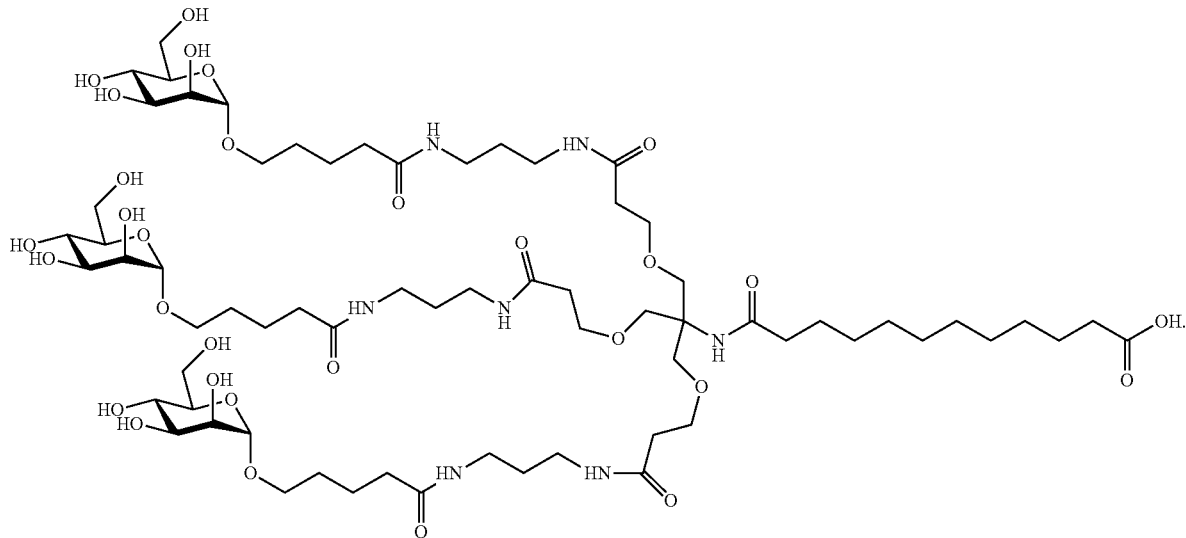

In some embodiments, a provided acid is

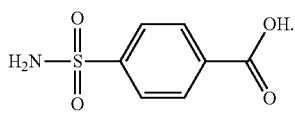 [SMILES: NS(=O)(=O)c1ccc(C(=O)O)cc1]

In some embodiments, a provided acid is

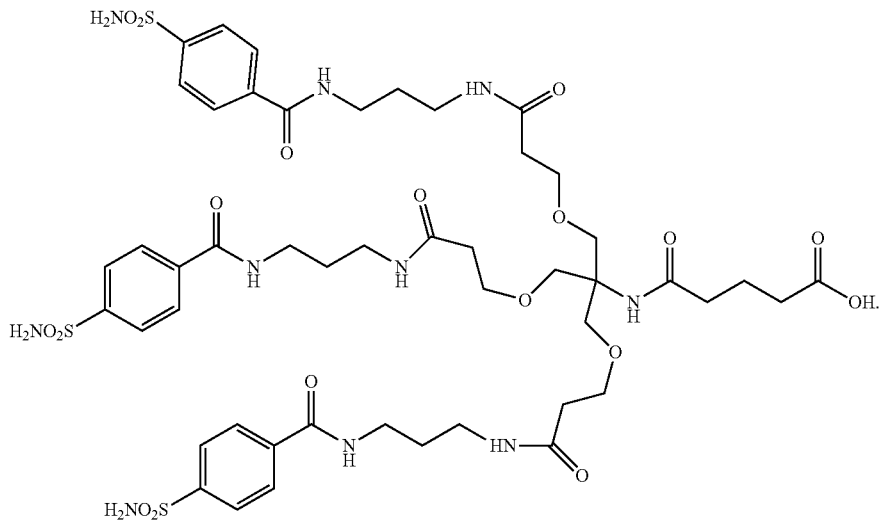 [SMILES: NS(=O)(=O)c1ccc(C(=O)NCCCNC(=O)CCOCC(COCCC(=O)NCCCNC(=O)c2ccc(S(N)(=O)=O)cc2)(COCCC(=O)NCCCNC(=O)c2ccc(S(N)(=O)=O)cc2)NC(=O)CCCC(=O)O)cc1]

In some embodiments, a provided acid is a fatty acid, which can provide a lipid moiety as a targeting component. In some embodiments, the present disclosure provides methods and reagents for preparing such acids.

In some embodiments, a targeting moiety is a lipid moiety, e.g., moiety of cholesterol or derivatives thereof ($R^{TD}$—H is an optionally substituted cholesterol or derivatives thereof).

In some embodiments, a targeting moiety is a peptide. In some embodiments, a targeting moiety is protein or a domain thereof. In some embodiments, a targeting moiety is antibody or a portion thereof.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any targeting moiety described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any targeting moiety described herein or known in the art in combination with any other structural element or modification described herein, including but not limited to, base sequence or portion thereof, sugar, base; internucleotidic linkage; stereochemistry or pattern thereof; additional chemical moiety, including but not limited to, a lipid moiety, a GalNAc moiety, etc.; seed region; post-seed region; 5'-end structure; 5'-end region; 5' nucleotide moiety; 3'-end region; 3'-terminal dinucleotide; 3'-end cap; length; GC content; pattern of modifications of sugars, bases or internucleotidic linkages; format or any structural element thereof, and/or any other structural element or modification described herein; and in some embodiments, the present disclosure pertains to multimers of any such oligonucleotides.

Optional Additional Chemical Moieties Conjugated to an Oligonucleotide: A Lipid Moiety In some embodiments, provided oligonucleotides or oligonucleotide compositions further comprise one or more lipids or lipid moieties. In some embodiments, a lipid is a lipid moiety. In some embodiments, a lipid moiety is or comprises a lipid which is conjugated directly or indirectly to an oligonucleotide. In some embodiments, lipid conjugation can achieve one or more unexpected, greatly improved properties (e.g., activities, toxicities, distribution, pharmacokinetics, etc.). As appreciated by a person having ordinary skill in the art, various carbohydrate moieties are described in the literature and can be utilized in accordance with the present disclosure.

Lipid moieties can be incorporated into oligonucleotides at various locations, for example, sugar units, internucleotidic linkage units, nucleobase units, etc., optionally through one or more bivalent or multivalent linkers (which can be used to connect two or more carbohydrate moieties to oligonucleotides). In some embodiments, the present disclosure provides technologies for lipid incorporation into oligonucleotides. In some embodiments, the present disclosure provides technologies for incorporating lipid moieties, optionally through one or more linkers, at nucleobase units, as an alternative and/or addition to incorporation at internucleotidic linkages and/or sugar units, thereby providing enormous flexibility and/or improved properties and/or activities. In some embodiments, a provided oligonucleotide comprises at least one lipid moiety, optionally through a linker, incorporated into the oligonucleotide at a nucleobase unit.

In some embodiments, provided oligonucleotides have the structure of:

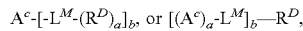

$A^c\text{-}[\text{-}L^M\text{-}(R^D)_a]_b$, or $[(A^c)_a\text{-}L^M]_b\text{—}R^D$, wherein:

$A^c$ is an oligonucleotide chain ($[H]_b\text{-}A^c$ is an oligonucleotide);

a is 1-1000;

b is 1-1000;

each $L^M$ is independently a linker; and each $R^D$ is independently $R^{LD}$ or $R^{CD}$, $R^{CD}$ is an optionally substituted, linear or branched group selected from a $C_{1-100}$ aliphatic group and a C1-100 heteroaliphatic group having 1-30 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with Cy;

$R^{LD}$ is an optionally substituted, linear or branched group selected from a $C_{1-100}$ aliphatic group wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with Cy;

$L^M$ is a covalent bond, or a bivalent or multivalent, optionally substituted, linear or branched group selected from a $C_{1-100}$ aliphatic group and a $C_{1-100}$ heteroaliphatic group having 1-30 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with $Cy^L$;

$Cy^L$ is an optionally substituted tetravalent group selected from a $C_{3-20}$ cycloaliphatic ring, a C6-20 aryl ring, a 5-20 membered heteroaryl ring having 1-10 heteroatoms independently selected from oxygen, nitrogen, sulfur, phosphorus and silicon, and a 3-20 membered heterocyclyl ring having 1-10 heteroatoms independently selected from oxygen, nitrogen, sulfur, phosphorus, boron and silicon;

each R' is independently —R, —C(O)R, —C(O)OR, or —S(O)$_2$R; and each R is independently —H, or an optionally substituted group selected from $C_{1-30}$ aliphatic, $C_{1-30}$ heteroaliphatic having 1-10 heteroatoms independently selected from oxygen, nitrogen, sulfur, phosphorus and silicon, $C_{6-30}$ aryl, $C_{6-30}$ arylaliphatic, $C_{6-30}$ arylheteroaliphatic having 1-10 heteroatoms independently selected from oxygen, nitrogen, sulfur, phosphorus and silicon, 5-30 membered heteroaryl having 1-10 heteroatoms independently selected from oxygen, nitrogen, sulfur, phosphorus and silicon, and 3-30 membered heterocyclyl having 1-10 heteroatoms independently selected from oxygen, nitrogen, sulfur, phosphorus and silicon, or two R groups are optionally and independently taken together to form a covalent bond, or:

two or more R groups on the same atom are optionally and independently taken together with the atom to form an optionally substituted, 3-30 membered monocyclic, bicyclic or polycyclic ring having, in addition to the atom, 0-10 heteroatoms independently selected from oxygen, nitrogen, sulfur, phosphorus and silicon; or two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms independently selected from oxygen, nitrogen, sulfur, phosphorus and silicon.

In some embodiments, $R^{CD}$ is a carbohydrate moiety or a bicyclic ketal. In some embodiments, $R^{CD}$ comprises at least one monosaccharide, disaccharide, or polysaccharide units. In some embodiments, $R^{CD}$ comprises at least one GalNAc moiety or a derivative thereof.

In some embodiments, $R^{LD}$ is a lipid moiety. In some embodiments, $R^{LD}$ comprises one or more optionally substituted $C_{6-20}$ aliphatic chain. In some embodiments, $R^{LD}$ comprises one or more unsubstituted $C_{6-20}$ aliphatic chain.

In some embodiments, at least one $L^M$ is directly bound to a sugar unit of a provided oligonucleotide. In some embodiments, a $L^M$ directly binds to a sugar unit incorporates a lipid moiety into an oligonucleotide. In some embodiments, a $L^M$ directly binds to a sugar unit incorporates a carbohydrate moiety into an oligonucleotide. In some embodiments, a $L^M$ directly binds to a sugar unit incorporates a $R^{LD}$ group into an oligonucleotide. In some embodiments, a $L^M$ directly binds to a sugar unit incorporates a $R^{CD}$ group into an oligonucleotide.

In some embodiments, at least one $L^M$ is directly bound to an internucleotidic linkage unit of a provided oligonucleotide. In some embodiments, a $L^M$ directly binds to an internucleotidic linkage unit incorporates a lipid moiety into an oligonucleotide. In some embodiments, a $L^M$ directly binds to an internucleotidic linkage unit incorporates a carbohydrate moiety into an oligonucleotide. In some embodiments, a $L^M$ directly binds to an internucleotidic linkage unit incorporates a $R^{LD}$ group into an oligonucleotide. In some embodiments, a $L^M$ directly binds to an internucleotidic linkage unit incorporates a $R^{CD}$ group into an oligonucleotide.

In some embodiments, at least one $L^M$ is directly bound to a nucleobase unit of a provided oligonucleotide. In some embodiments, a $L^M$ directly binds to a nucleobase unit incorporates a lipid moiety into an oligonucleotide. In some embodiments, a $L^M$ directly binds to a nucleobase unit incorporates a carbohydrate moiety into an oligonucleotide. In some embodiments, a $L^M$ directly binds to a nucleobase unit incorporates a $R^{LD}$ group into an oligonucleotide. In some embodiments, a $L^M$ directly binds to a nucleobase unit incorporates a $R^{CD}$ group into an oligonucleotide.

In some embodiments, $[H]_b\text{-}A^c$ is an oligonucleotide described in the present disclosure.

In some embodiments, incorporation of a lipid into a provided oligonucleotide improves distribution and/or pharmacokinetics. In some embodiments, incorporation of a lipid into a provided oligonucleotide improves one or more measurement of pharmacokinetics selected from: $C_{max}$, peak plasma concentration of a drug after administration; $t_{max}$, time to reach $C_{max}$; $C_{min}$, lowest (trough) concentration that a drug reaches before the next dose is administered; elimination half-life, the time required for the concentration of the drug to reach half of its original value; elimination rate constant, rate at which a drug is removed from the body; area under the curve, integral of the concentration-time curve (after a single dose or in steady state); and clearance, volume of plasma cleared of the drug per unit time. Without being bound by any particular theory, this disclosure notes that optimization of a pharmacokinetic characteristic such as half-life can be distinguished from maximization. In some embodiments, in general, it may be desirable for a particular drug to have a half-life sufficient to allow performance of its desired function, but short enough to minimize off-target effects and other toxicity. In some embodiments, an optimized half-life is long enough to allow activity while minimizing toxicity; a prolonged or maximized half-life may be undesirable.

In some embodiments, provided oligonucleotide compositions further comprise one or more lipids. In some embodiments, provided oligonucleotide compositions further comprise one or more fatty acids. In some embodiments, the lipids can be incorporated into provided oligonucleotides in the compositions. In some embodiments, two or more same or different lipids can be incorporated into one oligonucleotide, through either the same or differently chemistry and/or locations.

In some embodiments, a composition comprises an oligonucleotide disclosed herein [as non-limiting examples, a chirally controlled oligonucleotide composition, wherein the oligonucleotides are of a sequence that comprises or is the sequence of any oligonucleotide disclosed herein, comprise one or more chemical structures (e.g., 5'-end structures, chemical modifications to sugars, bases, internucleotidic linkages, etc.) and/or patterns described herein, and/or comprise backbone chiral center stereochemistry and/or patterns thereof, etc.] and a lipid. In some embodiments, a provided oligonucleotide comprises base sequence, pattern of backbone linkages, pattern or backbone chiral centers, and/or pattern of chemical modifications (e.g., base modifications, sugar modifications, etc.) and/or any structure, component, and/or format of any oligonucleotide disclosed herein, and a lipid and/or a carbohydrate. In some embodiments, a provided composition comprises an oligonucleotide disclosed herein and a lipid moiety, wherein the lipid is incorporated into the oligonucleotide. In some embodiments, a provided composition comprises an oligonucleotide disclosed herein and a carbohydrate moiety, wherein the carbohydrate is incorporated into the oligonucleotide. In some embodiments, a provided composition comprises an oligonucleotide disclosed herein and a lipid and a carbohydrate moiety, wherein the lipid and the carbohydrate is incorporated into the oligonucleotide.

Many lipids can be utilized in provided technologies in accordance with the present disclosure. In some embodiments, a lipid comprises an $R^{LD}$ group. In some embodiments, $R^{LD}$ is an optionally substituted, $C_{10}$-$C_{80}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, and -Cy-. In some embodiments, $R^{LD}$ is an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, and -Cy-. In some embodiments, $R^{LD}$ is a hydrocarbon group consisting of carbon and hydrogen atoms. In some embodiments, -Cy- is an optionally substituted bivalent group selected from a $C_{3-20}$ cycloaliphatic ring, a $C_{6-20}$ aryl ring, a 5-20 membered heteroaryl ring having 1-10 heteroatoms independently selected from oxygen, nitrogen, sulfur, phosphorus and silicon, and a 3-20 membered heterocyclyl ring having 1-10 heteroatoms independently selected from oxygen, nitrogen, sulfur, phosphorus, boron and silicon.

In some embodiments, $R^{LD}$ is an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, and -Cy-. In some embodiments, $R^{LD}$ is an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, and -Cy-. In some embodiments, $R^{LD}$ is a hydrocarbon group consisting carbon and hydrogen atoms.

In some embodiments, $R^{LD}$ is an optionally substituted, $C_{10}$-$C_{40}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, and -Cy-. In some embodiments, $R^{LD}$ is an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$—, and -Cy-. In some embodiments, $R^{LD}$ is a hydrocarbon group consisting carbon and hydrogen atoms.

The aliphatic group of $R^{LD}$ can be a variety of suitable length. In some embodiments, it is $C_{10}$-$C_{80}$. In some embodiments, it is $C_{10}$-$C_{75}$. In some embodiments, it is $C_{10}$-$C_{70}$. In some embodiments, it is $C_{10}$-$C_{65}$. In some embodiments, it is $C_{10}$-$C_{60}$. In some embodiments, it is $C_{10}$-$C_{50}$. In some embodiments, it is $C_{10}$-$C_{40}$. In some embodiments, it is $C_{10}$-$C_{35}$. In some embodiments, it is $C_{10}$-$C_{30}$. In some embodiments, it is $C_{10}$-$C_{25}$. In some embodiments, it is $C_{10}$-$C_{24}$. In some embodiments, it is $C_{10}$-$C_{23}$. In some embodiments, it is $C_{10}$-$C_{22}$. In some embodiments, it is $C_{10}$-$C_{21}$. In some embodiments, it is $C_{12}$-$C_{22}$. In some embodiments, it is $C_{13}$-$C_{22}$. In some embodiments, it is $C_{14}$-$C_{22}$. In some embodiments, it is $C_{15}$-$C_{22}$. In some embodiments, it is $C_{16}$-$C_{22}$. In some embodiments, it is $C_{17}$-$C_{22}$. In some embodiments, it is $C_{18}$-$C_{22}$. In some embodiments, it is $C_{10}$-$C_{20}$. In some embodiments, the lower end of the range is $C_{10}$, $C_{11}$, $C_{12}$, $C_{13}$, $C_{14}$, $C_{15}$, $C_{16}$, $C_{17}$, or $C_{18}$. In some embodiments, the higher end of the range is $C_{18}$, $C_{19}$, $C_{20}$, $C_{21}$, $C_{22}$, $C_{23}$, $C_{24}$, $C_{25}$, $C_{26}$, $C_{27}$, $C_{28}$, $C_{29}$, $C_{30}$, $C_{35}$, $C_{40}$, $C_{45}$, $C_{50}$, $C_{55}$, or $C_{60}$. In some embodiments, it is $C_{10}$. In some embodiments, it is $C_{11}$. In some embodiments, it is $C_{12}$. In some embodiments, it is $C_{13}$. In some embodiments, it is $C_{14}$. In some embodiments, it is $C_{15}$. In some embodiments, it is $C_{16}$. In some embodiments, it is $C_{17}$. In some embodiments, it is $C_{18}$. In some embodiments, it is $C_{19}$. In some embodiments, it is $C_{20}$. In some embodiments, it is $C_{21}$. In some embodiments, it is $C_{22}$. In some embodiments, it is $C_{23}$. In some embodiments, it is $C_{24}$. In some embodiments, it is $C_{25}$. In some embodiments, it is $C_{30}$. In some embodiments, it is $C_{35}$. In some embodiments, it is $C_{40}$. In some embodiments, it is $C_{45}$. In some embodiments, it is $C_{50}$. In some embodiments, it is $C_{55}$. In some embodiments, it is $C_{60}$.

In some embodiments, a lipid comprises no more than one $R^{LD}$ group. In some embodiments, a lipid comprises two or more $R^{LD}$ groups.

In some embodiments, a lipid is conjugated to a biologically active agent, optionally through a linker, as a moiety comprising an $R^{LD}$ group. In some embodiments, a lipid is conjugated to a biologically active agent, optionally through a linker, as a moiety comprising no more than one $R^{LD}$ group. In some embodiments, a lipid is conjugated to a biologically active agent, optionally through a linker, as an $R^{LD}$ group. In some embodiments, a lipid is conjugated to a biologically active agent, optionally through a linker, as a moiety comprising two or more $R^{LD}$ groups.

In some embodiments, $R^{LD}$ is an optionally substituted, $C_{10}$-$C_{40}$ saturated or partially unsaturated, aliphatic chain. In some embodiments, a lipid comprises an optionally substituted $C_{10}$-$C_{40}$ saturated or partially unsaturated, aliphatic chain.

In some embodiments, $R^{LD}$ is an optionally substituted $C_{10}$-$C_{40}$ linear, saturated or partially unsaturated, aliphatic chain. In some embodiments, a lipid comprises an optionally substituted $C_{10}$-$C_{40}$ linear, saturated or partially unsaturated, aliphatic chain.

In some embodiments, $R^{LD}$ is a $C_{10}$-$C_{40}$ linear, saturated or partially unsaturated, aliphatic chain, optionally substituted with one or more $C_{1-4}$ aliphatic groups. In some embodiments, a lipid comprises a $C_{10}$-$C_{40}$ linear, saturated or partially unsaturated, aliphatic chain, optionally substituted with one or more $C_{1-4}$ aliphatic groups. In some embodiments, $R^{LD}$ is a $C_{10}$-$C_{40}$ linear, saturated or partially unsaturated, aliphatic chain, optionally substituted with one or more $C_{1-2}$ aliphatic groups. In some embodiments, a lipid comprises a $C_{10}$-$C_{40}$ linear, saturated or partially unsaturated, aliphatic chain, optionally substituted with one or more $C_{1-2}$ aliphatic groups. In some embodiments, $R^{LD}$ is a $C_{10}$-$C_{40}$ linear, saturated or partially unsaturated, aliphatic chain, optionally substituted with one or more methyl groups. In some embodiments, a lipid comprises a $C_{10}$-$C_{40}$ linear, saturated or partially unsaturated, aliphatic chain, optionally substituted with one or more methyl groups.

In some embodiments, $R^{LD}$ is an unsubstituted $C_{10}$-$C_{40}$ linear, saturated or partially unsaturated, aliphatic chain. In some embodiments, a lipid comprises an unsubstituted $C_{10}$-$C_{40}$ linear, saturated or partially unsaturated, aliphatic chain.

In some embodiments, a lipid comprises no more than one optionally substituted $C_{10}$-$C_{40}$ linear, saturated or partially unsaturated, aliphatic chain. In some embodiments, a lipid comprises two or more optionally substituted $C_{10}$-$C_{40}$ linear, saturated or partially unsaturated, aliphatic chain.

In some embodiments, $R^{LD}$ is an optionally substituted, $C_{10}$-$C_{60}$ saturated or partially unsaturated, aliphatic chain. In some embodiments, a lipid comprises an optionally substituted $C_{10}$-$C_{60}$ saturated or partially unsaturated, aliphatic chain.

In some embodiments, $R^{LD}$ is an optionally substituted $C_{10}$-$C_{60}$ linear, saturated or partially unsaturated, aliphatic chain. In some embodiments, a lipid comprises an optionally substituted $C_{10}$-$C_{60}$ linear, saturated or partially unsaturated, aliphatic chain.

In some embodiments, $R^{LD}$ is a $C_{10}$-$C_{60}$ linear, saturated or partially unsaturated, aliphatic chain, optionally substituted with one or more $C_{1-4}$ aliphatic groups. In some embodiments, a lipid comprises a $C_{10}$-$C_{60}$ linear, saturated or partially unsaturated, aliphatic chain, optionally substituted with one or more $C_{1-4}$ aliphatic groups. In some embodiments, $R^{LD}$ is a $C_{10}$-$C_{60}$ linear, saturated or partially unsaturated, aliphatic chain, optionally substituted with one or more $C_{1-2}$ aliphatic groups. In some embodiments, a lipid comprises a $C_{10}$-$C_{60}$ linear, saturated or partially unsatumore $C_{1-2}$ aliphatic groups. In some embodiments, $R^{LD}$ is a $C_{10}$-$C_{60}$ linear, saturated or partially unsaturated, aliphatic chain, optionally substituted with one or more methyl groups. In some embodiments, a lipid comprises a $C_{10}$-$C_{60}$ linear, saturated or partially unsaturated, aliphatic chain, optionally substituted with one or more methyl groups.

In some embodiments, $R^{LD}$ is an unsubstituted $C_{10}$-$C_{60}$ linear, saturated or partially unsaturated, aliphatic chain. In some embodiments, a lipid comprises an unsubstituted $C_{10}$-$C_{60}$ linear, saturated or partially unsaturated, aliphatic chain.

In some embodiments, a lipid comprises no more than one optionally substituted $C_{10}$-$C_{60}$ linear, saturated or partially unsaturated, aliphatic chain. In some embodiments, a lipid comprises two or more optionally substituted $C_{10}$-$C_{60}$ linear, saturated or partially unsaturated, aliphatic chain.

In some embodiments, $R^{LD}$ is an optionally substituted, $C_{10}$-$C_{80}$ saturated or partially unsaturated, aliphatic chain. In some embodiments, a lipid comprises an optionally substituted $C_{10}$-$C_{80}$ saturated or partially unsaturated, aliphatic chain.

In some embodiments, $R^{LD}$ is an optionally substituted $C_{10}$-$C_{80}$ linear, saturated or partially unsaturated, aliphatic chain. In some embodiments, a lipid comprises an optionally substituted $C_{10}$-$C_{80}$ linear, saturated or partially unsaturated, aliphatic chain.

In some embodiments, $R^{LD}$ is a $C_{10}$-$C_{80}$ linear, saturated or partially unsaturated, aliphatic chain, optionally substituted with one or more $C_{1-4}$ aliphatic groups. In some embodiments, a lipid comprises a $C_{10}$-$C_{80}$ linear, saturated or partially unsaturated, aliphatic chain, optionally substituted with one or more $C_{1-4}$ aliphatic groups. In some embodiments, $R^{LD}$ is a $C_{10}$-$C_{80}$ linear, saturated or partially unsaturated, aliphatic chain, optionally substituted with one or more $C_{1-2}$ aliphatic groups. In some embodiments, a lipid comprises a $C_{10}$-$C_{80}$ linear, saturated or partially unsaturated, aliphatic chain, optionally substituted with one or more $C_{1-2}$ aliphatic groups. In some embodiments, $R^{LD}$ is a $C_{10}$-$C_{80}$ linear, saturated or partially unsaturated, aliphatic chain, optionally substituted with one or more methyl groups. In some embodiments, a lipid comprises a $C_{10}$-$C_{80}$ linear, saturated or partially unsaturated, aliphatic chain, optionally substituted with one or more methyl groups.

In some embodiments, $R^{LD}$ is an unsubstituted $C_{10}$-$C_{80}$ linear, saturated or partially unsaturated, aliphatic chain. In some embodiments, a lipid comprises an unsubstituted $C_{10}$-$C_{80}$ linear, saturated or partially unsaturated, aliphatic chain.

In some embodiments, a lipid comprises no more than one optionally substituted $C_{10}$-$C_{80}$ linear, saturated or partially unsaturated, aliphatic chain. In some embodiments, a lipid comprises two or more optionally substituted $C_{10}$-$C_{80}$ linear, saturated or partially unsaturated, aliphatic chain.

In some embodiments, $R^{LD}$ is or comprises a $C_{10}$ saturated linear aliphatic chain. In some embodiments, $R^{LD}$ is or comprises a $C_{10}$ partially unsaturated linear aliphatic chain. In some embodiments, $R^{LD}$ is or comprises a $C_{11}$ saturated linear aliphatic chain. In some embodiments, $R^{LD}$ is or comprises a $C_{11}$ partially unsaturated linear aliphatic chain. In some embodiments, $R^{LD}$ is or comprises a Cu saturated linear aliphatic chain. In some embodiments, $R^{LD}$ is or comprises a Cu partially unsaturated linear aliphatic chain. In some embodiments, $R^{LD}$ is or comprises a $C_{13}$ saturated linear aliphatic chain. In some embodiments, $R^{LD}$ is or comprises a $C_{13}$ partially unsaturated linear aliphatic chain. In some embodiments, $R^{LD}$ is or comprises a $C_{14}$ saturated linear aliphatic chain. In some embodiments, $R^{LD}$ is or comprises a $C_{14}$ partially unsaturated linear aliphatic chain. In some embodiments, $R^{LD}$ is or comprises a $C_{15}$ saturated linear aliphatic chain. In some embodiments, $R^{LD}$ is or comprises a $C_{15}$ partially unsaturated linear aliphatic chain. In some embodiments, $R^{LD}$ is or comprises a $C_{16}$ saturated linear aliphatic chain. In some embodiments, $R^{LD}$ is or comprises a $C_{16}$ partially unsaturated linear aliphatic chain. In some embodiments, $R^{LD}$ is or comprises a $C_{17}$ saturated linear aliphatic chain. In some embodiments, $R^{LD}$ is or comprises a $C_{17}$ partially unsaturated linear aliphatic chain. In some embodiments, $R^{LD}$ is or comprises a $C_{18}$ saturated linear aliphatic chain. In some embodiments, $R^{LD}$ is or comprises a $C_{18}$ partially unsaturated linear aliphatic chain. In some embodiments, $R^{LD}$ is or comprises a $C_{19}$ saturated linear aliphatic chain. In some embodiments, $R^{LD}$ is or comprises a $C_{19}$ partially unsaturated linear aliphatic chain. In some embodiments, $R^{LD}$ is or comprises a $C_{20}$ saturated linear aliphatic chain. In some embodiments, $R^{LD}$ is or comprises a $C_{20}$ partially unsaturated linear aliphatic chain. In some embodiments, $R^{LD}$ is or comprises a $C_{21}$ saturated linear aliphatic chain. In some embodiments, $R^{LD}$ is or comprises a $C_{21}$ partially unsaturated linear aliphatic chain. In some embodiments, $R^{LD}$ is or comprises a $C_{22}$ saturated linear aliphatic chain. In some embodiments, $R^{LD}$ is or comprises a $C_{22}$ partially unsaturated linear aliphatic chain. In some embodiments, $R^{LD}$ is or comprises a $C_{23}$ saturated linear aliphatic chain. In some embodiments, $R^{LD}$ is or comprises a $C_{23}$ partially unsaturated linear aliphatic chain. In some embodiments, $R^{LD}$ is or comprises a $C_{24}$ saturated linear aliphatic chain. In some embodiments, $R^{LD}$ is or comprises a $C_{24}$ partially unsaturated linear aliphatic chain. In some embodiments, $R^{LD}$ is or comprises a $C_{25}$ saturated linear aliphatic chain. In some embodiments, $R^{LD}$ is or comprises a $C_{25}$ partially unsaturated linear aliphatic chain. In some embodiments, $R^{LD}$ is or comprises a $C_{26}$ saturated linear aliphatic chain. In some embodiments, $R^{LD}$ is or comprises a $C_{26}$ partially unsaturated linear aliphatic chain. In some embodiments, $R^{LD}$ is or comprises a $C_{27}$ saturated linear aliphatic chain. In some embodiments, $R^{LD}$ is or comprises a $C_{27}$ partially unsaturated linear aliphatic chain. In some embodiments, $R^{LD}$ is or comprises a $C_{28}$ saturated linear aliphatic chain. In some embodiments, $R^{LD}$ is or comprises a $C_{28}$ partially unsaturated linear aliphatic chain. In some embodiments, $R^{LD}$ is or comprises a $C_{29}$ saturated linear aliphatic chain. In some embodiments, $R^{LD}$ is or comprises a $C_{29}$ partially unsaturated linear aliphatic chain. In some embodiments, $R^{LD}$ is or comprises a $C_{30}$ saturated linear aliphatic chain. In some embodiments, $R^{LD}$ is or comprises a $C_{30}$ partially unsaturated linear aliphatic chain.

In some embodiments, $R^{LD}$ is derived from cholesterol or a derivatives thereof, e.g., $R^{LD}$—H is optionally substituted cholesterol or a derivative thereof.

In some embodiments, a lipid has the structure of $R^{LD}$—OH. In some embodiments, a lipid has the structure of $R^{LD}$—C(O)OH. In some embodiments, $R^{LD}$ is

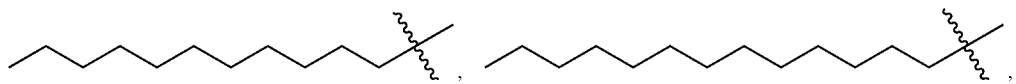

-continued

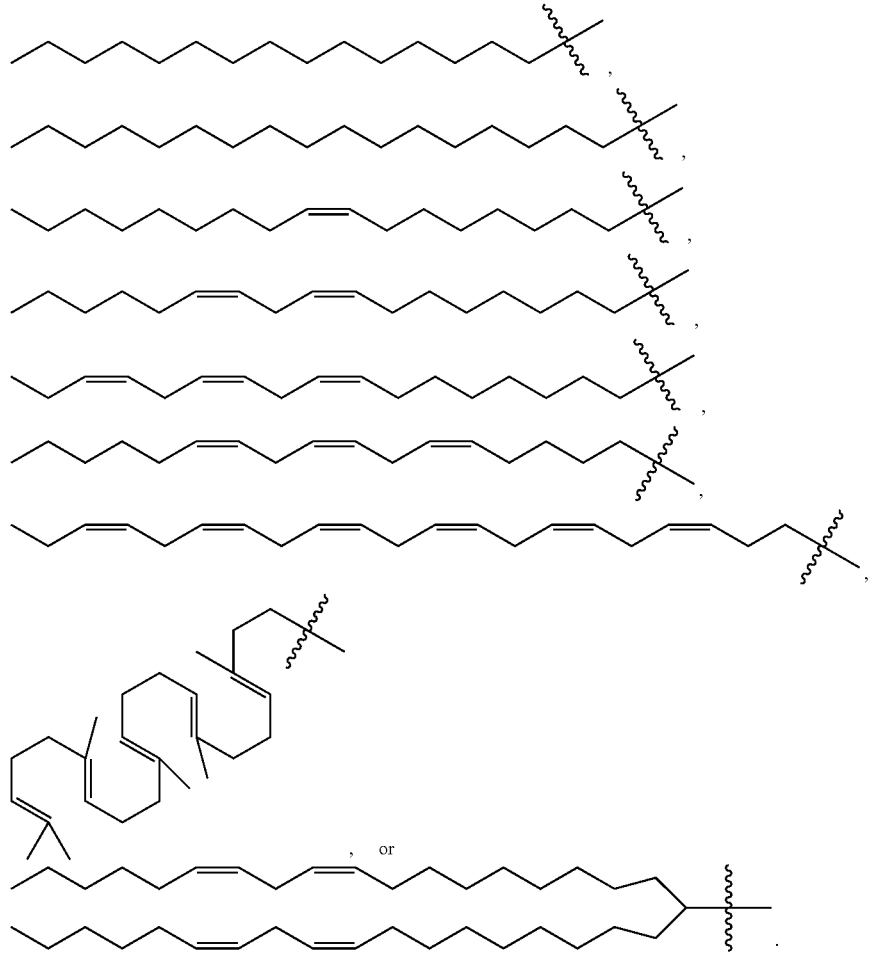

In some embodiments, a lipid is lauric acid, myristic acid, palmitic acid, stearic acid, oleic acid, linoleic acid, alpha-linolenic acid, gamma-linolenic acid, docosahexaenoic acid (DHA or cis-DHA), turbinaric acid, arachidonic acid, and dilinoleyl. In some embodiments, a lipid is lauric acid, myristic acid, palmitic acid, stearic acid, oleic acid, linoleic acid, alpha-linolenic acid, gamma-linolenic acid, docosahexaenoic acid (DHA or cis-DHA), turbinaric acid and dilinoleyl. In some embodiments, a lipid has a structure of:

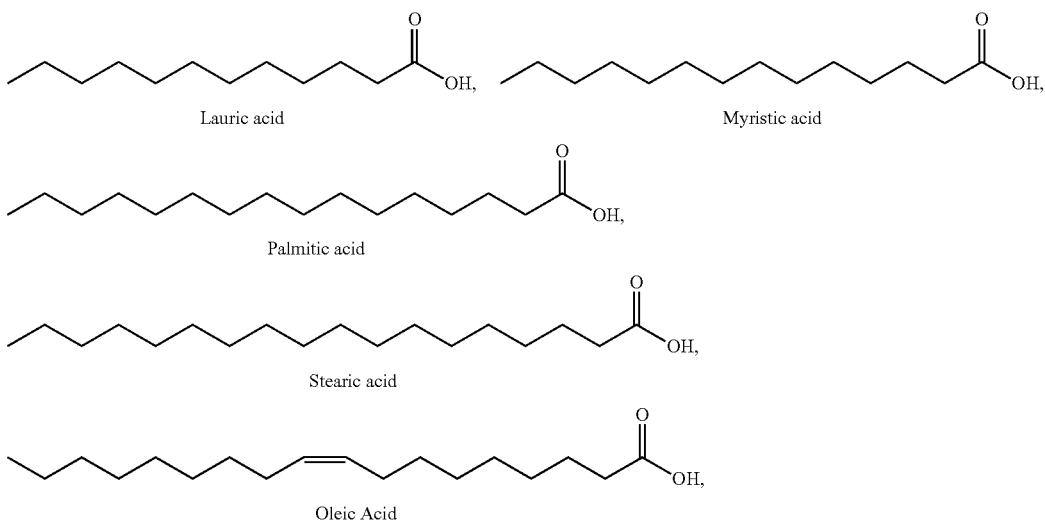

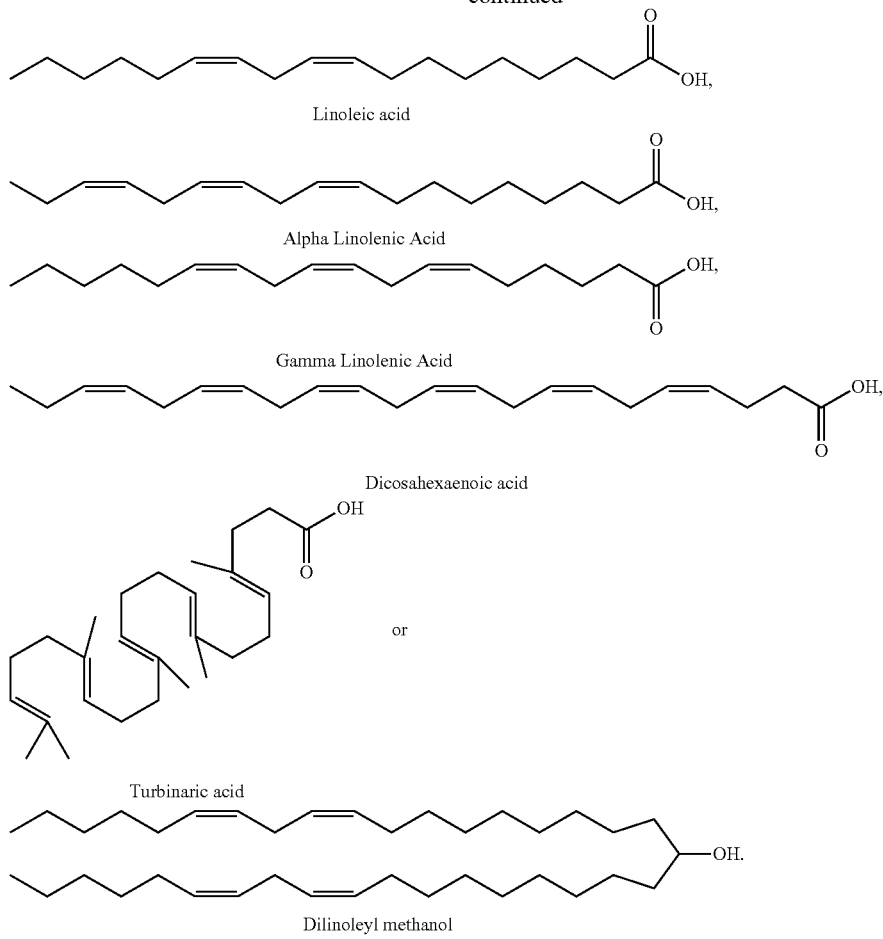

Linoleic acid

Alpha Linolenic Acid

Gamma Linolenic Acid

Dicosahexaenoic acid or

Turbinaric acid

Dilinoleyl methanol

In some embodiments, a lipid is, comprises or consists of any of: an at least partially hydrophobic or amphiphilic molecule, a phospholipid, a triglyceride, a diglyceride, a monoglyceride, a fat-soluble vitamin, a sterol, a fat and a wax. In some embodiments, a lipid is any of: a fatty acid, glycerolipid, glycerophospholipid, sphingolipid, sterol lipid, prenol lipid, saccharolipid, polyketide, and other molecule.

Lipids can be incorporated into provided technologies through many types of methods in accordance with the present disclosure. In some embodiments, lipids are physically mixed with provided oligonucleotides to form provided compositions. In some embodiments, lipids are chemically conjugated with oligonucleotide moieties.

In some embodiments, provided compositions comprise two or more lipids. In some embodiments, provided oligonucleotides comprise two or more conjugated lipids. In some embodiments, the two or more conjugated lipids are the same. In some embodiments, the two or more conjugated lipids are different. In some embodiments, provided oligonucleotides comprise no more than one lipid. In some embodiments, oligonucleotides of a provided composition comprise different types of conjugated lipids. In some embodiments, oligonucleotides of a provided composition comprise the same type of lipids.

Lipids can be conjugated to oligonucleotides optionally through linkers. Various types of linkers in the art can be utilized in accordance of the present disclosure. In some embodiments, a linker is $L^M$ as described in the present disclosure. In some embodiments, a linker comprise a phosphate group, which can, for example, be used for conjugating lipids through chemistry similar to those employed in oligonucleotide synthesis. In some embodiments, a linker comprises an amide, ester, or ether group.

In some embodiments, a linker has the structure of -$L^M$-. In some embodiments, $L^M$ is $L^D$. In some embodiments, $L^D$ is $T^D$ having the structure of

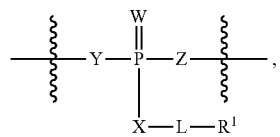

wherein each variable is independently as defined and described. In some embodiments, $T^D$ has the structure of formula I. In some embodiments, $T^D$ with the 5'—O— of an oligonucleotide moiety form a phosphorothioate linkage (—OP(O)(S⁻)O—). In some embodiments, $T^D$ with the 5'—O— of an oligonucleotide moiety form an Sp phosphorothioate linkage. In some embodiments, $T^D$ with the 5'—O— of an oligonucleotide moiety form an Rp phosphorothioate linkage. In some embodiments, $T^D$ with the 5'—O— of an oligonucleotide moiety form a phosphate linkage (—OP(O)(O⁻)O—). In some embodiments, $T^D$ with the 5'—O— of an oligonucleotide moiety form a phosphorodithioate linkage. In some embodiments, $L^D$ is -L-$T^D$-. In some embodiments, Y connects to -L- and —Z— is a covalent bond, so that P directly connects to a hydroxyl group of the oligonucleotide moiety. In some embodiments, P connects to the 5'-end hydroxyl (5'—O—) to form a phosphate group (natural phosphate linkage) or phosphorothioate group (phosphorothioate linkage). In some embodiments, the phosphorothioate linkage is chirally controlled and can be either Rp or Sp. Unless otherwise specified, chiral centers in the linkers (e.g., P in $T^D$) can be either stereorandom or chirally controlled, and they are not considered as part of the backbone chiral centers, e.g., for determining whether a composition is chirally controlled. In some embodiments, $L^D$ is —NH—$(CH_2)_6$-$T^D$-. In some embodiments, $L^D$ is —C(O)—NH—$(CH_2)_6$-$T^D$-.

In some embodiments, a linker has the structure of -L-. In some embodiments, after conjugation to oligonucleotides, a lipid forms a moiety having the structure of -L-$R^{LD}$, wherein each of L and $R^{LD}$ is independently as defined and described herein.

In some embodiments, -L- comprises a bivalent aliphatic chain. In some embodiments, -L- comprises a phosphate group. In some embodiments, -L- comprises a phosphorothioate group. In some embodiments, -L- has the structure of —C(O)NH—$(CH_2)_6$—OP(=O)(S$^-$)—. In some embodiments, -L- has the structure of —C(O)NH—$(CH_2)_6$—OP(=O)(O$^-$)—.

Lipids, optionally through linkers, can be incorporated into oligonucleotides at various suitable locations. In some embodiments, lipids are conjugated through the 5'-OH group. In some embodiments, lipids are conjugated through the 3'-OH group. In some embodiments, lipids are conjugated through one or more sugar moieties. In some embodiments, lipids are conjugated through one or more bases. In some embodiments, lipids are incorporated through one or more internucleotidic linkages. In some embodiments, an oligonucleotide may contain multiple conjugated lipids which are independently conjugated through its 5'-OH, 3'-OH, sugar moieties, base moieties and/or internucleotidic linkages.

In some embodiments, a linker is a moiety that connects two parts of a composition; as a non-limiting example, a linker physically connects an oligonucleotide moiety to a lipid. Non-limiting examples of suitable linkers include: an uncharged linker; a charged linker; a linker comprising an alkyl; a linker comprising a phosphate; a branched linker; an unbranched linker; a linker comprising at least one cleavage group; a linker comprising at least one redox cleavage group; a linker comprising at least one phosphate-based cleavage group; a linker comprising at least one acid-cleavage group; a linker comprising at least one ester-based cleavage group; a linker comprising at least one peptide-based cleavage group.

In some embodiments, a lipid is conjugated to an active compound optionally through a linker moiety. A person having ordinary skill in the art appreciates that various technologies can be utilized to conjugate lipids to active compound in accordance with the present disclosure. For example, for lipids comprising carboxyl groups, such lipids can be conjugated through the carboxyl groups. In some embodiments, a lipid is conjugated through a linker having the structure of -L-, wherein L is as defined and described in formula I. In some embodiments, L comprises a phosphate diester or modified phosphate diester moiety. In some embodiments, a compound formed by lipid conjugation has the structure of $(R^{LD}$-L-$)_a$-(active compound), wherein a is 1 or an integer greater than 1, and each of $R^{LD}$ and L is independently as defined and described herein. In some embodiments, a is 1. In some embodiments, a is greater than 1. In some embodiments, a is 1-50. In some embodiments, an active compound is an oligonucleotide. For example, in some embodiments, a conjugate has any of the following structures:

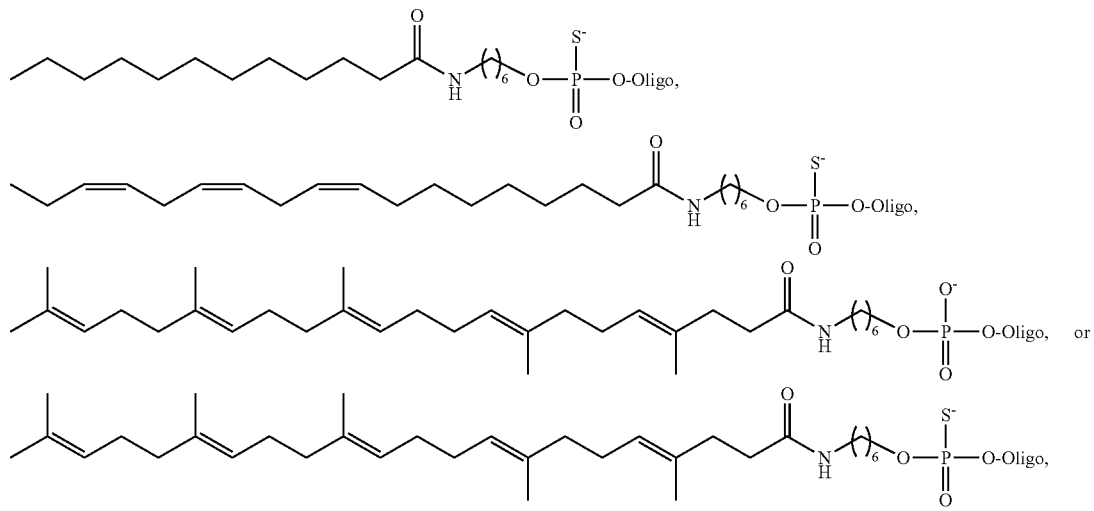

wherein Oligo indicates an oligonucleotide.

In some embodiments, a linker is selected from: an uncharged linker; a charged linker; a linker comprising an alkyl; a linker comprising a phosphate; a branched linker; an unbranched linker; a linker comprising at least one cleavage group; a linker comprising at least one redox cleavage group; a linker comprising at least one phosphate-based cleavage group; a linker comprising at least one acid-cleavage group; a linker comprising at least one ester-based cleavage group; and a linker comprising at least one peptide-based cleavage group. In some embodiments, a linker, e.g., $L^M$, has the structure of -$L^{LD}$-. In some embodiments, a linker, e.g., $L^M$, has the structure of -L-. In some embodiments, a linker comprises a linkage of formula I. In some embodiments, a linker is —C(O)NH—$(CH_2)_6$-$L^I$-, wherein $L^I$ has the structure of formula I as described herein. In some embodiments, a linker is —C(O)NH—(CH$_2$)$_6$—O—P(=O)(SR$^1$)—O—. In some embodiments, R$^1$ is —H, and a linker is —C(O)NH—(CH$_2$)$_6$—O—P(=O)(SH)—O—, in some conditions, e.g., certain pH, —C(O)NH—(CH$_2$)$_6$—O—P(=O)(S$^-$)—O—. In some embodiments, a linker is —C(O)NH—(CH$_2$)$_6$—O—P(=S)(SR$^1$)—O—. In some embodiments, R$^1$ is —H, and a linker is —C(O)NH—(CH$_2$)$_6$—O—P(=S)(SH)—O—, in some conditions, e.g., certain pH, —C(O)NH—(CH$_2$)$_6$—O—P(=S)(S$^-$)—O—. In some embodiments, a linker is —C(O)NH—(CH$_2$)$_6$—O—P(=S)(OR$^1$)—O—, wherein R$^1$ is —CH$_2$CH$_2$CN. In some embodiments, a linker is —C(O)NH—(CH$_2$)$_6$—O—P(=S)(SR$^1$)—O—, wherein R$^1$ is —CH$_2$CH$_2$CN. In some embodiments, a provided oligonucleotide is coupled with a linker and forms a structure of H-linker-oligonucleotide. In some embodiments, a provided oligonucleotide is conjugated to a lipid and forms the structure of lipid-linker-oligonucleotide, e.g., R$^{LD}$-L$^{LD}$-oligonucleotide. In some embodiments, the —O— end of a linker is connected to an oligonucleotide. In some embodiments, the —O— end of a linker is connected to the 5'-end oligonucleotide (—O— being the oxygen in the 5'-OH).

In some embodiments, a linker, e.g., L$^M$, comprises a PO (phosphodiester linkage), a PS (phosphorothioate linkage) or PS2 (phosphorodithioate linkage). A non-limiting example including a PS linker is shown below. In some embodiments, a linker is —O—P(O)(OH)—O— [phosphodiester], —O—P(O)(SH)—O— [phosphorothioate] or —O—P(S)(SH)—O— [phosphorodithioate]. In some embodiments, a linker comprises a C$_6$ amino moiety (—NH—(CH$_2$)$_6$—), which is illustrated below. In some embodiments, a linker comprises a C$_6$ amino bound to a PO, a PS, or PS2. In some embodiments, a linker is a C$_6$ amino bound to a PO, a PS, or PS2. In some embodiments, a linker, e.g., L$^{LD}$ or L, is —C(O)—NH—(CH$_2$)$_6$—P(O)(OH)—. In some embodiments, a linker, e.g., L$^{LD}$ or L, is —C(O)—NH—(CH$_2$)$_6$—P(O)(OH)—, wherein —C(O)— is connected to a lipid moiety and —P(O)(OH)— is connected to an oligonucleotide moiety. In some embodiments, a linker, e.g., L$^{LD}$ or L, is —C(O)—NH—(CH$_2$)$_6$—P(O)(OH)—, wherein —C(O)— is connected to a lipid moiety and —P(O)(OH)— is connected to the 5'—O— of an oligonucleotide moiety. In some embodiments, a linker, e.g., L$^{LD}$ or L, is —C(O)—NH—(CH$_2$)$_6$—P(O)(OH)—, wherein —C(O)— is connected to a lipid moiety and —P(O)(OH)— is connected to the 3'-O— of an oligonucleotide moiety. In some embodiments, a linker, e.g., L$^{LD}$ or L, is —C(O)—NH—(CH$_2$)$_6$—P(O)(SH)—. In some embodiments, a linker, e.g., L$^{LD}$ or L, is —C(O)—NH—(CH$_2$)$_6$—P(O)(SH)—, wherein —C(O)— is connected to a lipid moiety and —P(O)(SH)— is connected to an oligonucleotide moiety. In some embodiments, a linker, e.g., L$^{LD}$ or L, is —C(O)—NH—(CH$_2$)$_6$—P(O)(SH)—, wherein —C(O)— is connected to a lipid moiety and —P(O)(SH)— is connected to the 5'—O— of an oligonucleotide moiety. In some embodiments, a linker, e.g., L$^{LD}$ or L, is —C(O)—NH—(CH$_2$)$_6$—P(O)(SH)—, wherein —C(O)— is connected to a lipid moiety and —P(O)(SH)— is connected to the 3'-O— of an oligonucleotide moiety. In some embodiments, a linker, e.g., L$^{LD}$ or L, is —C(O)—NH—(CH$_2$)$_6$—P(S)(SH)—. In some embodiments, a linker, e.g., L$^{LD}$ or L, is —C(O)—NH—(CH$_2$)$_6$—P(S)(SH)—, wherein —C(O)— is connected to a lipid moiety and —P(S)(SH)— is connected to an oligonucleotide moiety. In some embodiments, a linker, e.g., L$^{LD}$ or L, is —C(O)—NH—(CH$_2$)$_6$—P(S)(SH)—, wherein —C(O)— is connected to a lipid moiety and —P(S)(SH)— is connected to the 5'—O— of an oligonucleotide moiety. In some embodiments, a linker, e.g., L$^{LD}$ or L, is —C(O)—NH—(CH$_2$)$_6$—P(S)(SH)—, wherein —C(O)— is connected to a lipid moiety and —P(S)(SH)— is connected to the 3'-O— of an oligonucleotide moiety. As appreciated by a person having ordinary skill in the art, at certain pH —P(O)(OH)—, —P(O)(SH)—, —P(S)(SH)— may exist as —P(O)(O$^-$)—, —P(O)(S$^-$)—, —P(S)(S$^-$)—, respectively. In some embodiments, a lipid moiety is R$^{LD}$.

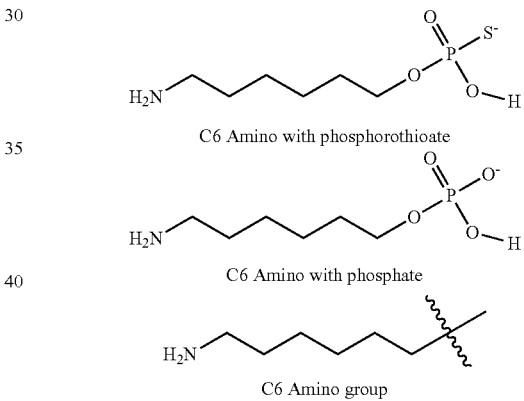

C6 Amino with phosphorothioate

C6 Amino with phosphate

C6 Amino group

Various chemistry and linkers can be used for conjugation in accordance with the present disclosure. For example, in some embodiment, a lipid is incorporated using chemistry described below, or similar processes:

HATU, DIPEA
Acetonitrile

-continued
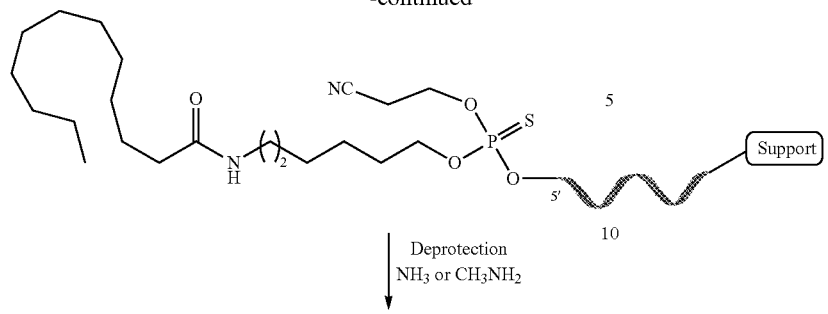
Deprotection
NH₃ or CH₃NH₂
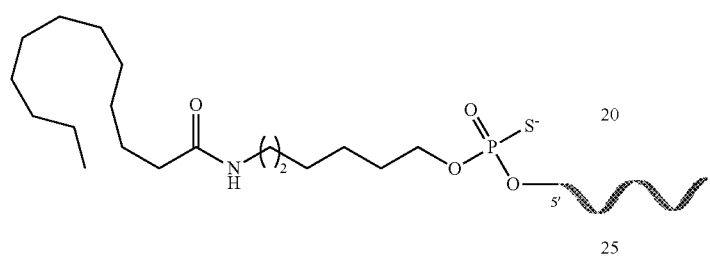
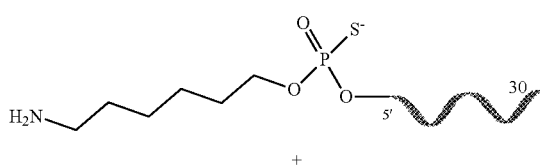
+
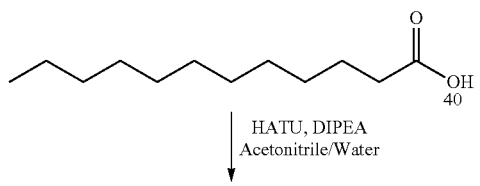
HATU, DIPEA
Acetonitrile/Water
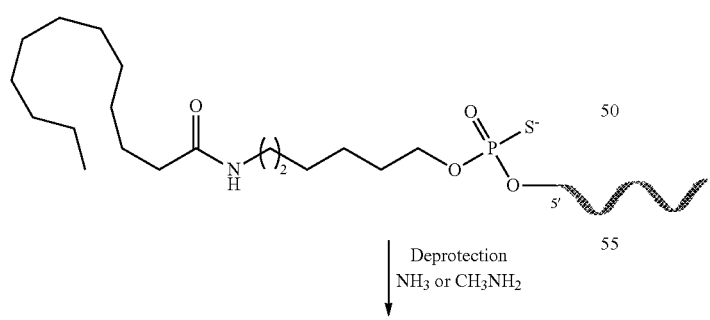
Deprotection
NH₃ or CH₃NH₂
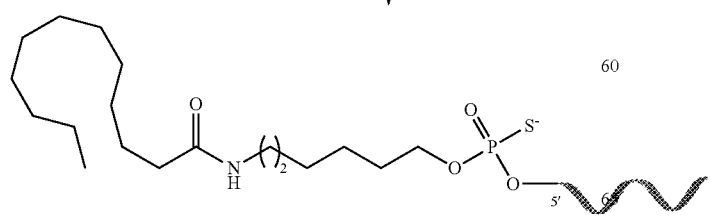

In some embodiments, a lipid is incorporated into an oligonucleotide directly through a nucleobase, for example:

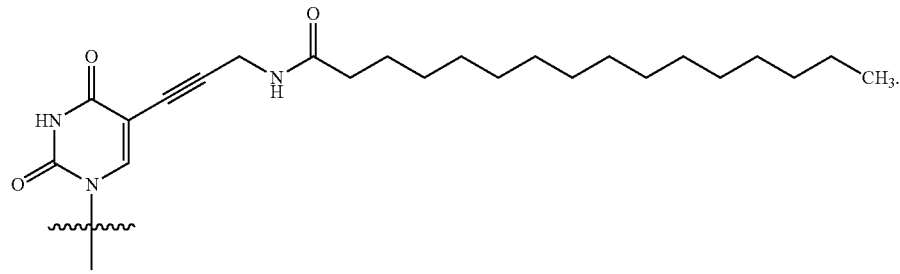 [SMILES: *n1cc(C#CCNC(=O)CCCCCCCCCCCCCCC)c(=O)[nH]c1=O]

In some embodiments, a provided oligonucleotide comprises -L$^M$-R$^{LD}$ directly bonded to a nucleobase. In some embodiments, a provided oligonucleotide comprises

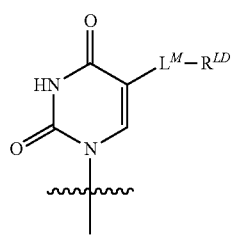

In some embodiments, a linker (L$^M$) is

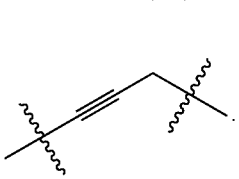 [SMILES: *C#CC*]

In some embodiments, a linker (L$^M$) is

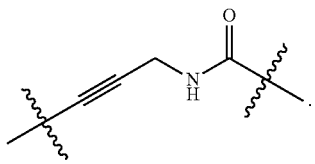 [SMILES: *C#CCNC(*)=O]

In some embodiments, a lipid moiety, R$^{LD}$, is

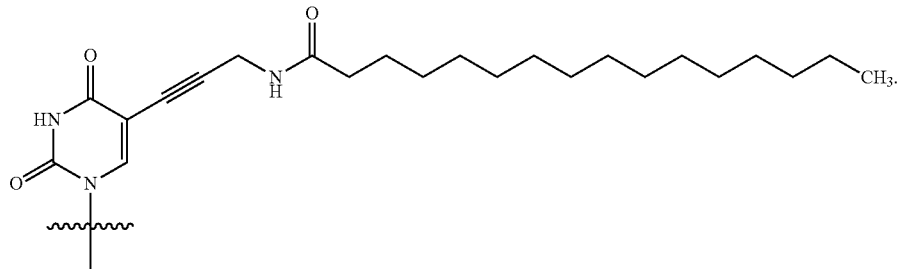 [SMILES: *n1cc(C#CCNC(=O)CCCCCCCCCCCCCCC)c(=O)[nH]c1=O]

In some embodiments, a provided oligonucleotide comprises

In some embodiments, a provided oligonucleotide comprises a carbohydrate moiety connected to the oligonucleotide moiety, option through a linker, at a nucleobase. In some embodiments, the nucleobase is T. In some embodiments, the nucleobase is protected T. In some embodiments, the nucleobase is optionally substituted T. In some embodiments, the connection is at the 5-carbon of a T or an optionally substituted T. In some embodiments, a provided oligonucleotide comprises one or more -L$^M$-(R$^{LD}$)a, wherein each variable is independently as described in the present disclosure. In some embodiments, a provided oligonucleotide comprises one or more -L$^M$-(R$^{LD}$)a, which is bonded to a nucleobase, wherein each variable is independently as described in the present disclosure. In some embodiments, a provided oligonucleotide comprises one or more

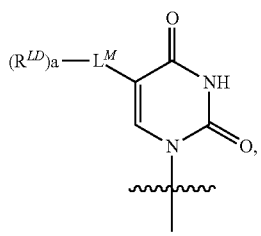

wherein each variable is independently as described in the present disclosure. In some embodiments, a provided oligonucleotide comprises one or more

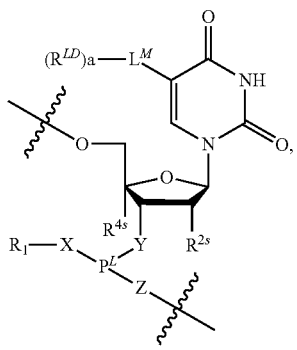

wherein each variable is independently as described in the present disclosure. In some embodiments, a provided oligonucleotide comprises one or more

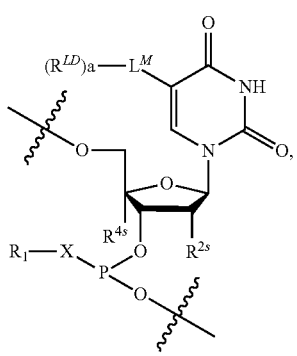

wherein each variable is independently as described in the present disclosure. In some embodiments, a provided oligonucleotide comprises one or more

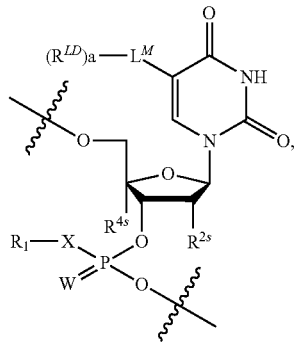

wherein each variable is independently as described in the present disclosure. In some embodiments, a provided oligonucleotide comprises one or more

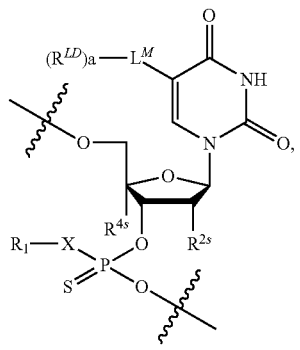

wherein each variable is independently as described in the present disclosure. In some embodiments, a provided oligonucleotide comprises one or more

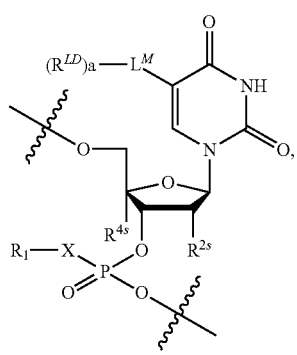

wherein each variable is independently as described in the present disclosure. In some embodiments, a provided oligonucleotide comprises one or more

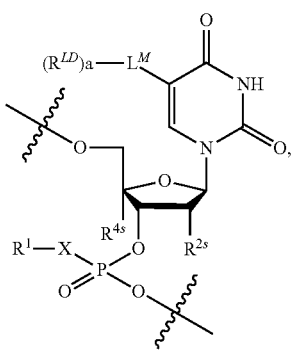

wherein X is O or S, R¹ is H, and each other variable is independently as described in the present disclosure. In some embodiments, $R^{2s}$ and $R^{4s}$ are hydrogen. In some embodiments, a provided oligonucleotide comprises one or more

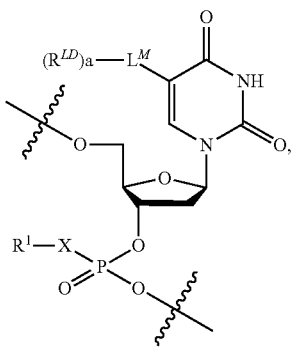

wherein X is O or S, R¹ is H, and each other variable is independently as described in the present disclosure.

In some embodiments, a is 1. In some embodiments, a provided oligonucleotide comprises one or more $-L^{M}-R^{CD}$, which is bonded to a nucleobase, wherein each variable is independently as described in the present disclosure. In some embodiments, the nucleobase is T. In some embodiments, the nucleobase is protected T. In some embodiments, the nucleobase is optionally substituted T. In some embodiments, the connection is at the 5-carbon of a T or an optionally substituted T. In some embodiments, a provided oligonucleotide comprises one or more

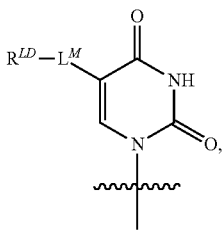

wherein each variable is independently as described in the present disclosure. In some embodiments, a provided oligonucleotide comprises one or more

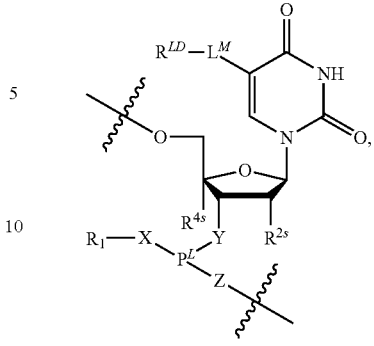

wherein each variable is independently as described in the present disclosure. In some embodiments, a provided oligonucleotide comprises one or more

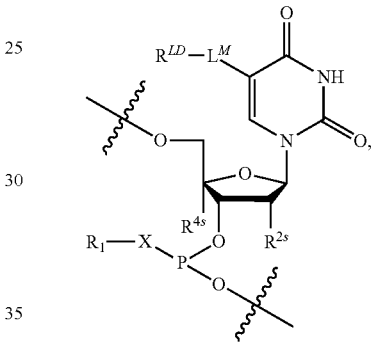

wherein each variable is independently as described in the present disclosure. In some embodiments, a provided oligonucleotide comprises one or more

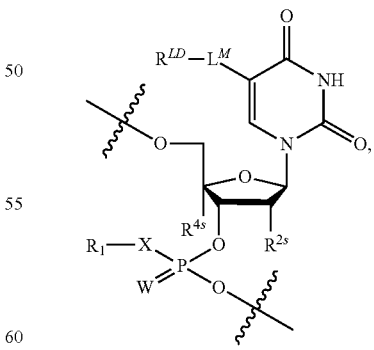

wherein each variable is independently as described in the present disclosure. In some embodiments, a provided oligonucleotide comprises one or more

621

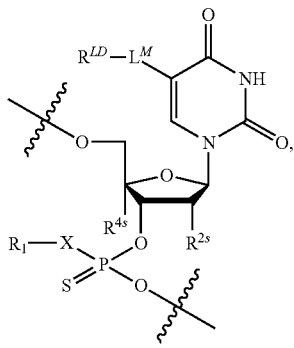

wherein each variable is independently as described in the present disclosure. In some embodiments, a provided oligonucleotide comprises one or more

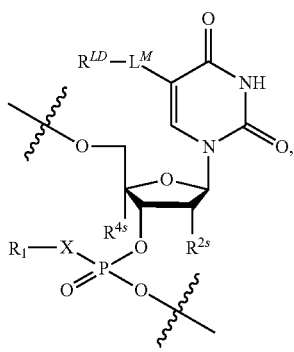

wherein each variable is independently as described in the present disclosure. In some embodiments, a provided oligonucleotide comprises one or more

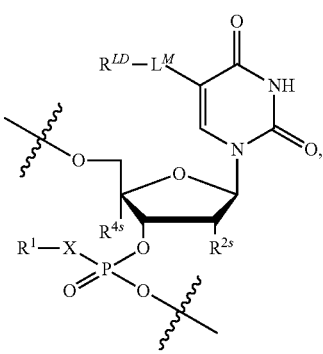

wherein X is O or S, $R^1$ is H, and each other variable is independently as described in the present disclosure. In some embodiments, $R^{2s}$ and $R^{4s}$ are hydrogen. In some embodiments, a provided oligonucleotide comprises one or more

622

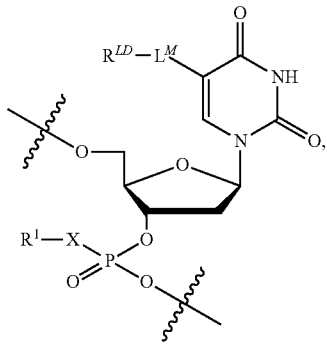

wherein X is O or S, $R^1$ is H, and each other variable is independently as described in the present disclosure.

In some embodiments, the present disclosure provides a composition comprising an oligonucleotide comprising a lipid moiety comprising or being a $C_{10}$-$C_{40}$ linear, saturated or partially unsaturated, aliphatic chain. In some embodiments, the present disclosure provides a composition comprising an oligonucleotide comprising a lipid moiety comprising or being a $C_{10}$-$C_{40}$ linear, saturated or partially unsaturated, aliphatic chain, optionally substituted with one or more $C_{1-4}$ aliphatic group.

In some embodiments, a composition comprises an oligonucleotide comprising a lipid moiety formed through conjugation of a compound selected from: lauric acid, myristic acid, palmitic acid, stearic acid, oleic acid, linoleic acid, alpha-linolenic acid, gamma-linolenic acid, docosahexaenoic acid (cis-DHA), turbinaric acid, arachidonic acid, and dilinoleyl alcohol In some embodiments, a linker is a moiety that connects two parts of a composition; as a non-limiting example, a linker physically connects an oligonucleotide to a lipid. Non-limiting examples of suitable linkers include: an uncharged linker; a charged linker; a linker comprising an alkyl; a linker comprising a phosphate; a branched linker; an unbranched linker; a linker comprising at least one cleavage group; a linker comprising at least one redox cleavage group; a linker comprising at least one phosphate-based cleavage group; a linker comprising at least one acid-cleavage group; a linker comprising at least one ester-based cleavage group; a linker comprising at least one peptide-based cleavage group. In some embodiments, a linker is an uncharged linker or a charged linker. In some embodiments, a linker comprises an alkyl.

In some embodiments, a linker comprises a phosphate. In various embodiments, a phosphate can also be modified by replacement of a bridging oxygen, (i.e. oxygen that links the phosphate to the nucleoside), with nitrogen (bridged phosphoroamidates), sulfur (bridged phosphorothioates) and carbon (bridged methylenephosphonates). The replacement can occur at the either linking oxygen or at both the linking oxygens. In some embodiments, the bridging oxygen is the 3'-oxygen of a nucleoside, replacement with carbon is done. In some embodiments, the bridging oxygen is the 5'-oxygen of a nucleoside, replacement with nitrogen is done. In various embodiments, the linker comprising a phosphate comprises any one or more of: a phosphorodithioate, phosphoramidate, boranophosphonate, or a compound of formula (I):

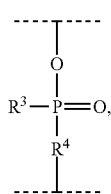

(I), where $R^3$ is selected from OH, SH, $NH_2$, $BH_3$, $CH_3$, $C_{1-6}$ alkyl, $C_{6-10}$ aryl, $C_{1-6}$ alkoxy and $C_{6-10}$ aryl-oxy, wherein $C_{1-6}$ alkyl and $C_{6-10}$ aryl are unsubstituted or optionally independently substituted with 1 to 3 groups independently selected from halo, hydroxyl and $NH_2$; and $R^4$ is selected from O, S, NH, or $CH_2$.

In some embodiments, a linker comprises a direct bond or an atom such as oxygen or sulfur, a unit such as $NR^1$, C(O), C(O)NH, SO, $SO_2$, $SO_2NH$ or a chain of atoms, such as substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, where one or more methylenes can be interrupted or terminated by O, S, S(O), $SO_2$, $N(R_1)_2$, C(O), cleavable linking group, substituted or unsubstituted aryl, substituted or unsubstituted heteroaryl, substituted or unsubstituted heterocyclic; where $R^1$ is hydrogen, acyl, aliphatic or substituted aliphatic.

In some embodiments, a linker is a branched linker. In some embodiments, a branchpoint of the branched linker may be at least trivalent, but may be a tetravalent, pentavalent or hexavalent atom, or a group presenting such multiple valencies. In some embodiments, a branchpoint is —N, —N(Q)-C, —O—C, —S—C, —SS—C, —C(O)N(Q)-C, —OC(O)N(Q)-C, —N(Q)C(O)—C, or —N(Q)C(O)O—C; wherein Q is independently for each occurrence H or optionally substituted alkyl. In other embodiment, the branchpoint is glycerol or glycerol derivative.

In one embodiment, a linker comprises at least one cleavable linking group. As a non-limiting example, a cleavable linking group can be sufficiently stable outside the cell, but which upon entry into a target cell is cleaved to release the two parts the linker is holding together. As a non-limiting example, a cleavable linkage group, such as a disulfide bond can be susceptible to pH. As a non-limiting example, a linker can include a cleavable linking group that is capable of being cleaved by an enzyme. As a non-limiting example, a linker can contain a peptide bond, which can be used when targeting cell types rich in peptidases, such as liver cells and synoviocytes. As a non-limiting example, suitability of a candidate cleavable linking group can be evaluated by testing the ability of a degradative agent (or condition) to cleave the candidate linking group. In some embodiments, a linker comprises a redox cleavable linking group, a phosphate-based cleavable linking groups, which are cleavable by agents that degrade or hydrolyze the phosphate group, a linker comprises an acid cleavable linking group, an ester-based linking group, and/or a peptide-based cleaving group.

In one embodiment, a linker comprises at least one cleavable linking group.

As a non-limiting example, a cleavable linking group can be sufficiently stable outside the cell, but which upon entry into a target cell is cleaved to release the two parts the linker is holding together. As a non-limiting example, a cleavable linking group is cleaved at least 10 times or more, at least 100 times faster in the target cell or under a first reference condition (which can, e.g., be selected to mimic or represent intracellular conditions) than in the blood of a subject, or under a second reference condition (which can, e.g., be selected to mimic or represent conditions found in the blood or serum). Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

As a non-limiting example, a cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a desired pH, thereby releasing the cationic lipid from the ligand inside the cell, or into the desired compartment of the cell.

As a non-limiting example, a linker can include a cleavable linking group, which is capable of being cleaved by an enzyme. The type of cleavable linking group incorporated into a linker can depend on the cell to be targeted. For example, liver targeting ligands can be linked to the cationic lipids through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

As a non-limiting example, a linker can contain a peptide bond, which can be used when targeting cell types rich in peptidases, such as liver cells and synoviocytes.

As a non-limiting example, suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. In some embodiments, initial evaluations can be carried out in cell-free or culture conditions and to confirm by further evaluations in whole animals. As a non-limiting example, useful candidate compounds are cleaved at least 2, 4, 10 or 100 times faster in the cell (or under in vitro conditions selected to mimic intracellular conditions) as compared to blood or serum (or under in vitro conditions selected to mimic extracellular conditions).

In some embodiments, a linker comprises a redox cleavable linking group. As a non-limiting example, one class of cleavable linking groups are redox cleavable linking groups that are cleaved upon reduction or oxidation. A non-limiting example of a reductively cleavable linking group is a disulphide linking group (—S—S—). To determine if a candidate cleavable linking group is a suitable "reductively cleavable linking group," or for example is suitable for use with a particular oligonucleotide moiety and particular targeting agent, one can look to methods described herein. As a non-limiting example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. As a non-limiting example, candidate compounds are cleaved by at most 10% in the blood. As a non-limiting example, useful candidate compounds are degraded at least 2, 4, 10 or 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

In some embodiments, a linker comprises a phosphate-based cleavable linking group, which is cleavable by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Additional non-limiting examples are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. An additional non-limiting example is —O—P(O)(OH)—O—. In various embodiments, Rk is any of: OH, SH, NH$_2$, BH$_3$, CH$_3$, C$_{1-6}$ alkyl, C$_{6-10}$ aryl, C$_{1-6}$ alkoxy and C$_{6-10}$ aryl-oxy, wherein C$_{1-6}$ alkyl and C$_{6-10}$ aryl are unsubstituted or optionally independently substituted with 1 to 3 groups independently selected from halo, hydroxyl and NH$_2$; and R$^4$ is selected from O, S, NH, and CH$_2$.

In some embodiments, a linker comprises an acid cleavable linking group, e.g., a linking group that is capable of being cleaved under acidic conditions. As a non-limiting example, acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). In an additional non-limiting example, when the carbon attached to the oxygen of the ester (the alkoxy group) is an aryl group, substituted alkyl group, or tertiary alkyl group such as dimethyl pentyl or t-butyl.

In some embodiments, a linker comprises an ester-based linking groups. As a non-limiting example, ester-based cleavable linking groups are cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

In some embodiments, a linker comprises a peptide-based cleaving group. Peptide-based cleavable linking groups are cleaved by enzymes such as peptidases and proteases in cells. Peptide-based cleavable linking groups are peptide bonds formed between amino acids to yield oligopeptides (e.g., dipeptides, tripeptides etc.) and polypeptides. As a non-limiting example, peptide-based cleavable groups do not include the amide group (—C(O)NH—). The amide group can be formed between any alkylene, alkenylene or alkynylene. A peptide bond is a special type of amide bond formed between amino acids to yield peptides and proteins. As a non-limiting example, a peptide based cleavage group can be limited to the peptide bond (i.e., the amide bond) formed between amino acids yielding peptides and proteins and does not include the entire amide functional group. As a non-limiting example, a peptide-based cleavable linking groups can have the general formula —NHCHR$^A$C(O)NHCHR$^B$C(O)—, where R$^A$ and R$^B$ are the R groups of the two adjacent amino acids. These candidates can be evaluated using methods analogous to those described above.

Any linker reported in the art can be used, including, as non-limiting examples, those described in: U.S. Pat. App. No. 20150265708.

In some embodiments, a lipid is conjugated to an oligonucleotide using any method known in the art in accordance with the present disclosure.

Targeting Moieties

In some embodiments, a provided oligonucleotide or oligonucleotide composition further comprises a targeting component or moiety. A targeting moiety can be either conjugated or not conjugated to an oligonucleotide moiety. In some embodiments, a targeting moiety is a lipid. In some embodiments, a targeting moiety is a carbohydrate or a bicyclic ketal. In some embodiments, a targeting moiety is —R$^{LD}$ as described in the present disclosure. In some embodiments, a targeting moiety is —R$^{CD}$ as described in the present disclosure.

Targeting moieties can be incorporated into provided technologies through many types of methods in accordance with the present disclosure, for example, those described for lipids and carbohydrates. In some embodiments, targeting moieties are physically mixed with provided oligonucleotides to form provided compositions. In some embodiments, a targeting moiety is conjugated to an oligonucleotide. In some embodiments, a targeting moiety is not conjugated to an oligonucleotide.

In some embodiments, provided compositions comprise two or more targeting moieties. In some embodiments, provided oligonucleotides comprise two or more conjugated targeting moieties. In some embodiments, the two or more conjugated targeting moieties are the same. In some embodiments, the two or more conjugated targeting moieties are different. In some embodiments, provided oligonucleotides comprise no more than one targeting moiety. In some embodiments, oligonucleotides of a provided composition comprise different types of conjugated targeting moieties. In some embodiments, oligonucleotides of a provided composition comprise the same type of targeting moieties.

Targeting moieties can be conjugated to oligonucleotides optionally through linkers, for example, as described for lipids and carbohydrates. Various types of linkers in the art can be utilized in accordance of the present disclosure. In some embodiments, a linker comprises a phosphate group, which can, for example, be used for conjugating targeting moieties through chemistry similar to those employed in oligonucleotide synthesis. In some embodiments, a linker comprises an amide, ester, or ether group. In some embodiments, a linker has the structure of -L-. Targeting moieties can be conjugated through either the same or different linkers compared to lipids.

Targeting moieties, optionally through linkers, can be conjugated to oligonucleotides at various suitable locations. In some embodiments, targeting moieties are conjugated through the 5'—OH group. In some embodiments, targeting moieties are conjugated through the 3'-OH group. In some embodiments, targeting moieties are conjugated through one or more sugar moieties. In some embodiments, targeting moieties are conjugated through one or more bases. In some embodiments, targeting moieties are incorporated through one or more internucleotidic linkages. In some embodiments, an oligonucleotide may contain multiple conjugated targeting moieties which are independently conjugated through its 5'-OH, 3'-OH, sugar moieties, base moieties and/or internucleotidic linkages. Targeting moieties and lipids can be conjugated either at the same, neighboring and/or separated locations. In some embodiments, a targeting moiety is conjugated at one end of an oligonucleotide, and a lipid is conjugated at the other end.

In some embodiments, a targeting moiety interacts with a protein on the surface of targeted cells. In some embodiments, such interaction facilitates internalization into targeted cells. In some embodiments, a targeting moiety comprises a sugar moiety. In some embodiments, a targeting moiety comprises a polypeptide moiety. In some embodiments, a targeting moiety comprises an antibody. In some embodiments, a targeting moiety is an antibody. In some embodiments, a targeting moiety comprises an inhibitor. In some embodiments, a targeting moiety is a moiety from a small molecule inhibitor. In some embodiments, an inhibitor is an inhibitor of a protein on the surface of targeted cells.

In some embodiments, an inhibitor is a carbonic anhydrase inhibitor. In some embodiments, an inhibitor is a carbonic anhydrase inhibitor expressed on the surface of target cells. In some embodiments, a carbonic anhydrase is I, II, III, IV, V, VI, VII, VIII, IX, X, XI, XII, XIII, XIV, XV or XVI. In some embodiments, a carbonic anhydrase is membrane bound. In some embodiments, a carbonic anhydrase is IV, IX, XII or XIV. In some embodiments, an inhibitor is for IV, IX, XII and/or XIV. In some embodiments, an inhibitor is a carbonic anhydrase III inhibitor. In some embodiments, an inhibitor is a carbonic anhydrase IV inhibitor. In some embodiments, an inhibitor is a carbonic anhydrase IX inhibitor. In some embodiments, an inhibitor is a carbonic anhydrase XII inhibitor. In some embodiments, an inhibitor is a carbonic anhydrase XIV inhibitor. In some embodiments, an inhibitor comprises or is a sulfonamide (e.g., those described in Supuran, CT. *Nature Rev Drug Discover* 2008, 7, 168-181, which sulfonamides are incorporated herein by reference). In some embodiments, an inhibitor is a sulfonamide. In some embodiments, targeted cells are muscle cells.

In some embodiments, a targeting moiety is $R^{TD}$, wherein $R^{TD}$ is $R^{LD}$ or $R^{CD}$ as described in the present disclosure.

In some embodiments, a targeting moiety is $R^{LD}$ as defined and described in the present disclosure. In some embodiments, the present disclosure provides oligonucleotides comprising $R^{LD}$. In some embodiments, the present disclosure provides oligonucleotide compositions comprising oligonucleotides comprising $R^{LD}$. In some embodiments, the present disclosure provides oligonucleotide compositions comprising a first plurality of oligonucleotides comprising $R^{LD}$. In some embodiments, the present disclosure provides chirally controlled oligonucleotide compositions of oligonucleotides comprising $R^{LD}$.

In some embodiments, a targeting moiety is $R^{CD}$ as defined and described in the present disclosure. In some embodiments, the present disclosure provides oligonucleotides comprising $R^{CD}$. In some embodiments, the present disclosure provides oligonucleotide compositions comprising oligonucleotides comprising $R^{CD}$. In some embodiments, the present disclosure provides oligonucleotide compositions comprising a first plurality of oligonucleotides comprising $R^{CD}$. In some embodiments, the present disclosure provides chirally controlled oligonucleotide compositions of oligonucleotides comprising $R^{CD}$.

In some embodiments, $R^{TD}$ comprises or is

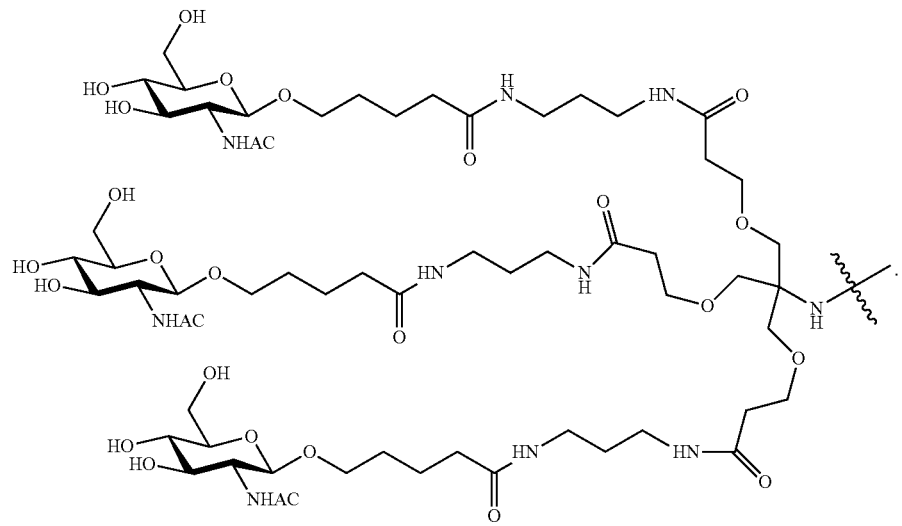

In some embodiments, $R^{TD}$ comprises or is
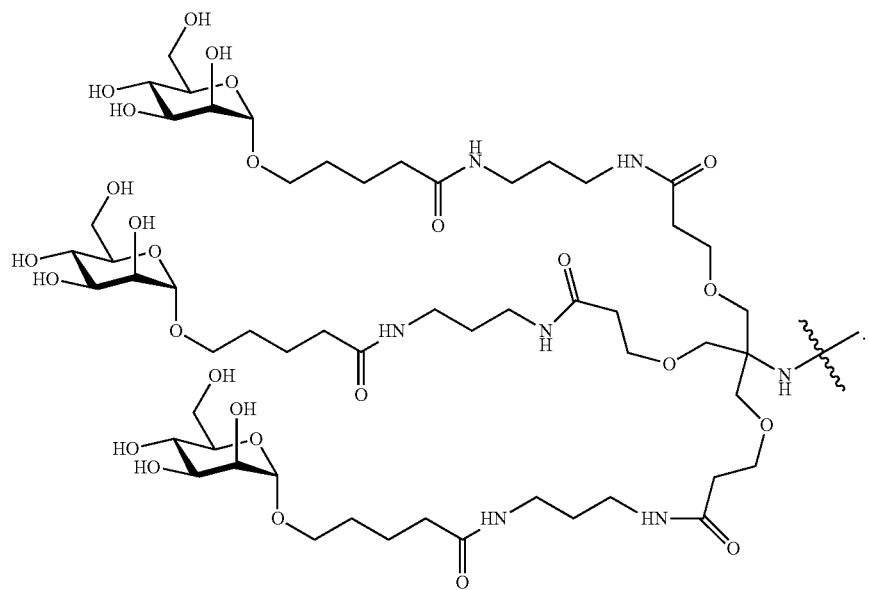
In some embodiments, $R^{TD}$ comprises or is
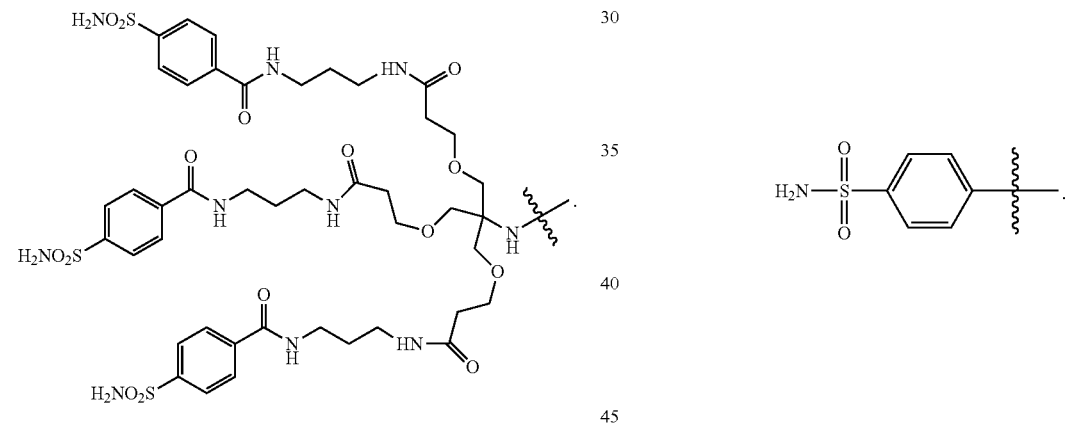
In some embodiments, $R^{TD}$ comprises or is
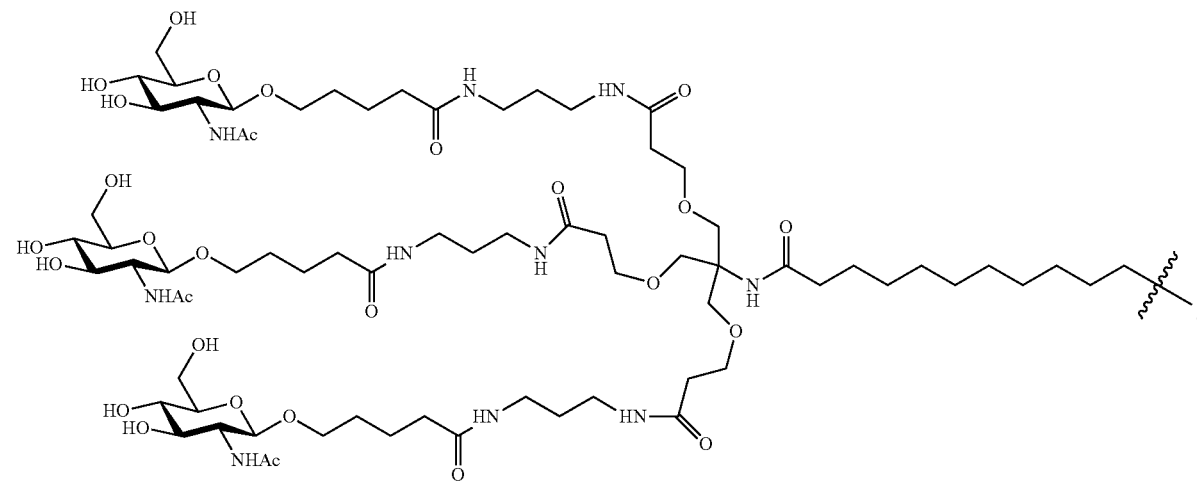
In some embodiments, $R^{TD}$ comprises or is In some embodiments, $R^{TD}$ comprises or is
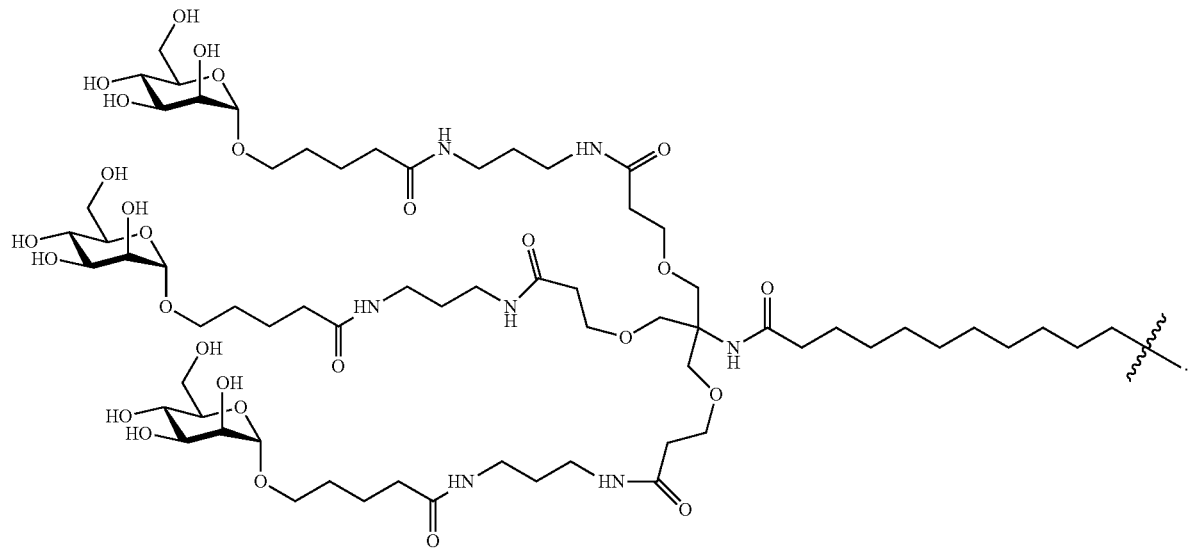
In some embodiments, $R^{TD}$ comprises or is
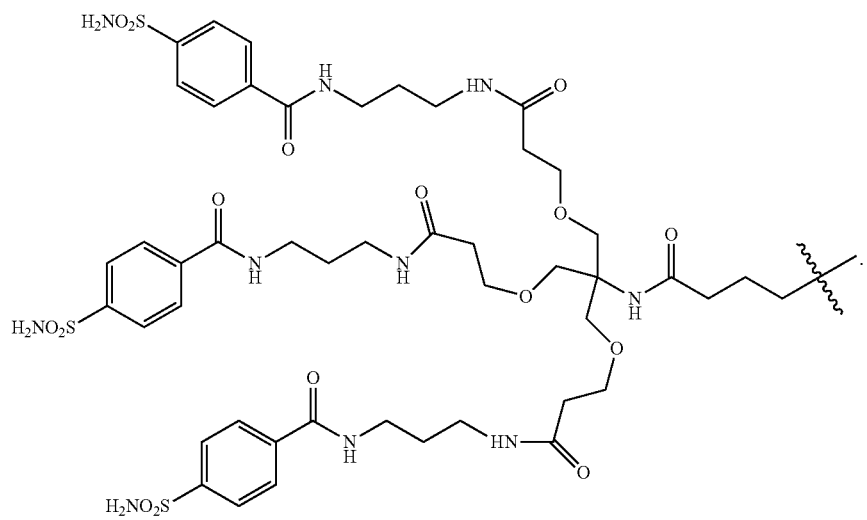 [SMILES: *CCCC(=O)NC(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]

In some embodiments, $R^{TD}$ comprises or is
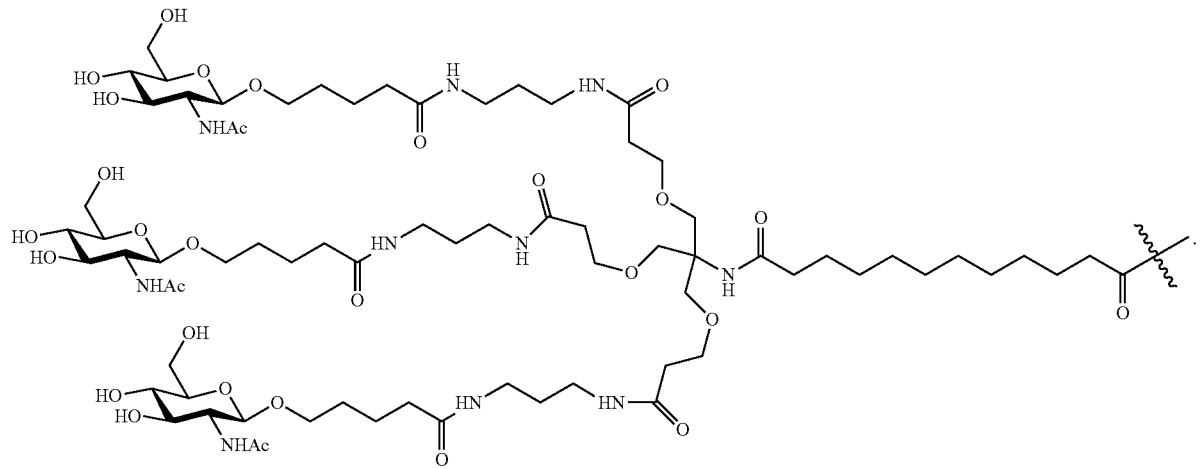
In some embodiments, $R^{TD}$ comprises or is
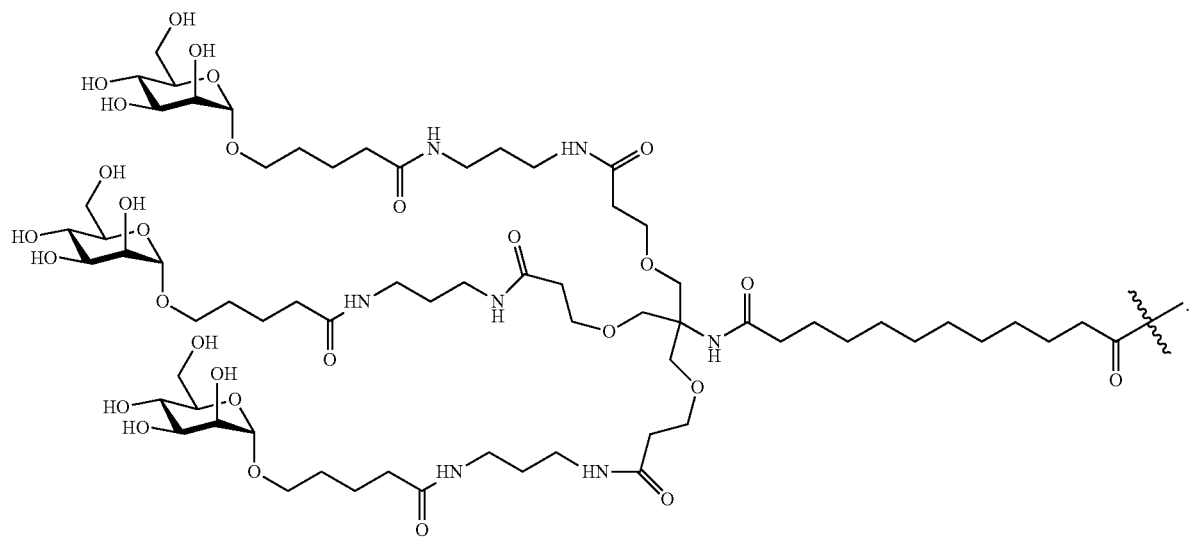

In some embodiments, $R^{TD}$ comprises or is
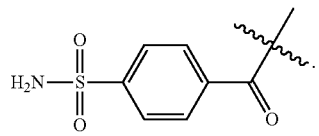 [SMILES: *C(=O)c1ccc(S(N)(=O)=O)cc1]
In some embodiments, $R^{TD}$ comprises or is
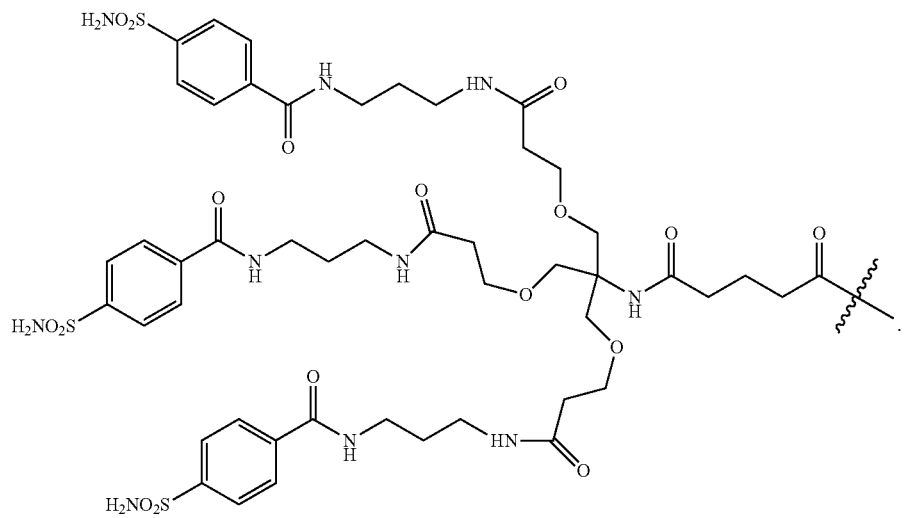 [SMILES: *C(=O)CCCC(=O)NC(COCCC(=O)NCCCNC(=O)c1ccc(S(N)(=O)=O)cc1)(COCCC(=O)NCCCNC(=O)c1ccc(S(N)(=O)=O)cc1)COCCC(=O)NCCCNC(=O)c1ccc(S(N)(=O)=O)cc1]
In some embodiments, $R^{TD}$ comprises or is
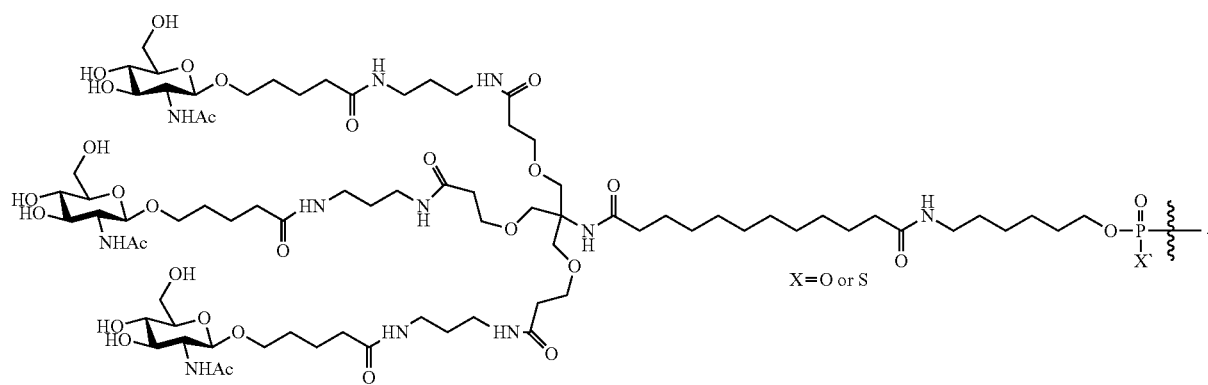

In some embodiments, $R^{TD}$ comprises or is

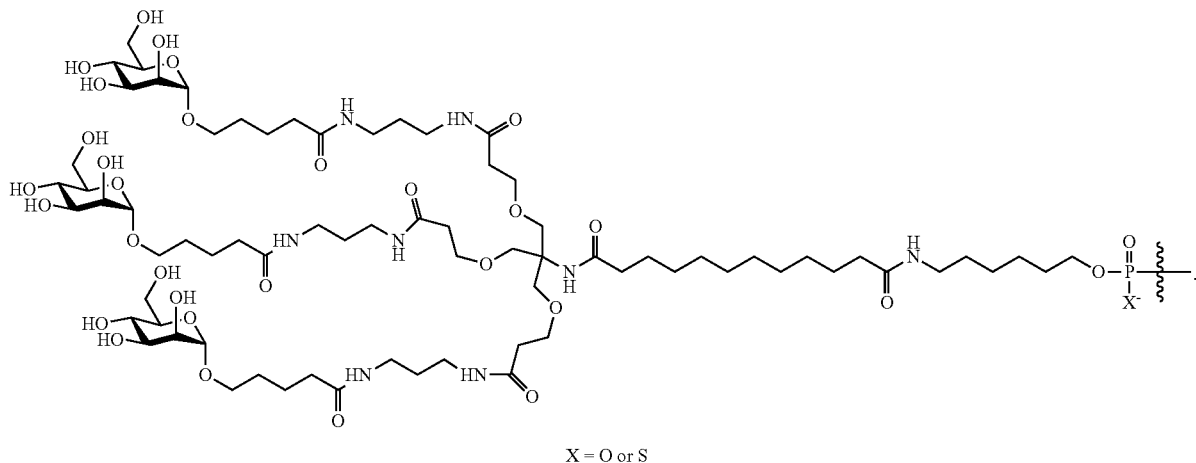

X = O or S

In some embodiments, $R^{TD}$ comprises or is

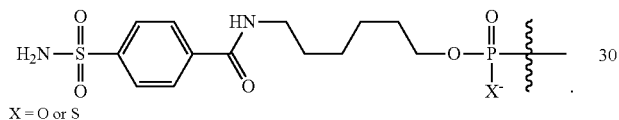

X = O or S

In some embodiments, $R^{TD}$ comprises or is

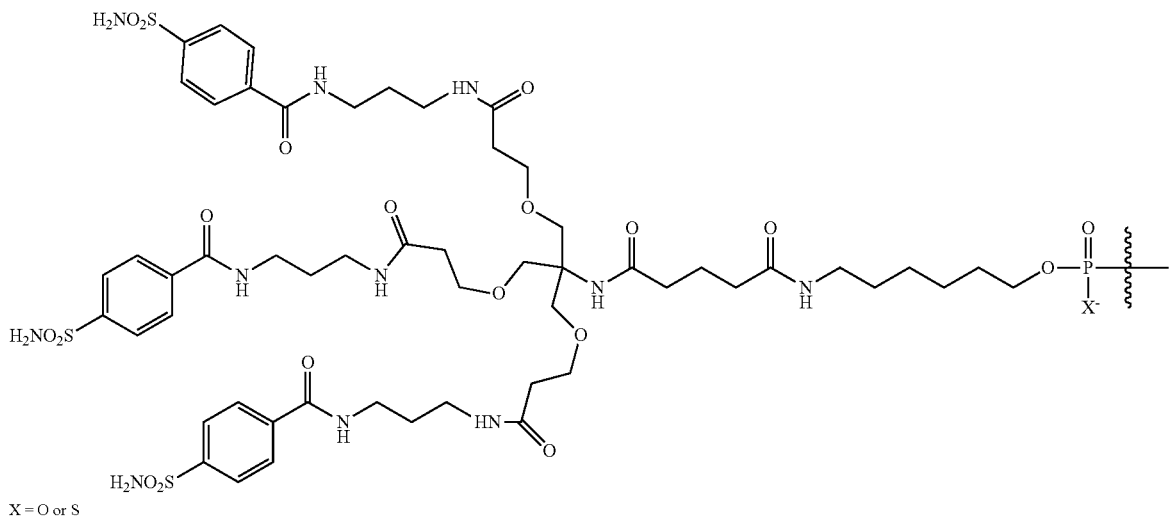

X = O or S

In some embodiments, $R^{TD}$ is a targeting moiety that comprises or is a lipid moiety. In some embodiments, X is O. In some embodiments, X is S.

In some embodiments, the present disclosure provides technologies (e.g., reagents, methods, etc.) for conjugating various moieties to oligonucleotide moieties. In some embodiments, the present disclosure provides technologies for conjugating targeting moiety to oligonucleotide moieties. In some embodiments, the present disclosure provides acids comprising targeting moieties for conjugation, e.g., $R^{LD}$—COOH. In some embodiments, the present disclosure provides linkers for conjugation, e.g., $L^M$. A person having ordinary skill in the art understands that many known and widely practiced technologies can be utilized for conjugation with oligonucleotide moieties in accordance with the present disclosure. In some embodiments, a provided acid is

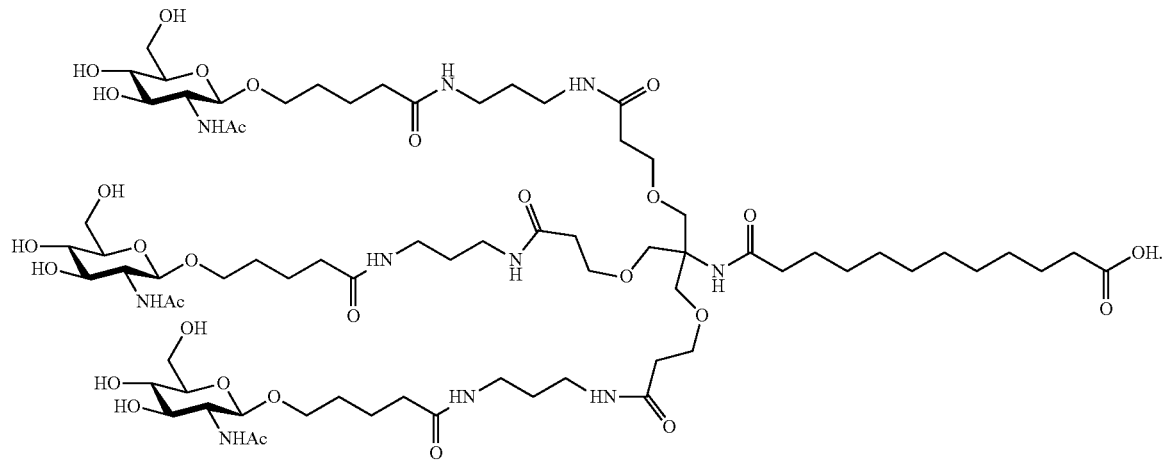
In some embodiments, a provided acid is
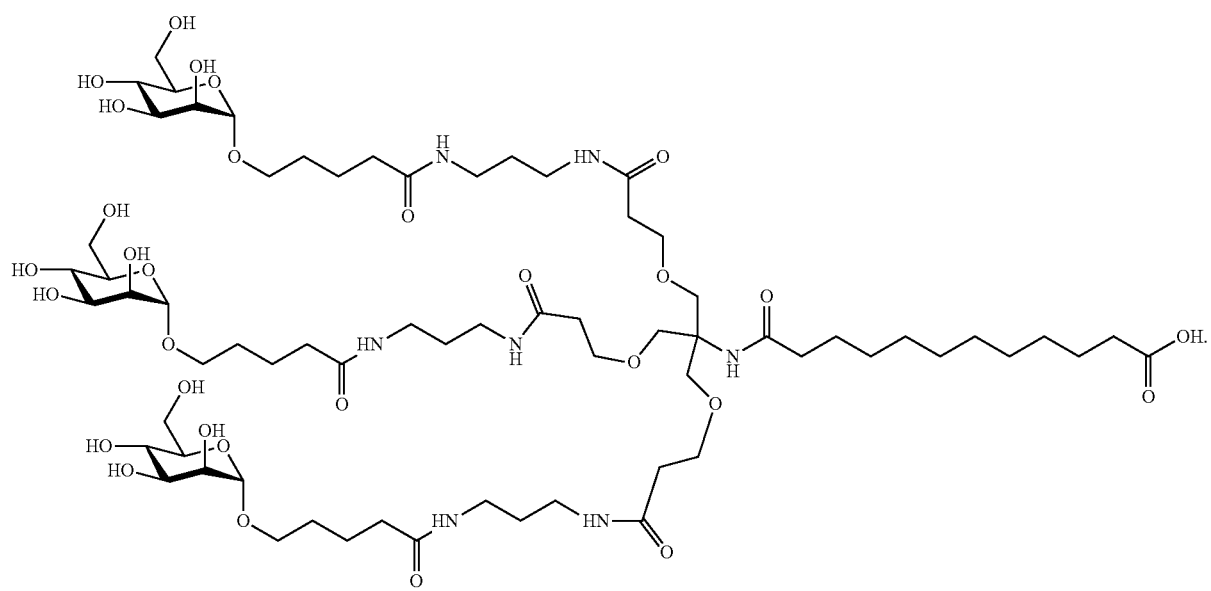

In some embodiments, a provided acid is

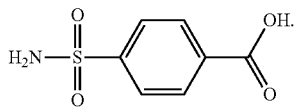    5

In some embodiments, a provided acid is

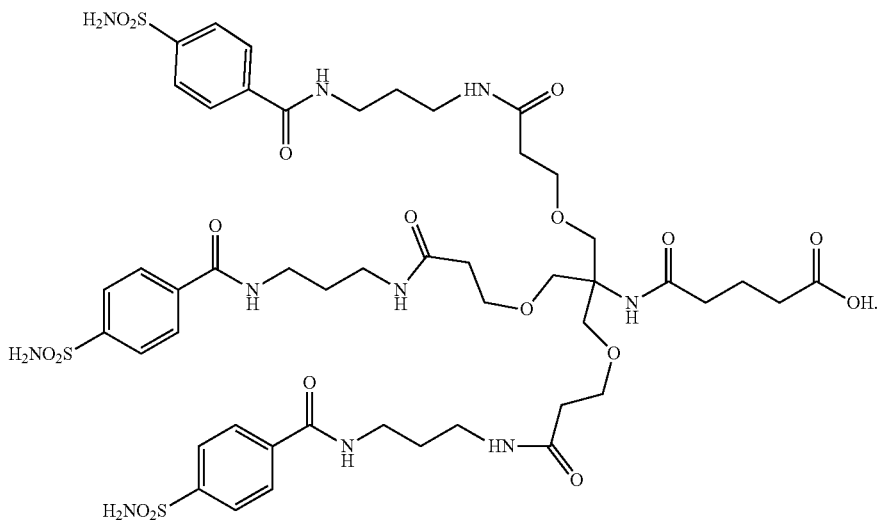 [SMILES: NS(=O)(=O)c1ccc(C(=O)NCCCNC(=O)CCOCC(COCCC(=O)NCCCNC(=O)c2ccc(S(N)(=O)=O)cc2)(COCCC(=O)NCCCNC(=O)c2ccc(S(N)(=O)=O)cc2)NC(=O)CCCC(=O)O)cc1]

In some embodiments, a provided acid is a fatty acid, which can provide a lipid moiety as a targeting moiety. In some embodiments, the present disclosure provides methods and reagents for preparing such acids.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any optional additional chemical moiety, including but not limited to, a targeting moiety, a lipid moiety, a carbohydrate moiety, a bicyclic ketal, a GalNAc moiety, etc., described herein or known in the art. In some embodiments, a lipid is any lipid, or variant, derivative or modification thereof, as described herein or known in the art. In some embodiments, a GalNAc moiety is any GalNAc, or variant, derivative or modification thereof, as described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any optional additional chemical moiety, including but not limited to, a targeting moiety, a lipid moiety, a carbohydrate moiety, a bicyclic ketal, a GalNAc moiety, etc., described herein or known in the art in combination with any other structural element or modification described herein, including but not limited to, base sequence or portion thereof, sugar, base; internucleotidic linkage; stereochemistry or pattern thereof; seed region; post-seed region; 5'-end structure; 5'-end region; 5' nucleotide moiety; 3'-end region; 3'-terminal dinucleotide; 3'-end cap length; GC content; pattern of modifications of sugars, bases or internucleotidic linkages; format or any structural element thereof, and/or any other structural element or modification described herein; and in some embodiments, the present disclosure pertains to multimers of any such oligonucleotides.

In some embodiments, an oligonucleotide, an oligonucleotide capable of directing a decrease in the expression and/or level of a target gene or its gene product can comprise any lipid described herein or known in the art.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any lipid described herein or known in the art.

In some embodiments, a provided oligonucleotide comprises a lipid moiety. In some embodiments, a lipid moiety is incorporated by conjugation with a lipid. In some embodiments, a lipid is a fatty acid. In some embodiments, an oligonucleotide is conjugated to a fatty acid. In some embodiments, a provided single-stranded RNAi agent comprises a lipid. In some embodiments, a provided single-stranded RNAi agent comprises a lipid conjugated to a nucleotide in the seed region. In some embodiments, a provided single-stranded RNAi agent comprises a lipid conjugated to a nucleotide in the post-seed region. In some embodiments, a provided single-stranded RNAi agent comprises a lipid conjugated at the $1^{st}$, $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, $18^{th}$, $19^{th}$, $20^{th}$, $21^{st}$, $22^{nd}$, $23^{rd}$, $24^{th}$, or $25^{th}$ nucleotide (counting from the 5'-end). In some embodiments, a provided single-stranded RNAi agent comprises a lipid conjugated at the $9^{th}$ or $11^{th}$ nucleotide (counting from the 5'-end). In some embodiments, an oligonucleotide is conjugated at the base to a fatty acid. In some embodiments, a provided single-stranded RNAi agent comprises a lipid. In some embodiments, a provided single-stranded RNAi agent comprises a lipid conjugated at the base at the $9^{th}$ or $11^{th}$ nucleotide (counting from the 5'-end).

In some embodiments, a fatty acid comprises 10, 11, 12, 13, 14, 15, 16, 17, 18, 19, 20, 21, 22, 23, 24, 25, 26, 27, 28, 29, 30 or more carbon atoms. In some embodiments, a fatty acid comprises 10 or more carbon atoms. In some embodiments, a fatty acid comprises 11 or more carbon atoms. In some embodiments, a fatty acid comprises 12 or more carbon atoms. In some embodiments, a fatty acid comprises 13 or more carbon atoms. In some embodiments, a fatty acid comprises 14 or more carbon atoms. In some embodiments, a fatty acid comprises 15 or more carbon atoms. In some embodiments, a fatty acid comprises 16 or more carbon atoms. In some embodiments, a fatty acid comprises 17 or more carbon atoms. In some embodiments, a fatty acid comprises 18 or more carbon atoms. In some embodiments, a fatty acid comprises 19 or more carbon atoms. In some embodiments, a fatty acid comprises 20 or more carbon atoms. In some embodiments, a fatty acid comprises 21 or more carbon atoms. In some embodiments, a fatty acid comprises 22 or more carbon atoms. In some embodiments, a fatty acid comprises 23 or more carbon atoms. In some embodiments, a fatty acid comprises 24 or more carbon atoms. In some embodiments, a fatty acid comprises 25 or more carbon atoms. In some embodiments, a fatty acid comprises 26 or more carbon atoms. In some embodiments, a fatty acid comprises 27 or more carbon atoms. In some embodiments, a fatty acid comprises 28 or more carbon atoms. In some embodiments, a fatty acid comprises 29 or more carbon atoms. In some embodiments, a fatty acid comprises 30 or more carbon atoms.

In some embodiments, a lipid is palmitic acid. In some embodiments, a lipid is stearic acid or turbinaric acid. In some embodiments, a lipid is stearic acid acid. In some embodiments, a lipid is turbinaric acid.

In some embodiments, a lipid comprises an optionally substituted, $C_{10}$-$C_{80}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein.

In some embodiments, a lipid comprises an optionally substituted $C_{10}$-$C_{60}$ saturated or partially unsaturated, aliphatic chain.

In some embodiments, a lipid comprises an optionally substituted $C_{10}$-$C_{60}$ linear, saturated or partially unsaturated, aliphatic chain.

In some embodiments, a lipid comprises a $C_{10}$-$C_{60}$ linear, saturated or partially unsaturated, aliphatic chain, optionally substituted with one or more $C_{1-4}$ aliphatic group.

In some embodiments, a lipid comprises an optionally substituted, $C_{10}$-$C_{60}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R')$_2$, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein.

In some embodiments, a lipid comprises an optionally substituted $C_{10}$-$C_{60}$ saturated or partially unsaturated, aliphatic chain.

In some embodiments, a lipid comprises an optionally substituted, $C_{10}$-$C_{40}$ saturated or partially unsaturated aliphatic group, wherein one or more methylene units are optionally and independently replaced by an optionally substituted group selected from $C_1$-$C_6$ alkylene, $C_1$-$C_6$ alkenylene, —C≡C—, a $C_1$-$C_6$ heteroaliphatic moiety, —C(R$_1$)$_2$, -Cy-, —O—, —S—, —S—S—, —N(R')—, —C(O)—, —C(S)—, —C(NR')—, —C(O)N(R')—, —N(R')C(O)N(R')—, —N(R')C(O)—, —N(R')C(O)O—, —OC(O)N(R')—, —S(O)—, —S(O)$_2$—, —S(O)$_2$N(R')—, —N(R')S(O)$_2$—, —SC(O)—, —C(O)S—, —OC(O)—, and —C(O)O—, wherein each variable is independently as defined and described herein.

In some embodiments, a lipid comprises an optionally substituted $C_{10}$-$C_{60}$ saturated or partially unsaturated, aliphatic chain.

In some embodiments, a lipid comprises an optionally substituted $C_{10}$-$C_{60}$ linear, saturated or partially unsaturated, aliphatic chain.

In some embodiments, a lipid comprises a $C_{10}$-$C_{60}$ linear, saturated or partially unsaturated, aliphatic chain, optionally substituted with one or more $C_{1-4}$ aliphatic group.

In some embodiments, a lipid comprises an unsubstituted $C_{10}$-$C_{80}$ linear, saturated or partially unsaturated, aliphatic chain.

In some embodiments, a lipid comprises no more than one optionally substituted $C_{10}$-$C_{60}$ linear, saturated or partially unsaturated, aliphatic chain.

In some embodiments, a lipid comprises two or more optionally substituted $C_{10}$-$C_{60}$ linear, saturated or partially unsaturated, aliphatic chain.

In some embodiments, a lipid comprises an unsubstituted $C_{10}$-$C_{60}$ linear, saturated or partially unsaturated, aliphatic chain.

In some embodiments, a lipid comprises no more than one optionally substituted $C_{10}$-$C_{60}$ linear, saturated or partially unsaturated, aliphatic chain.

In some embodiments, a lipid comprises two or more optionally substituted $C_{10}$-$C_{60}$ linear, saturated or partially unsaturated, aliphatic chain.

In some embodiments, a lipid comprises an unsubstituted $C_{10}$-$C_{40}$ linear, saturated or partially unsaturated, aliphatic chain.

In some embodiments, a lipid comprises no more than one optionally substituted $C_{10}$-$C_{60}$ linear, saturated or partially unsaturated, aliphatic chain.

In some embodiments, a lipid comprises two or more optionally substituted $C_{10}$-$C_{60}$ linear, saturated or partially unsaturated, aliphatic chain.

In some embodiments, a lipid comprises a $C_{10}$-$C_{40}$ linear, saturated or partially unsaturated, aliphatic chain.

In some embodiments, a lipid comprises a $C_{10}$-$C_{30}$ linear, saturated or partially unsaturated, aliphatic chain.

In some embodiments, a lipid comprises a $C_{10}$-$C_{20}$ linear, saturated or partially unsaturated, aliphatic chain.

In some embodiments, a lipid comprises a $C_{10}$-$C_{16}$ linear, saturated or partially unsaturated, aliphatic chain.

In some embodiments, a lipid comprises a $C_{12}$-$C_{16}$ linear, saturated or partially unsaturated, aliphatic chain.

In some embodiments, a lipid comprises a $C_{14}$-$C_{16}$ linear, saturated or partially unsaturated, aliphatic chain.

In some embodiments, a lipid comprises a $C_{10}$-$C_{40}$ linear, saturated or partially unsaturated, aliphatic chain, optionally substituted with one or more $C_{1-4}$ aliphatic group.

In some embodiments, a lipid is selected from the group consisting of: lauric acid, myristic acid, palmitic acid, stearic acid, oleic acid, linoleic acid, alpha-linolenic acid, gamma-linolenic acid, docosahexaenoic acid (DHA or cis-DHA), turbinaric acid and dilinoleyl.

In some embodiments, a lipid is not conjugated to the oligonucleotide.

In some embodiments, a lipid is conjugated to the oligonucleotide.

In some embodiments, a lipid is conjugated to the oligonucleotide with a linker. In some embodiments, a linker has the structure of -L-.

In some embodiments, a targeting moiety is conjugated to an oligonucleotide. In some embodiments, a provided oligonucleotide comprises one or more targeting moieties. In some embodiments, a targeting moiety is conjugated via a linker.

In some embodiments, a provided oligonucleotide comprises one or more lipid moieties, and one or more targeting moieties.

In some embodiments, a provided single-stranded RNAi agent comprises a lipid. In some embodiments, a provided single-stranded RNAi agent comprises a lipid moiety, wherein the lipid is $C_{16}$ linear. In some embodiments, a provided single-stranded RNAi agent comprises a lipid, wherein the lipid is palmitic acid.

In some embodiments, a provided single-stranded RNAi agent comprises a lipid conjugated to a base. In some embodiments, a provided single-stranded RNAi agent comprises a lipid, wherein the lipid is $C_{16}$ linear conjugated to a base. In some embodiments, a provided single-stranded RNAi agent comprises a lipid, wherein the lipid is palmitic acid conjugated to a base.

In some embodiments, the present disclosure pertains to a chirally controlled oligonucleotide composition, wherein the composition further comprises a lipid. In some embodiments, a lipid is stearic acid or turbinaric acid. In some embodiments, a lipid is conjugated to the oligonucleotide.

In some embodiments, conjugation of a lipid to an oligonucleotide improves at least one property of the oligonucleotide. In some embodiments, the property is increased activity (e.g., increased ability to mediate single-stranded RNA interference), or improved distribution to a tissue. In some embodiments, lipid conjugation improves activity. In some embodiments, lipid conjugation improves deliveries to one or more target tissues. In some embodiments, the tissue is muscle tissue. In some embodiments, the tissue is skeletal muscle, gastrocnemius, triceps, heart or diaphragm.

In some embodiments, a provided oligonucleotide is no more than 25 bases long. In some embodiments, a provided oligonucleotide is no more than 30 bases long. In some embodiments, a provided oligonucleotide is no more than 35 bases long. In some embodiments, a provided oligonucleotide is no more than 40 bases long. In some embodiments, a provided oligonucleotide is no more than 45 bases long. In some embodiments, a provided oligonucleotide is no more than 50 bases long. In some embodiments, a provided oligonucleotide is no more than 55 bases long. In some embodiments, a provided oligonucleotide is no more than 60 bases long. In some embodiments, a U is replaced with T, or vice versa.

In some embodiments, a lipid comprises an optionally substituted, $C_{10}$-$C_{80}$ saturated or partially unsaturated aliphatic group, wherein one or more methylene units are optionally and independently replaced by an optionally substituted group selected from $C_1$-$C_6$ alkylene, $C_1$-$C_6$ alkenylene, a $C_1$-$C_6$ heteroaliphatic moiety, —C(R)$_2$—, -Cy-, —O—, —S—, —S—S—, —N(R)—, —C(O)—, —C(S)—, —C(NR)—, —C(O)N(R)—, —N(R)C(O)N(R), —N(R)C(O)—, —N(R)C(O)O—, —OC(O)N(R)—, —S(O)—, —S(O)$_2$—, —S(O)$_2$N(R)—, —N(R)S(O)$_2$—, —SC(O)—, —C(O)S—, —OC(O)—, and —C(O)O—, wherein each variable is independently as defined and described herein. In some embodiments, a lipid comprises an optionally substituted C10-C60 saturated or partially unsaturated, aliphatic chain. In some embodiments, a lipid comprises an optionally substituted C10-C60 linear, saturated or partially unsaturated, aliphatic chain. In some embodiments, a lipid comprises a C10-C60 linear, saturated or partially unsaturated, aliphatic chain, optionally substituted with one or more C1-4 aliphatic group. In some embodiments, a lipid comprises an optionally substituted, C10-C60 saturated or partially unsaturated aliphatic group, wherein one or more methylene units are optionally and independently replaced by an optionally substituted group selected from C1-C6 alkylene, C1-C6 alkenylene, a C1-C6 heteroaliphatic moiety, —C(R)$_2$—, -Cy-, —O—, —S—, —S—S—, —N(R)—, —C(O)—, —C(S)—, —C(NR)—, —C(O)N(R)—, —N(R)C(O)N(R), —N(R)C(O)—, —N(R)C(O)O—, —OC(O)N(R)—, —S(O)—, —S(O)$_2$—, —S(O)$_2$N(R)—, —N(R)S(O)$_2$—, —SC(O)—, —C(O)S—, —OC(O)—, and —C(O)O—, wherein each variable is independently as defined and described herein. In some embodiments, a lipid comprises an optionally substituted C10-C60 saturated or partially unsaturated, aliphatic chain. In some embodiments, a lipid comprises an optionally substituted C10-C60 linear, saturated or partially unsaturated, aliphatic chain. In some embodiments, a lipid comprises a C10-C60 linear, saturated or partially unsaturated, aliphatic chain, optionally substituted with one or more C1-4 aliphatic group. In some embodiments, a lipid comprises an optionally substituted, C10-C40 saturated or partially unsaturated aliphatic group, wherein one or more methylene units are optionally and independently replaced by an optionally substituted group selected from C1-C6 alkylene, C1-C6 alkenylene, a C1-C6 heteroaliphatic moiety, —C(R)$_2$—, -Cy-, —O—, —S—, —S—S—, —N(R)—, —C(O)—, —C(S)—, —C(NR)—, —C(O)N(R)—, —N(R)C(O)N(R), —N(R)C(O)—, —N(R)C(O)O—, —OC(O)N(R)—, —S(O)—, —S(O)$_2$—, —S(O)$_2$N(R)—, —N(R)S(O)$_2$—, —SC(O)—, —C(O)S—, —OC(O)—, and —C(O)O—, wherein each variable is independently as defined and described herein. In some embodiments, a lipid comprises an optionally substituted C10-C60 saturated or partially unsaturated, aliphatic chain. In some embodiments, a lipid comprises an optionally substituted C10-C60 linear, saturated or partially unsaturated, aliphatic chain. In some embodiments, a lipid comprises a C10-C60 linear, saturated or partially unsaturated, aliphatic chain, optionally substituted with one or more C1-4 aliphatic group. In some embodiments, a lipid comprises an unsubstituted C10-C80 linear, saturated or partially unsaturated, aliphatic chain. In some embodiments, a lipid comprises no more than one optionally substituted C10-C60 linear, saturated or partially unsaturated, aliphatic chain. In some embodiments, a lipid comprises two or more optionally substituted C10-C60 linear, saturated or partially unsaturated, aliphatic chain. In some embodiments, a lipid comprises an unsubstituted C10-C60 linear, saturated or partially unsaturated, aliphatic chain. In some embodiments, a lipid comprises no more than one optionally substituted C10-C60 linear, saturated or partially unsaturated, aliphatic chain. In some embodiments, a lipid comprises two or more optionally substituted C10-C60 linear, saturated or partially unsaturated, aliphatic chain. In some embodiments, a lipid comprises an unsubstituted C10-C40 linear, saturated or partially unsaturated, aliphatic chain. In some embodiments, a lipid comprises no more than one optionally substituted C10-C60 linear, saturated or partially unsaturated, aliphatic chain. In some embodiments, a lipid comprises two or more optionally substituted C10-C60 linear, saturated or partially unsaturated, aliphatic chain. In some embodiments, a lipid comprises a C10-C40 linear, saturated or partially unsaturated, aliphatic chain. In some embodiments, a lipid comprises a C10-C40 linear, saturated or partially unsaturated, aliphatic chain, optionally substituted with one or more C1-4 aliphatic group. In some embodiments, the lipid is selected from the group consisting of: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl. In some embodiments, the lipid is not conjugated to the oligonucleotide. In some embodiments, the lipid is conjugated to the oligonucleotide.

In some embodiments, conjugation of a lipid to an oligonucleotide surprisingly improves at least one property of the oligonucleotide. In some embodiments, the property is increased activity (e.g., increased ability to mediate single-stranded RNA interference), or improved distribution to a tissue. In some embodiments, the tissue is muscle tissue. In some embodiments, the tissue is skeletal muscle, gastrocnemius, triceps, heart or diaphragm. In some embodiments, oligonucleotides comprising lipid moieties form, for example, micelles. In some embodiments, example improved properties are demonstrated, e.g., in one or more of the Figures.

In some embodiments, when assaying example oligonucleotides in mice, tested oligonucleotides are intravenous injected via tail vein in male C57BL/10ScSnDMDmdx mice (4-5 weeks old), at tested amounts, e.g., 10 mg/kg, 30 mg/kg, etc. In some embodiments, tissues are harvested at tested times, e.g., on Day, e.g., 2, 7 and/or 14, etc., after injection, in some embodiments, fresh-frozen in liquid nitrogen and stored in −80° C. until analysis.

Various assays can be used to assess oligonucleotide levels in accordance with the present disclosure. In some embodiments, hybrid-ELISA is used to quantify oligonucleotide levels in tissues using test article serial dilution as standard curve: for example, in an example procedure, maleic anhydride activated 96 well plate (Pierce 15110) was coated with 50 1 of capture probe at 500 nM in 2.5% NaHCO$_3$ (Gibco, 25080-094) for 2 hours at 37° C. The plate was then washed 3 times with PBST (PBS+0.1% Tween-20), and blocked with 5% fat free milk-PBST at 37° C. for 1 hour. Test article oligonucleotide was serial diluted into matrix. This standard together with original samples were diluted with lysis buffer (4 M Guanidine; 0.33% N-Lauryl Sarcosine; 25 mM Sodium Citrate; 10 mM DTT) so that oligonucleotide amount in all samples is less than 100 ng/ml. 20 1 of diluted samples were mixed with 180 1 of 333 nM detection probe diluted in PBST, then denatured in PCR machine (65° C., 10 min, 95° C., 15 min, 4° C.). 50 1 of denatured samples were distributed in blocked ELISA plate in triplicates, and incubated overnight at 4° C. After 3 washes of PBST, 1:2000 streptavidin-AP in PBST was added, 50 1 per well and incubated at room temperature for 1 hour. After extensive wash with PBST, 100 1 of AttoPhos (Promega S1000) was added, incubated at room temperature in dark for 10 min and read on plate reader (Molecular Device, M5) fluorescence channel. Ex435 nm, Em555 nm. Oligonucleotides in samples were calculated according to standard curve by 4-parameter regression.

As described and demonstrated in the present disclosure, in some embodiments, lipid conjugation improves delivery to a tissue. In some embodiments, lipid conjugation improves delivery to muscle. In some embodiments, lipid conjugation comprises conjugation with a fatty acid. In some embodiments, oligonucleotides are conjugated with turbinaric acid. In some embodiments, conjugation with turbinaric acid is particularly effective in improving oligonucleotide delivery to muscle.

In some embodiments, provided oligonucleotides are stable in both plasma and tissue homogenates.

In some embodiments, a provided single-stranded RNAi agent comprises a lipid conjugated at position 9 or 11 (counting from the 5'-end). In some embodiments, a provided single-stranded RNAi agent comprises a lipid, wherein the lipid is $C_{16}$ linear conjugated at position 9 or 11 (counting from the 5'-end). In some embodiments, a provided single-stranded RNAi agent comprises a lipid, wherein the lipid is palmitic acid conjugated at position 9 or 11 (counting from the 5'-end).

In some embodiments, a provided single-stranded RNAi agent comprises a lipid conjugated to a base at position 9 or 11 (counting from the 5'-end). In some embodiments, a provided single-stranded RNAi agent comprises a lipid, wherein the lipid is $C_{16}$ linear conjugated to a base at position 9 or 11 (counting from the 5'-end). In some embodiments, a provided single-stranded RNAi agent comprises a lipid, wherein the lipid is palmitic acid conjugated to a base at position 9 or 11 (counting from the 5'-end).

In some embodiments, a provided single-stranded RNAi agent comprises a lipid conjugated to a U base at position 9 or 11 (counting from the 5'-end). In some embodiments, a provided single-stranded RNAi agent comprises a lipid, wherein the lipid is $C_{16}$ linear conjugated to a U base at position 9 or 11 (counting from the 5'-end). In some embodiments, a provided single-stranded RNAi agent comprises a lipid, wherein the lipid is palmitic acid conjugated to a U base at position 9 or 11 (counting from the 5'-end).

In some embodiments, a provided single-stranded RNAi comprises a structure of ImU, or 5'-lipid-2' OMeU.

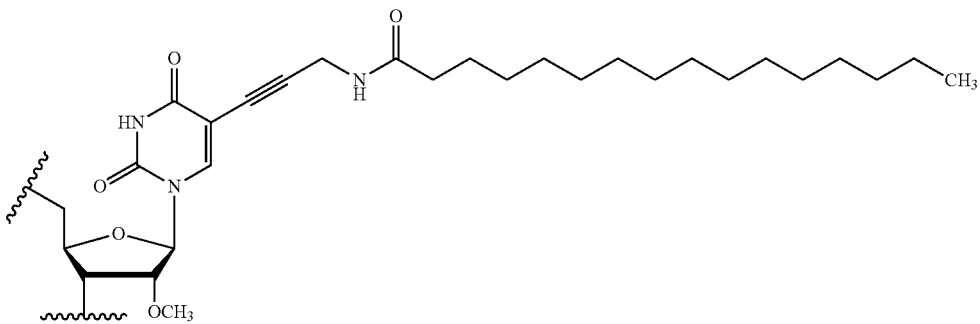

Non-limiting examples of such single-stranded RNAi agents include: WV-7302, WV-7303, WV-7304, and WV-7305. Table 88.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any additional chemical moiety, including but not limited to, a lipid, described in any of U.S. Pat. Nos. 5,614,503; 5,780,009; 6,074,863; 6,258,581; 6,489,117; 6,677,445; 6,828,435; 6,846,921; 7,416,849; 7,494,982; 7,981,871; 8,106,022; 8,148,344; 8,318,508; 8,389,707; 8,450,467; 8,507,455; 8,703,731; 8,828,956; 8,901,046; 9,107,904; 9,352,048; 9,370,581; 9,370,582; 9,387,257; 9,388,415; 9,388,416; 9,393,316; and 9,404,112.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any lipid described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any lipid described herein or known in the art in combination with any other structural element or modification described herein, including but not limited to, base sequence or portion thereof, sugar, base; internucleotidic linkage; stereochemistry or pattern thereof; additional chemical moiety, including but not limited to, a targeting moiety, a GalNAc moiety, etc.; seed region; post-seed region; 5'-end structure; 5'-end region; 5' nucleotide moiety; 3'-end region; 3'-terminal dinucleotide; 3'-end cap; length; GC content; pattern of modifications of sugars, bases or internucleotidic linkages; format or any structural element thereof, and/or any other structural element or modification described herein; and in some embodiments, the present disclosure pertains to multimers of any such oligonucleotides.

Optional Additional Chemical Moieties Conjugated to an Oligonucleotide: A Carbohydrate Moiety or a Bicyclic Ketal, Including but not Limited to, a GalNAc Moiety In some embodiments, provided oligonucleotides or oligonucleotide compositions comprise one or more carbohydrates or carbohydrate moieties or bicyclic ketal moieties. In some embodiments, a carbohydrate moiety is a carbohydrate. In some embodiments, a carbohydrate moiety is or comprises a carbohydrate which is conjugated directly or indirectly to an oligonucleotide. In some embodiments, carbohydrate moieties facilitate targeted delivery of oligonucleotides to desired locations, e.g., cells, tissues, organs, etc. In some embodiments, provided carbohydrate moieties facilitate delivery to liver. As appreciated by a personal having ordinary skill in the art, various carbohydrate moieties are described in the literature and can be utilized in accordance with the present disclosure.

Carbohydrate moieties can be incorporated into oligonucleotides at various locations, for example, sugar units, internucleotidic linkage units, nucleobase units, etc., optionally through one or more bivalent or multivalent (which can be used to connect two or more carbohydrate moieties to oligonucleotides) linkers. In some embodiments, the present disclosure provides technologies for carbohydrate incorporation into oligonucleotides. In some embodiments, the present disclosure provides technologies for incorporating carbohydrate moieties, optionally through one or more linkers, at nucleobase units, as alternative and/or addition to incorporation at internucleotidic linkages and/or sugar units, thereby providing enormous flexibility and/or improved properties and/or activities. In some embodiments, a provided oligonucleotide comprises at least one carbohydrate moiety, optionally through a linker, incorporated into the oligonucleotide at a nucleobase unit.

In some embodiments, a linker is $L^M$, wherein $L^M$ is a covalent bond, or a bivalent or multivalent, optionally substituted, linear or branched group selected from a $C_{1-100}$ aliphatic group and a $C_{1-100}$ heteroaliphatic group having 1-30 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with Cy. In some embodiments, $L^M$ is bivalent. In some embodiments, $L^M$ is multivalent. In some embodiments, $L^M$ is

651  652
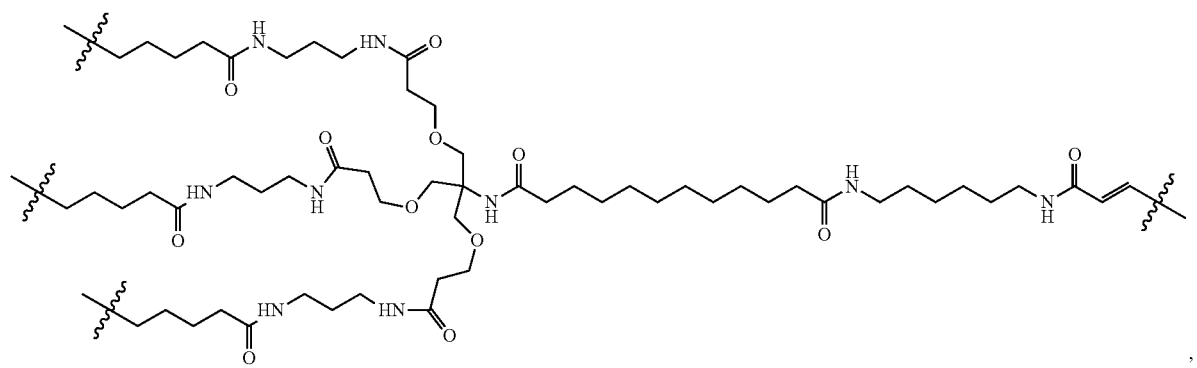
wherein $L^M$ is directly bond to a nucleobase, for example, as in:

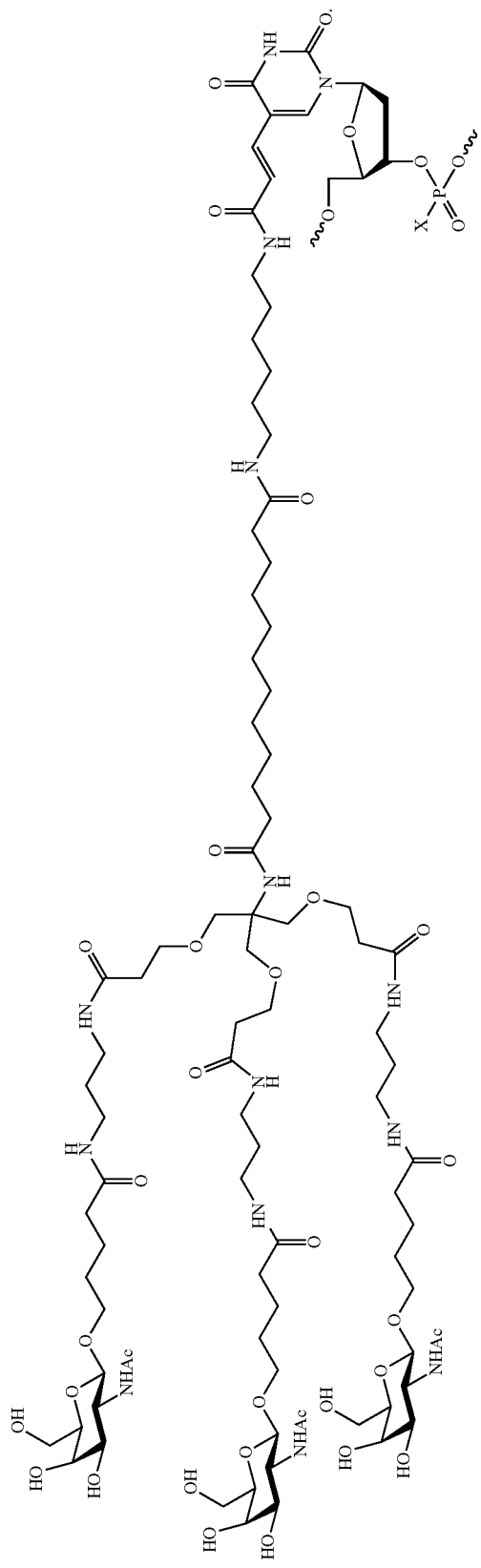
X = S or O-

In some embodiments, $L^M$ is
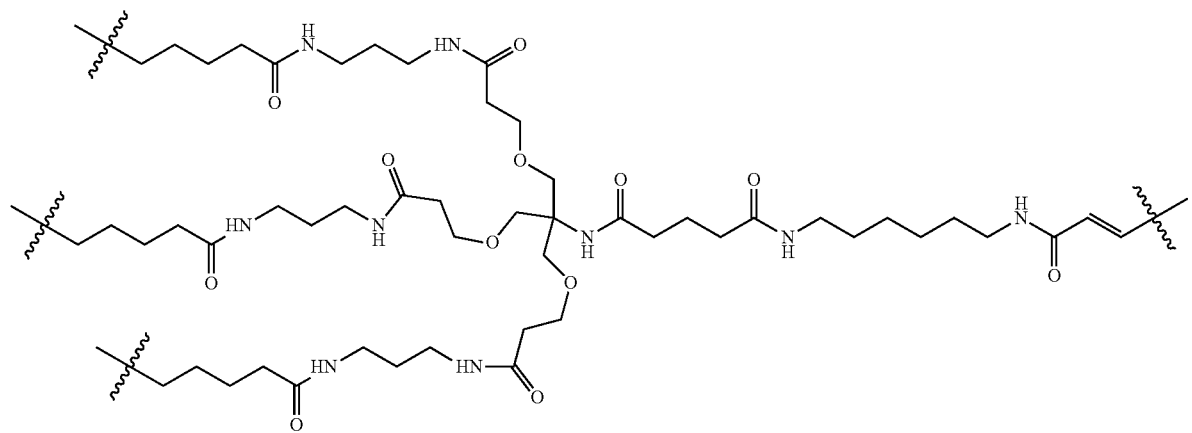 [SMILES: */C=C/C(=O)NCCCCCCNC(=O)CCCC(=O)NC(COCCC(=O)NCCCNC(=O)CCCC*)(COCCC(=O)NCCCNC(=O)CCCC*)COCCC(=O)NCCCNC(=O)CCCC*]
In some embodiments, $L^M$ is
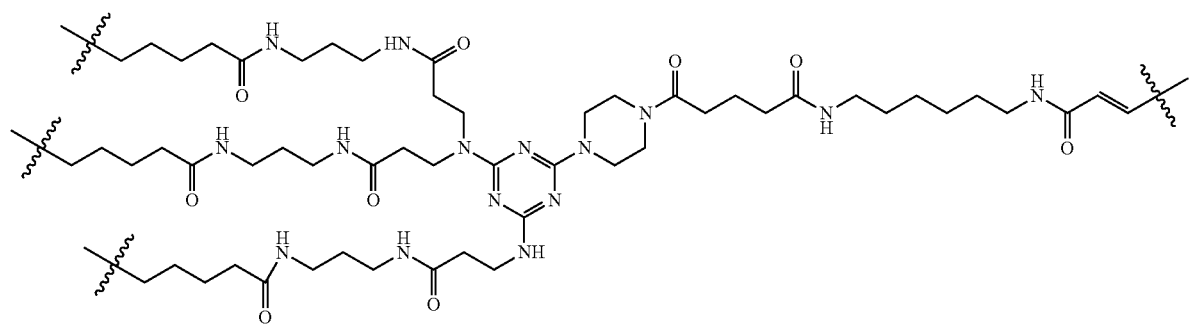 [SMILES: */C=C/C(=O)NCCCCCCNC(=O)CCCC(=O)N1CCN(c2nc(NCCC(=O)NCCCNC(=O)CCCC*)nc(N(CCC(=O)NCCCNC(=O)CCCC*)CCC(=O)NCCCNC(=O)CCCC*)n2)CC1]
In some embodiments, $L^M$ is
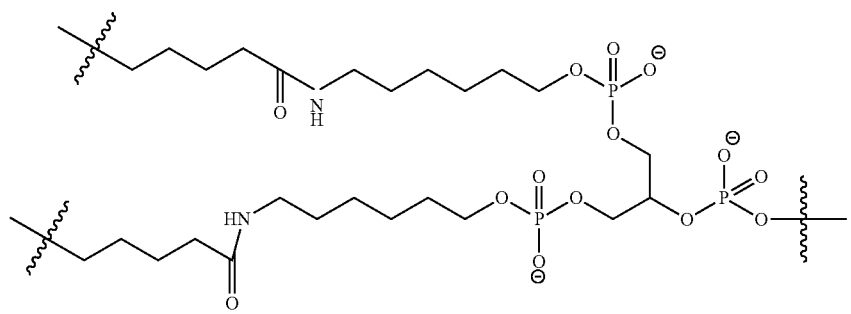 [SMILES: *CCCCC(=O)NCCCCCCOP(=O)([O-])OCC(COP(=O)([O-])OCCCCCCNC(=O)CCCC*)OP(=O)([O-])O*]

In some embodiments, $L^M$ is

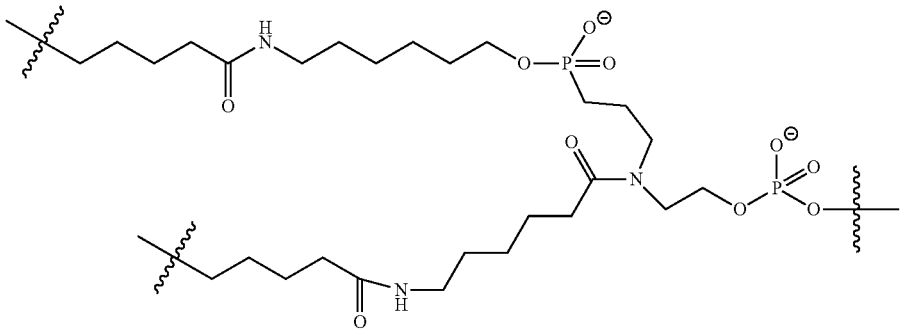 [SMILES: *CCCCC(=O)NCCCCCCOP(=O)([O-])CCCN(CCOP(=O)([O-])O*)C(=O)CCCCCNC(=O)CCCC*]

In some embodiments, a carbohydrate moiety or bicyclic ketal or bicyclic ketal moiety is $R^{CD}$, wherein $R^{CD}$ is an optionally substituted, linear or branched group selected from a $C_{1-100}$ aliphatic group and a $C_{1-100}$ heteroaliphatic group having 1-30 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with $Cy^L$. In some embodiments, $R^{CD}$ is an optionally substituted, linear or branched group selected from a $C_{1-100}$ aliphatic group and a $C_{1-100}$ heteroaliphatic group having 1-30 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are independently replaced with a tetravalent monosaccharide, disaccharide or polysaccharide moiety. In some embodiments, $R^{CD}$ is an optionally substituted, linear or branched group selected from a $C_{1-100}$ aliphatic group and a $C_{1-100}$ heteroaliphatic group having 1-30 heteroatoms independently selected from oxygen, nitrogen, sulfur, phosphorus, boron and silicon, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are independently replaced with a tetravalent GalNac moiety, or a tetravalent moiety of a GalNac derivative.

In some embodiments, $R^{CD}$ is optionally substituted

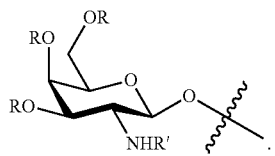

In some embodiments, R' is —C(O)R. In some embodiments, $R^{CD}$ is a monosaccharide moiety. In some embodiments, $R^{CD}$ is a monovalent GalNac moiety. In some embodiments, $R^{CD}$ is

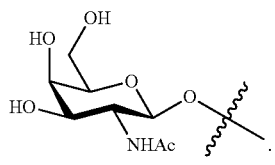

In some embodiments, $R^{CD}$ is optionally substituted

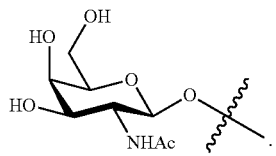

In some embodiments, $R^{CD}$ is optionally substituted

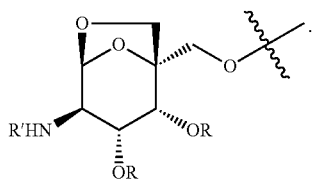

In some embodiments, R' is —C(O)R. In some embodiments, $R^{CD}$ is optionally substituted

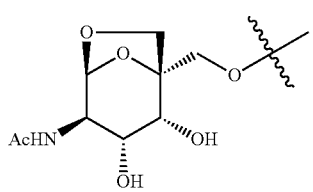

In some embodiments, $R^{CD}$ is a disaccharide moiety. In some embodiments, $R^{CD}$ is a polysaccharide moiety.

In some embodiments, $R^{CD}$ has the structure of $R^G$-L-, wherein $R^G$ is —H, or an optionally substituted group selected from $C_3$-$C_{20}$ cycloaliphatic, and 3-20 membered heterocyclyl having 1-10 heteroatoms independently selected from oxygen, nitrogen, sulfur, phosphorus, boron and silicon. In some embodiments, $R^{CD}$ has the structure of $R^G$-L-, wherein $R^G$ is an optionally substituted group selected from $C_3$-$C_{20}$ cycloaliphatic, and 3-20 membered heterocyclyl having 1-10 heteroatoms independently selected from oxygen, nitrogen, sulfur, phosphorus, boron and silicon. In some embodiments, $R^{CD}$ has the structure of $R^G$-L-, wherein $R^G$ is an optionally substituted group selected from $C_3$-$C_{20}$ cycloaliphatic, and 3-20 membered heterocyclyl having 1-10 heteroatoms independently selected from oxygen, nitrogen, sulfur, phosphorus, boron and silicon, wherein at least one heteroatom is oxygen. In some embodiments, $R^G$ is substituted, and at least one substitute of each $R^G$ is bonded to $R^G$ through an oxygen atom. In some embodiments, $R^G$ is substituted, and at least one substitute of each $R^G$ is bonded to $R^G$ through a nitrogen atom. In some embodiments, $R^G$ is independently substituted, and each carbon atom of each $R^G$ is independently bonded to a substituent through an oxygen or nitrogen atom. In some embodiments, $R^G$ is independently substituted, and each carbon atom of each $R^G$ is independently bonded to a substituent through an oxygen or nitrogen atom. In some embodiments, $R^G$ is optionally substituted 3-20 membered heterocyclyl having 1-10 oxygen atoms. In some embodiments, $R^G$ is optionally substituted 3-6 membered heterocyclyl having one oxygen atom. In some embodiments, each $R^G$ is independently optionally substituted 3-20 membered heterocyclyl having 1-10 oxygen atoms. In some embodiments, $R^G$ is independently optionally substituted 3-6 membered heterocyclyl having one oxygen atom. In some embodiments, each carbon of the heterocyclyl ring of $R^G$ is independently boned to an oxygen or nitrogen atom. In some embodiments, two or more carbon atoms of the heterocyclyl ring of $R^G$ are independently boned to an oxygen or nitrogen atom. In some embodiments, two or more carbon atoms of the heterocyclyl ring of $R^G$ are independently boned to an oxygen or nitrogen atom. In some embodiments, three or more carbon atoms of the heterocyclyl ring of $R^G$ are independently boned to an oxygen or nitrogen atom. In some embodiments, four or more carbon atoms of the heterocyclyl ring of $R^G$ are independently boned to an oxygen or nitrogen atom. In some embodiments, five or more carbon atoms of the heterocyclyl ring of $R^G$ are independently boned to an oxygen or nitrogen atom. In some embodiments, two or more carbon atoms of the heterocyclyl ring of $R^G$ are independently boned to an oxygen atom. In some embodiments, three or more carbon atoms of the heterocyclyl ring of $R^G$ are independently boned to an oxygen atom. In some embodiments, four or more carbon atoms of the heterocyclyl ring of $R^G$ are independently boned to an oxygen atom. In some embodiments, five or more carbon atoms of the heterocyclyl ring of $R^G$ are independently boned to an oxygen atom. In some embodiments, $R^G$—H is $C_{3-20}$ polyol comprising a —CHO or —C(O)— group.

In some embodiments, $R^{CD}$ has the structure of $R^G$-L-, wherein $R^G$ is —H, or a substituted group selected from $C_3$-$C_{20}$ cycloaliphatic, and 3-20 membered heterocyclyl having 1-10 heteroatoms independently selected from oxygen, nitrogen, sulfur, phosphorus, boron and silicon, wherein 1-20 of the substituents are R groups. In some embodiments, $R^{CD}$ has the structure of $R^G$-L-, wherein $R^G$ is —H, or a substituted group selected from $C_3$-$C_{20}$ cycloaliphatic, and 3-20 membered heterocyclyl having 1-10 heteroatoms independently selected from oxygen, nitrogen, sulfur, phosphorus, boron and silicon, wherein 1-20 of the substituents are —OR or —N(R)$_2$ groups. In some embodiments, $R^{CD}$ has the structure of $R^G$-L-, wherein $R^G$ is —H, or a substituted group selected from $C_3$-$C_{20}$ cycloaliphatic, and 3-20 membered heterocyclyl having 1-10 heteroatoms independently selected from oxygen, nitrogen, sulfur, phosphorus, boron and silicon, wherein 1-20 of the substituents are —OH and —N(R)$_2$. In some embodiments, $R^{CD}$ has the structure of $R^G$-L-, wherein $R^G$ is —H, or a substituted group selected from $C_3$-$C_{20}$ cycloaliphatic, and 3-20 membered heterocyclyl having 1-10 heteroatoms independently selected from oxygen, nitrogen, sulfur, phosphorus, boron and silicon, wherein 1-20 of the substituents are —OH and —NHR. In some embodiments, $R^{CD}$ has the structure of $R^G$-L-, wherein $R^G$ is —H, or a substituted group selected from $C_3$-$C_{20}$ cycloaliphatic, and 3-20 membered heterocyclyl having 1-10 heteroatoms independently selected from oxygen, nitrogen, sulfur, phosphorus, boron and silicon, wherein 1-20 of the substituents are —OH and —NHC(O)R.

In some embodiments, $R^G$ is substituted 3-20 membered heterocyclyl having 1-10 heteroatoms independently selected from oxygen, nitrogen, sulfur, phosphorus, boron and silicon. In some embodiments, $R^G$ is substituted 3-20 membered heterocyclyl having 1-10 heteroatoms independently selected from oxygen and nitrogen. In some embodiments, $R^G$ is substituted 3-20 membered heterocyclyl having 1-10 oxygen. In some embodiments, $R^G$ is substituted

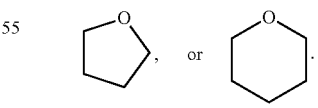

In some embodiments, $R^G$ is substituted

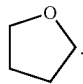

In some embodiments, $R^G$ is substituted

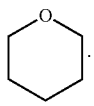

In some embodiments, $R^G$ is

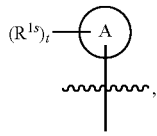

wherein each variable is independently as described in the present disclosure. In some embodiments, t is 1, 2, 3, 4, 5, 6, 7, 8, 9, or 10. In some embodiments, t is at least 1, 2, 3, 4, 5, 6, 7, 8, 9, or 10. In some embodiments, t is at least 1. In some embodiments, t is at least 2. In some embodiments, t is at least 3. In some embodiments, t is at least 4. In some embodiments, t is at least 5. In some embodiments, t is at least 6. In some embodiments, each $R^{1s}$ is independently —OR' or —N(R')$_2$. In some embodiments, each R' is independently —C(O)R. In some embodiments, each $R^{1s}$ is independently —OR' or —NHR'. In some embodiments, each $R^{1s}$ is independently —OH or —NHR'. In some embodiments, each $R^{1s}$ is independently —OH or —NHC(O)R. In some embodiments, Ring A is optionally substituted

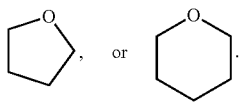 [SMILES: C1CCOC1 ; C1CCOCC1]

In some embodiments, Ring A is optionally substituted

In some embodiments, Ring A is optionally substituted

In some embodiments, $R^G$ is

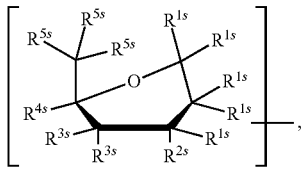

wherein each variable is independently as described in the present disclosure (i.e., $R^G$—H is

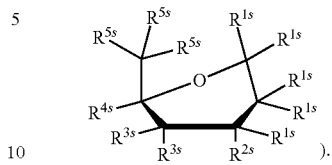

).

In some embodiments, at least 1, 2, 3, 4, 5, or 6 of $R^{1s}$, $R^{2s}$, $R^{3s}$, $R^{4s}$ and $R^{5s}$ are independently —OR' or —N(R')$_2$. In some embodiments, at least 1, 2, 3, 4, 5, or 6 of $R^{1s}$, $R^{2s}$, $R^{3s}$, $R^{4s}$ and $R^{5s}$ are independently —OR' or —NHR'. In some embodiments, at least 1, 2, 3, 4, 5, or 6 of $R^{1s}$, $R^{2s}$, $R^{3s}$, $R^{4s}$ and $R^{5s}$ are independently —OH or —NHR'. In some embodiments, at least 1, 2, 3, 4, 5, or 6 of $R^{1s}$, $R^{2s}$, $R^{3s}$, $R^{4s}$ and $R^{5s}$ are independently —OH or —NHC(O)R. In some embodiments, at least 1, 2, 3, 4, 5, or 6 of $R^{1s}$, $R^{2s}$, $R^{3s}$, $R^{4s}$ and $R^{5s}$ are —OH.

In some embodiments, each ring carbon atom of the cycloaliphatic or heterocyclic ring of $R^G$ is independently substituted. In some embodiments, no more than 1, 2, 3, 4, 5, 6, 7, 8, 9, or 10 ring carbon atoms of the cycloaliphatic or heterocyclic ring of $R^G$ are not substituted. In some embodiments, no more than 1 ring carbon atom is not substituted. In some embodiments, no more than 2 ring carbon atoms are not substituted. In some embodiments, no more than 3 ring carbon atoms are not substituted. In some embodiments, no more than 4 ring carbon atoms are not substituted. In some embodiments, no more than 5 ring carbon atoms are not substituted. In some embodiments, no more than 6 ring carbon atoms are not substituted. In some embodiments, no more than 7 ring carbon atoms are not substituted. In some embodiments, no more than 8 ring carbon atoms are not substituted. In some embodiments, no more than 9 ring carbon atoms are not substituted. In some embodiments, no more than 10 ring carbon atoms are not substituted. In some embodiments, no more than 1, 2, 3, 4, 5, 6, 7, 8, 9, or 10 ring carbon atoms of the cycloaliphatic or heterocyclic ring of $R^G$ are not substituted with —OH or —N(R')$_2$. In some embodiments, no more than 1 ring carbon atom is not substituted with —OH or —N(R')$_2$. In some embodiments, no more than 2 ring carbon atoms are not substituted with —OH or —N(R')$_2$. In some embodiments, no more than 3 ring carbon atoms are not substituted with —OH or —N(R')$_2$. In some embodiments, no more than 4 ring carbon atoms are not substituted with —OH or —N(R')$_2$. In some embodiments, no more than 5 ring carbon atoms are not substituted with —OH or —N(R')$_2$. In some embodiments, no more than 6 ring carbon atoms are not substituted with —OH or —N(R')$_2$. In some embodiments, no more than 7 ring carbon atoms are not substituted with —OH or —N(R')$_2$. In some embodiments, no more than 8 ring carbon atoms are not substituted with —OH or —N(R')$_2$. In some embodiments, no more than 9 ring carbon atoms are not substituted with —OH or —N(R')$_2$. In some embodiments, no more than 10 ring carbon atoms are not substituted with —OH or —N(R')$_2$. In some embodiments, no more than 1, 2, 3, 4, 5, 6, 7, 8, 9, or 10 ring carbon atoms of the cycloaliphatic or heterocyclic ring of $R^G$ are not substituted with —OH. In some embodiments, no more than 1 ring carbon atom is not substituted with —OH. In some embodiments, no more than 2 ring carbon atoms are not substituted with —OH. In some embodiments, no more than 3 ring carbon atoms are not substituted with —OH. In some embodiments, no more than 4 ring carbon atoms are not substituted with —OH. In some embodiments, no more than 5 ring carbon atoms are not substituted with —OH. In some embodiments, no more than 6 ring carbon atoms are not substituted with —OH. In some embodiments, no more than 7 ring carbon atoms are not substituted with —OH. In some embodiments, no more than 8 ring carbon atoms are not substituted with —OH. In some embodiments, no more than 9 ring carbon atoms are not substituted with —OH. In some embodiments, no more than 10 ring carbon atoms are not substituted with —OH. In some embodiments, at least 10%, 20%, 30%, 40%, 50%, 60%, 70%, 80%, 90%, or 95% percent of the ring carbon atoms of the cycloaliphatic or heterocyclic ring of $R^G$ are substituted with —OH or —N(R')$_2$. In some embodiments, no more than 10% the ring carbon atoms are not substituted with —OH or —N(R')$_2$. In some embodiments, no more than 20% the ring carbon atoms are not substituted with —OH or —N(R')$_2$. In some embodiments, no more than 30% of the ring carbon atoms are not substituted with —OH or —N(R')$_2$. In some embodiments, no more than 40% of the ring carbon atoms are not substituted with —OH or —N(R')$_2$. In some embodiments, no more than 50% of the ring carbon atoms are not substituted with —OH or —N(R')$_2$. In some embodiments, no more than 60% of the ring carbon atoms are not substituted with —OH or —N(R')$_2$. In some embodiments, no more than 70% of the ring carbon atoms are not substituted with —OH or —N(R')$_2$. In some embodiments, no more than 80% of the ring carbon atoms are not substituted with —OH or —N(R')$_2$. In some embodiments, no more than 90% of the ring carbon atoms are not substituted with —OH or —N(R')$_2$. In some embodiments, no more than 95% of the ring carbon atoms are not substituted with —OH or —N(R')$_2$. In some embodiments, no more than 10%, 20%, 30%, 40%, 50%, 60%, 70%, 80%, 90%, or 95% of the ring carbon atoms of the cycloaliphatic or heterocyclic ring of $R^G$ are not substituted with —OH. In some embodiments, no more than 10% of the ring carbon atoms are not substituted with —OH. In some embodiments, no more than 20% of the ring carbon atoms are not substituted with —OH. In some embodiments, no more than 30% of the ring carbon atoms are not substituted with —OH. In some embodiments, no more than 40% of the ring carbon atoms are not substituted with —OH. In some embodiments, no more than 50% of the ring carbon atoms are not substituted with —OH. In some embodiments, no more than 60% of the ring carbon atoms are not substituted with —OH. In some embodiments, no more than 70% of the ring carbon atoms are not substituted with —OH. In some embodiments, no more than 80% of the ring carbon atoms are not substituted with —OH. In some embodiments, no more than 90% of the ring carbon atoms are not substituted with —OH. In some embodiments, no more than 95% of the ring carbon atoms are not substituted with —OH. In some embodiments, each ring carbon atom of the cycloaliphatic or heterocyclic ring of $R^G$ is independently substituted. In some embodiments, at least 1, 2, 3, 4, 5, 6, 7, 8, 9, or 10 ring carbon atoms of the cycloaliphatic or heterocyclic ring of $R^G$ are substituted. In some embodiments, at least 1 ring carbon atom is substituted. In some embodiments, at least 2 ring carbon atoms are substituted. In some embodiments, at least 3 ring carbon atoms are substituted. In some embodiments, at least 4 ring carbon atoms are substituted. In some embodiments, at least 5 ring carbon atoms are substituted. In some embodiments, at least 6 ring carbon atoms are substituted. In some embodiments, at least 7 ring carbon atoms are substituted. In some embodiments, at least 8 ring carbon atoms are substituted. In some embodiments, at least 9 ring carbon atoms are substituted. In some embodiments, at least 10 ring carbon atoms are substituted. In some embodiments, at least 1, 2, 3, 4, 5, 6, 7, 8, 9, or 10 ring carbon atoms of the cycloaliphatic or heterocyclic ring of $R^G$ are substituted with —OH or —N(R')$_2$. In some embodiments, at least 1 ring carbon atom is substituted with —OH or —N(R')$_2$. In some embodiments, at least 2 ring carbon atoms are substituted with —OH or —N(R')$_2$. In some embodiments, at least 3 ring carbon atoms are substituted with —OH or —N(R')$_2$. In some embodiments, at least 4 ring carbon atoms are substituted with —OH or —N(R')$_2$. In some embodiments, at least 5 ring carbon atoms are substituted with —OH or —N(R')$_2$. In some embodiments, at least 6 ring carbon atoms are substituted with —OH or —N(R')$_2$. In some embodiments, at least 7 ring carbon atoms are substituted with —OH or —N(R')$_2$. In some embodiments, at least 8 ring carbon atoms are substituted with —OH or —N(R')$_2$. In some embodiments, at least 9 ring carbon atoms are substituted with —OH or —N(R')$_2$. In some embodiments, at least 10 ring carbon atoms are substituted with —OH or —N(R')$_2$. In some embodiments, at least 1, 2, 3, 4, 5, 6, 7, 8, 9, or 10 ring carbon atoms of the cycloaliphatic or heterocyclic ring of $R^G$ are substituted with —OH. In some embodiments, at least 1 ring carbon atom is substituted with —OH. In some embodiments, at least 2 ring carbon atoms are substituted with —OH. In some embodiments, at least 3 ring carbon atoms are substituted with —OH. In some embodiments, at least 4 ring carbon atoms are substituted with —OH. In some embodiments, at least 5 ring carbon atoms are substituted with —OH. In some embodiments, at least 6 ring carbon atoms are substituted with —OH. In some embodiments, at least 7 ring carbon atoms are substituted with —OH. In some embodiments, at least 8 ring carbon atoms are substituted with —OH. In some embodiments, at least 9 ring carbon atoms are substituted with —OH. In some embodiments, at least 10 ring carbon atoms are substituted with —OH. In some embodiments, at least 10%, 20%, 30%, 40%, 50%, 60%, 70%, 80%, 90%, or 95% percent of the ring carbon atoms of the cycloaliphatic or heterocyclic ring of $R^G$ are substituted with —OH or —N(R')$_2$. In some embodiments, at least 10% the ring carbon atoms are substituted with —OH or —N(R')$_2$. In some embodiments, at least 20% the ring carbon atoms are substituted with —OH or —N(R')$_2$. In some embodiments, at least 30% of the ring carbon atoms are substituted with —OH or —N(R')$_2$. In some embodiments, at least 40% of the ring carbon atoms are substituted with —OH or —N(R')$_2$. In some embodiments, at least 50% of the ring carbon atoms are substituted with —OH or —N(R')$_2$. In some embodiments, at least 60% of the ring carbon atoms are substituted with —OH or —N(R')$_2$. In some embodiments, at least 70% of the ring carbon atoms are substituted with —OH or —N(R')$_2$. In some embodiments, at least 80% of the ring carbon atoms are substituted with —OH or —N(R')$_2$. In some embodiments, at least 90% of the ring carbon atoms are substituted with —OH or —N(R')$_2$. In some embodiments, at least 95% of the ring carbon atoms are substituted with —OH or —N(R')$_2$. In some embodiments, at least 10%, 20%, 30%, 40%, 50%, 60%, 70%, 80%, 90%, or 95% of the ring carbon atoms of the cycloaliphatic or heterocyclic ring of $R^G$ are substituted with —OH. In some embodiments, at least 10% of the ring carbon atoms are substituted with —OH. In some embodiments, at least 20% of the ring carbon atoms are substituted with —OH. In some embodiments, at least 30% of the ring carbon atoms are substituted with —OH. In some embodiments, at least 40% of the ring carbon atoms are substituted with —OH. In some embodiments, at least 50% of the ring carbon atoms are substituted with —OH. In some embodiments, at least 60% of the ring carbon atoms are substituted with —OH. In some embodiments, at least 70% of the ring carbon atoms are substituted with —OH. In some embodiments, at least 80% of the ring carbon atoms are substituted with —OH. In some embodiments, at least 90% of the ring carbon atoms are substituted with —OH. In some embodiments, at least 95% of the ring carbon atoms are substituted with —OH. In some embodiments, at least one ring carbon atom is substituted with —N(R')$_2$. In some embodiments, at least one ring carbon atom is substituted with —NHC(O)R. In some embodiments, at least one ring carbon atom is substituted with —NHC(O)R, wherein R is optionally substituted $C_{1-6}$ aliphatic. In some embodiments, at least one ring carbon atom is substituted with —NHAc.

In some embodiments, $R^G$ is optionally substituted

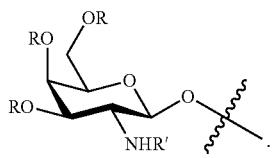

In some embodiments, R' is —C(O)R. In some embodiments, $R^G$ is

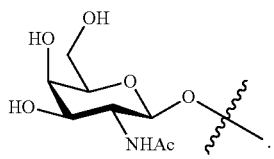

In some embodiments, $R^G$ is optionally substituted

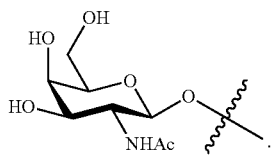

In some embodiments, $R^G$ is optionally substituted

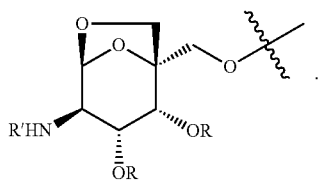

In some embodiments, R' is —C(O)R. In some embodiments, $R^G$ is optionally substituted

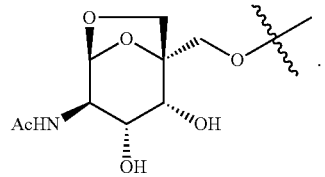 [SMILES: *OC[C@@]12CO[C@@H](O1)[C@H](NC(C)=O)[C@@H](O)[C@H]2O]

In some embodiments, $R^{CD}$, or $R^G$, is of such a structure that $R^{CD}$—H, or $R^G$—H, is

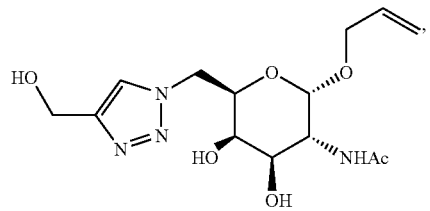

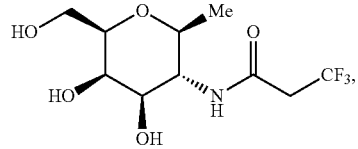

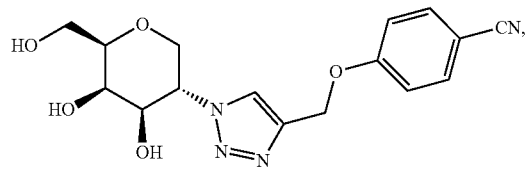

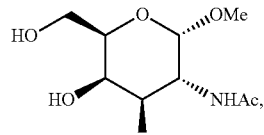

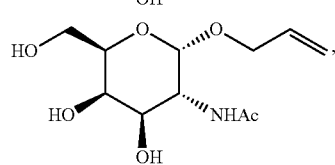

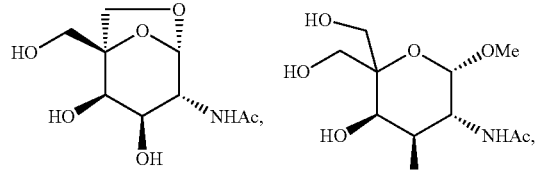

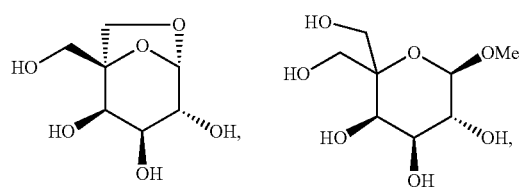

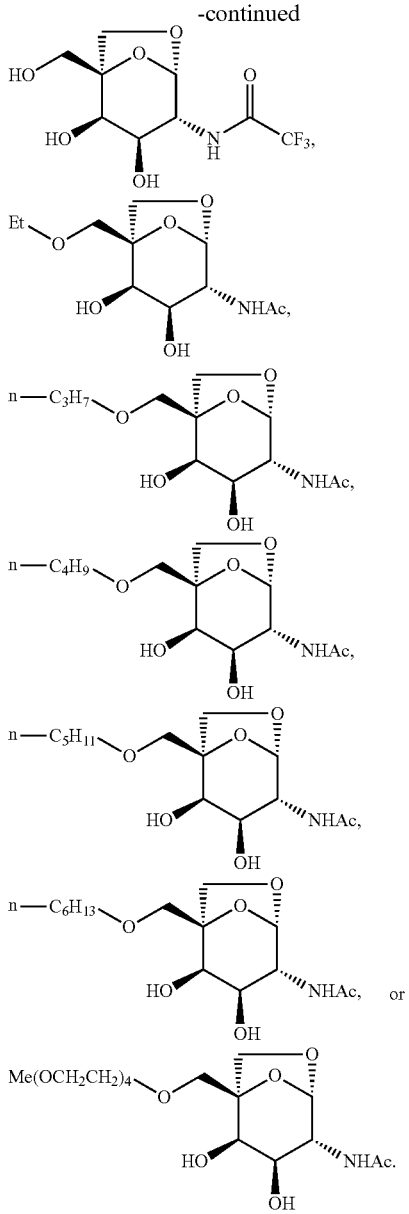

In some embodiments, $R^{CD}$, or $R^G$, is of such a structure that $R^{CD}$—H, or $R^G$—H, is a ligand for the asialoglycoprotein receptor (ASGPR). Various other ASGPR ligands are known in the art and can be utilized in accordance with the present disclose. In some embodiments, carbohydrate moieties described in are useful for targeted delivery of provided oligonucleotides to liver.

In some embodiments, L is a covalent bond. In some embodiments, L is bivalent optionally substituted $C_{1-6}$ aliphatic wherein one or more methylene units are independently and optionally replaced with —O—. In some embodiments, L is —O—$CH_2$—.

In some embodiments, $R^{CD}$ is an oligomeric or polymeric moiety of $R^G$—H, wherein each $R^G$ is independently as described in the present disclosure.

In some embodiments, an oligonucleotide or single-stranded RNAi agent comprises any targeting moiety described herein or known in the art. In some embodiments, an oligonucleotide is a single-stranded RNAi agent.

In some embodiments, a targeting moiety is a ligand for the asialoglycoprotein receptor (ASGPR).

In some embodiments, a targeting moiety is a ligand for the asialoglycoprotein receptor (ASGPR) disclosed in: Sanhueza et al. J. Am. Chem. Soc., 2017, 139 (9), pp 3528-3536.

In some embodiments, a targeting moiety is a ligand for the asialoglycoprotein receptor (ASGPR) disclosed in Liras et al. US 20160207953.

In some embodiments, a targeting moiety is a substituted-6,8-dioxabicyclo[3.2.1]octane-2,3-diol derivative disclosed in Liras et al. US 20160207953.

In some embodiments, a targeting moiety is a ligand for the asialoglycoprotein receptor (ASGPR) disclosed in Liras et al. US 20150329555.

In some embodiments, a targeting moiety is a substituted-6,8-dioxabicyclo[3.2.1]octane-2,3-diol derivative disclosed in Liras et al. US 20150329555.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any optional additional chemical moiety, including but not limited to, a carbohydrate moiety, a bicyclic ketal, a targeting moiety, a lipid moiety, a GalNAc moiety, etc., described herein or known in the art. In some embodiments, a carbohydrate is any carbohydrate, or variant, derivative or modification thereof, as described herein or known in the art. In some embodiments, a lipid is any lipid, or variant, derivative or modification thereof, as described herein or known in the art. In some embodiments, a GalNAc moiety is any GalNAc, or variant, derivative or modification thereof, as described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any optional additional chemical moiety, including but not limited to, a carbohydrate moiety, a targeting moiety, a lipid moiety, a GalNAc moiety, etc., described herein or known in the art in combination with any other structural element or modification described herein, including but not limited to, base sequence or portion thereof, sugar, base; internucleotidic linkage; stereochemistry or pattern thereof; seed region; post-seed region; 5'-end structure; 5'-end region; 5' nucleotide moiety; 3'-end region; 3'-terminal dinucleotide; 3'-end cap length; GC content; pattern of modifications of sugars, bases or internucleotidic linkages; format or any structural element thereof, and/or any other structural element or modification described herein; and in some embodiments, the present disclosure pertains to multimers of any such oligonucleotides.

In some embodiments, an additional chemical moiety conjugated to an oligonucleotide or single-stranded RNAi agent is a GalNAc moiety. In some embodiments, an additional chemical moiety conjugated to an oligonucleotide or single-stranded RNAi agent is a GalNAc moiety which is conjugated at any of positions N1 to N27.

In some embodiments, an additional chemical moiety conjugated to an oligonucleotide or single-stranded RNAi agent is a GalNAc moiety, conjugated via a linker to a 5'-H T. In some embodiments, an additional chemical moiety conjugated to an oligonucleotide or single-stranded RNAi agent is a GalNAc moiety, conjugated via a linker to a 5'-H T which is conjugated at any of positions N1 to N27.

In some embodiments, an additional chemical moiety is GaNC6T (also known as TGaNC6T, or conjugation of a GalNAc moiety to 5'H T via amino C6 linker) at any of positions N1 to N27.

In some embodiments, an additional chemical moiety is GaNC6T, e.g., conjugation of a GalNAc moiety to 5'H T via amino C6 linker (e.g., at the penultimate or antepenultimate nucleotide [counting 5' to 3']; for example, the 5' nucleotide of the 3'-terminal dinucleotide (e.g., the 5' nucleotide of the 3'-terminal dinucleotide is, of the two nucleotides of the 3'-terminal dinucleotide, the nucleotide closer to the 5'-end of the oligonucleotide) or the nucleotide immediately 5' to the 5' nucleotide of the 3'-terminal dinucleotide; wherein, for example, the penultimate position is N26 if yz=1, and the antepenultimate is N25 if wz=1 and yz=1):

In some embodiments, a GalNAc moiety can be conjugated at the penultimate nucleotide of a single-stranded RNAi agent (the more 5' position of a 3'-terminal dinucleotide), or at the antepenultimate nucleotide of a single-stranded RNAi agent (the nucleotide immediate 5' to the 3'-terminal dinucleotide). Without wishing to be bound by any particular theory, this disclosure suggests that the penultimate or antepenultimate nucleotide of a single-stranded RNAi agent (e.g., the more 5' position of a 3'-terminal dinucleotide) can be adjacent to a pocket in Ago-2, and a GalNAc moiety may be capable of insertion into said pocket, such that the GalNAc moiety does not interfere with Ago-2 activity. Without wishing to be bound by any particular theory, this disclosure suggests that if a GalNAc moiety is attached at the penultimate or antepenultimate

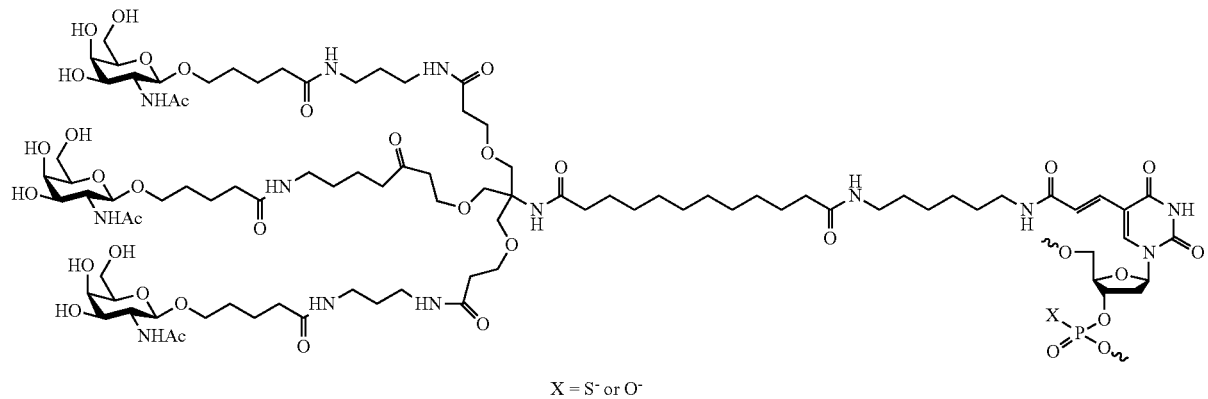

X = S⁻ or O⁻

See, as non-limiting examples: WV-3068, Tables 13 and 25; WV-3069, Table 25; WV-3245; WV-3248; WV-3532; WV-6035; WV-6036; WV-6037; WV-6038; and WV-6039.

In some embodiments or single-stranded RNAi agent, the oligonucleotide or single-stranded RNAi agent comprises a linker conjugating a GalNAc moiety to the oligonucleotide or single-stranded RNAi agent. In some embodiments or single-stranded RNAi agent, the oligonucleotide or single-stranded RNAi agent comprises a linker conjugating a GalNAc moiety to the oligonucleotide or single-stranded RNAi agent, wherein the linker is attached at the 2' position of a sugar. In some embodiments or single-stranded RNAi agent, the oligonucleotide or single-stranded RNAi agent comprises a linker conjugating a GalNAc moiety to the oligonucleotide or single-stranded RNAi agent, wherein the linker is attached to a base. In some embodiments or single-stranded RNAi agent, the oligonucleotide or single-stranded RNAi agent comprises a linker conjugating a GalNAc moiety to the oligonucleotide or single-stranded RNAi agent, wherein the linker is attached to a T base. In some embodiments or single-stranded RNAi agent, the oligonucleotide or single-stranded RNAi agent comprises a linker conjugating a GalNAc moiety to the oligonucleotide or single-stranded RNAi agent.

In some embodiments, a linker attaching a GalNAc moiety is a biocleavable linker. Such a linker allows the intracellular removal of the GalNAc moiety, so that the GalNAc moiety will not interfere with Ago-2 activity or RNA interference.

In some embodiments, a GalNAc moiety is conjugated to an oligonucleotide or single-stranded RNAi agent at the penultimate or antepenultimate nucleotide.

nucleotide, it may thus not be necessary to cleave the GalNAc moiety to allow RNAi activity, and it may thus be acceptable to use a more robust, non-biocleavable linker to attach a GalNAc moiety to the oligonucleotide or single-stranded RNAi agent. The more robust linker thus is less susceptible to cleavage, increasing the probability that a GalNAc moiety will increase delivery of the oligonucleotide or single-stranded RNAi agent.

In some embodiments, the GalNAc moiety is attached via a AMC6 linker.

In some embodiments, the GalNAc moiety is attached via a AMC6 linker attached at a T base (AMC6T).

In some embodiments, AMC6T has a structure of:

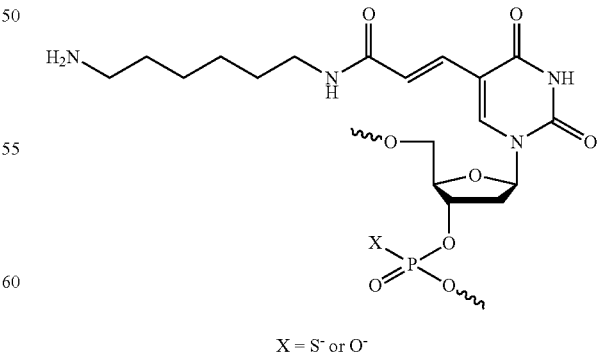

X = S⁻ or O⁻

In some non-limiting examples, AMC6T is either the penultimate or antepenultimate nucleotide [counting 5' to 3']; for example, the 5' nucleotide of the 3'-terminal dinucleotide, or the nucleotide immediately 5' to the 5' nucleotide of the 3'-terminal dinucleotide; wherein, for example, the penultimate position is N26 if yz=1, and the antepenultimate is N25 if wz=1 and yz=1. See, for example, WV-2154 and WV-2155, Table 23; and WV-2156 and WV-2157, Table 24.

Non-limiting examples of single-stranded RNAi agents comprising a AMC6T include: WV-2818, Table 13; and WV-2709, WV-2711, WV-2820, WV-3525, WV-3526, WV-3528, WV-6043 to WV-6050, WV-7498 to WV-7505, WV-6504, WV-6505, and WV-7323 to WV-7326.

In some embodiments of a single-stranded RNAi agent, the single-stranded RNAi agent comprises a AMC6T at the penultimate or antepenultimate nucleotide. Non-limiting examples of such single-stranded RNAi agents include: WV-2818, Table 13; and WV-2709, WV-2711, WV-2820, WV-3525, WV-3526, WV-3528, WV-6043 to WV-6050, WV-7498 to WV-7505, WV-6504, WV-6505, and WV-7323 to WV-7326.

As disclosed herein, GaNC6T is a component in an efficacious single-stranded RNAi agent. In some non-limiting examples, GaNC6T is either at the penultimate or antepenultimate nucleotide [counting 5' to 3']; for example, the 5' nucleotide of the 3'-terminal dinucleotide, or the nucleotide immediately 5' to the 5' nucleotide of the 3'-terminal dinucleotide; wherein, for example, the penultimate position is N26 if yz=1, and the antepenultimate is N25 if wz=1 and yz=1. In some non-limiting examples disclosed herein, GaNC6T is at nucleotide position 20 out of 21 (counting from the 5'-end), or 24 out of 25 (counting from the 5'-end). See, for example, WV-3068 and WV-3069, Tables 13 and 25; WV-3243, WV-3245, WV-3248, WV-3532.

In some embodiments, an oligonucleotide or single-stranded RNAi agent is conjugated to Tri-antennary GalNAc Acid (e.g., via a C10, C3 or triazine linker):

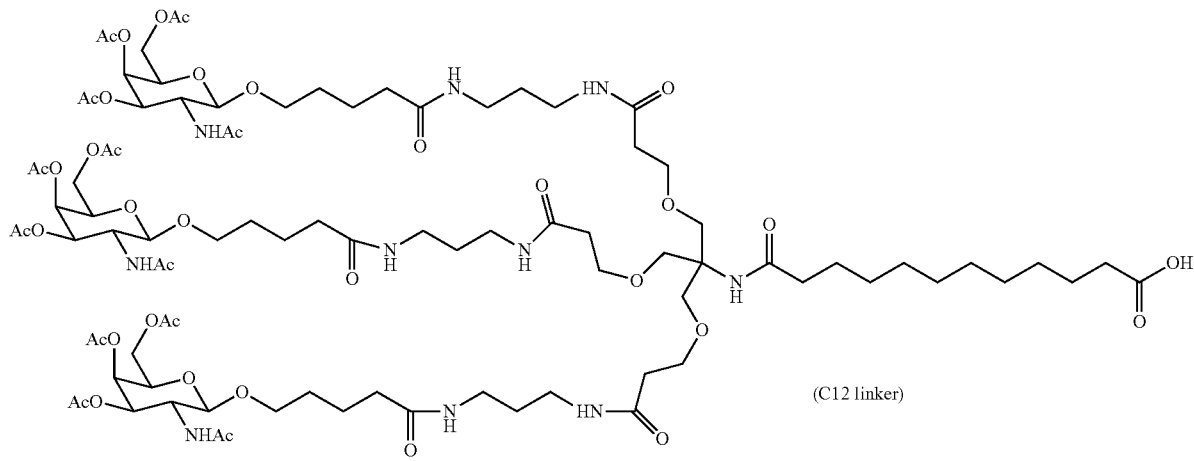

(C12 linker)

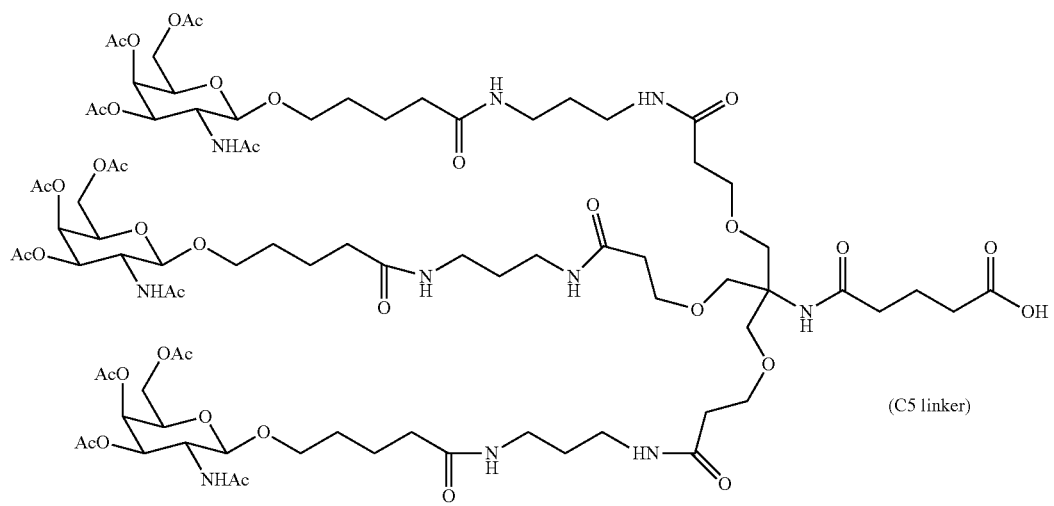

(C5 linker)

-continued

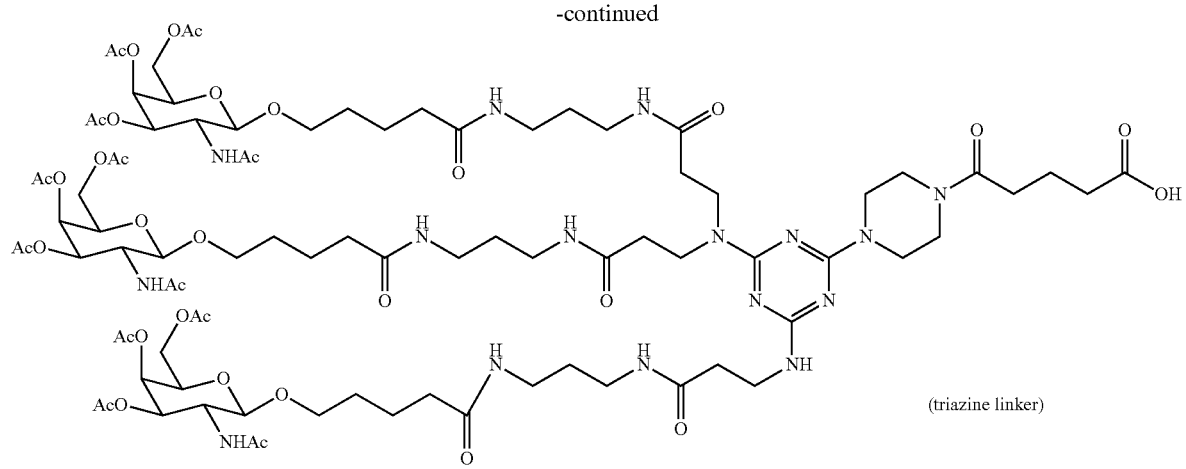

(triazine linker)

These structures represent the protected versions, as they comprise —OAc (—O-acetate groups). In some embodiments, the Ac groups are removed during de-protection following conjugation of the compound to the oligonucleotide. In some embodiments, de-protection is performed with concentrated ammonium hydroxide, e.g., as described in Example 37B. In the de-protected versions of these structures, —OAc is replaced by —OH.

In some embodiments, a GalNAc moiety is conjugated at the 5'-end (the N1 position). See, for example, WV-3249.

Each of these additional chemical moieties (Tri-antennary GalNAc Acid, with each of the C12, C5 or triazine linkers) was conjugated to an oligonucleotide targeting Factor XI (FXI), which operates via a RNase H mechanism.

Several oligonucleotides were constructed; each comprises an oligonucleotide targeting Factor XI (FXI), which operates via a RNase H mechanism, with each conjugated to a different Tri-antennary GalNAc Acid, with each of the C12, C5 or triazine linkers. The Tri-antennary GalNAc Acid has been revealed experimentally (data not shown) to improve the delivery of the oligonucleotides to the liver.

In some embodiments, the present disclosure pertains to any oligonucleotide conjugated to Tri-antennary GalNAc Acid. In some embodiments, the present disclosure pertains to any oligonucleotide conjugated to Tri-antennary GalNAc Acid via a C10, C3 or triazine linker. In some embodiments, the present disclosure pertains to any oligonucleotide conjugated to Tri-antennary GalNAc Acid, wherein the oligonucleotide directs knockdown of a target transcript mediated by a RNase H or RNA interference mechanism. In some embodiments, the present disclosure pertains to any oligonucleotide conjugated to Tri-antennary GalNAc Acid via a C10, C3 or triazine linker, wherein the oligonucleotide directs knockdown of a target transcript mediated by a RNase H or RNA interference mechanism.

In some embodiments, the present disclosure pertains to any oligonucleotide conjugated to Tri-antennary GalNAc Acid, wherein the oligonucleotide directs knockdown of a target transcript mediated by a RNase H or RNA interference mechanism, wherein the RNA interference mechanism is directed by a RNAi agent comprising 1, 2 or more strands. In some embodiments, the present disclosure pertains to any oligonucleotide conjugated to Tri-antennary GalNAc Acid via a C10, C3 or triazine linker, wherein the oligonucleotide directs knockdown of a target transcript mediated by a RNase H or RNA interference mechanism, wherein the RNA interference mechanism is directed by a RNAi agent comprising 1, 2 or more strands.

In addition, the present disclosure shows that in provided oligonucleotides capable of directing single-stranded RNA interference it is not necessary for the first nucleotide on the 5'-end of a single-stranded RNAi agent to match the corresponding portion of the sequence of the target transcript.

Oligonucleotides capable of directing single-stranded RNA interference were prepared and characterized using a variety of methods in accordance of the present disclosure. In some embodiments, a provided oligonucleotide composition is a single-stranded RNAi agent of an oligonucleotide type listed in Table 1A. In some embodiments, a provided oligonucleotide composition is a single-stranded RNAi agent of an oligonucleotide type listed as any of Formats illustrated in FIG. 1.

In some embodiments, an oligonucleotide is capable of directing knockdown of a target transcript by both RNase H-mediated knockdown and RNA interference. Such an oligonucleotide is described herein a dual mechanism or hybrid oligonucleotide.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any additional chemical moiety, including but not limited to, any GalNAc moiety described or referenced in any of: U.S. Pat. Nos. 5,382,524; 5,491,075; 5,545,553; 5,705,367; 5,733,765; 5,786,184; 5,798,233; 5,854,042; 5,871,990; 5,945,322; 6,165,469; 6,187,310; 6,342,382; 6,465,220; 6,503,744; 6,699,705; 6,723,545; 6,780,624; 6,825,019; 6,905,867; 6,911,337; 7,026,147; 7,078,207; 7,138,258; 7,166,717; 7,169,593; 7,169,914; 7,189,836; 7,192,756; 7,202,353; 7,208,304; 7,211,657; 7,217,549; 7,220,848; 7,238,509; 7,338,932; 7,371,838; 7,384,771; 7,462,474; 7,598,068; 7,608,442; 7,682,787; 7,723,092; 8,039,218; 8,137,941; 8,268,596; 8,871,723; or 9,222,080.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any optional additional chemical moiety, including but not limited to, a targeting moiety, a lipid moiety, a carbohydrate moiety, a GalNAc moiety, etc., described herein or known in the art. In some embodiments, a GalNAc moiety is any GalNAc, or variant, derivative or modification thereof, as described herein or known in the art. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can comprise any optional additional chemical moiety, including but not limited to, a targeting moiety, a lipid moiety, a carbohydrate moiety, a GalNAc moiety, etc., described herein or known in the art in combination with any other structural element or modification described herein, including but not limited to, base sequence or portion thereof, sugar, base; internucleotidic linkage; stereochemistry or pattern thereof; seed region; post-seed region; 5'-end structure; 5'-end region; 5' nucleotide moiety; 3'-end region; 3'-terminal dinucleotide; 3'-end cap length; GC content; pattern of modifications of sugars, bases or internucleotidic linkages; format or any structural element thereof, and/or any other structural element or modification described herein; and in some embodiments, the present disclosure pertains to multimers of any such oligonucleotides.

Dual Mechanism or Hybrid Oligonucleotide

In some embodiments, an oligonucleotide or an oligonucleotide that directs both RNA interference and RNase H-mediated knockdown can comprise structural element of any oligonucleotide described herein or known in the art.

As disclosed herein, some oligonucleotides are capable of directing knockdown of a transcript target by both RNase H-mediated knockdown and RNA interference.

As disclosed herein, some oligonucleotides (including but not limited to those described herein as dual mechanism or hybrid oligonucleotides or hybrid RNAi agents) are capable of directing knockdown of a transcript target by both RNase H-mediated knockdown and RNA interference.

Wishing wishing to be bound by any particular theory, the present disclosure suggests that a hybrid oligonucleotide can have particular advantages to either an oligonucleotide capable of directing knockdown solely by RNase H-mediated knockdown, or an oligonucleotide capable of directing knockdown solely by RNA interference. For example, if several hybrid oligonucleotides are introduced into the same cell, some but not all hybrid oligonucleotide may participate in the RISC pathway; those which do not are available to participate in the RNase H-mediated pathway. For example, if several hybrid oligonucleotides are introduced into the same cell, some but not all hybrid oligonucleotide may participate in the RNase H-mediated pathway; those which do not are available to participate in the RISC pathway. Without wishing to be bound by any particular theory, the present disclosure suggests that a hybrid oligonucleotide may be able to mediate more efficacious knockdown than an oligonucleotide capable of directing knockdown solely by RNase H-mediated knockdown, or an oligonucleotide capable of directing knockdown solely by RNA interference, as the hybrid oligonucleotide is capable of directing knockdown via both pathways. In at least some cells, levels of RNase H activity and RNA interference may differ from cell compartment to cell compartment. In some embodiments, a hybrid oligonucleotide can direct knockdown in various cell compartments via RNase H-mediated knockdown or RNA interference. In some embodiments, if RNase H is saturated with oligonucleotides, the excess oligonucleotides can be available for RNA interference-mediated knockdown. In some embodiments, if Ago-2 is saturated with oligonucleotides, the excess oligonucleotides can be available for RNase H-mediated knockdown.

In some embodiments, a hybrid oligonucleotide comprises a structure which allows both knockdown via RNase H-mediated knockdown and knockdown via RNA interference.

Reportedly, RNase H and RNAi both involve knockdown of a target mRNA, but they involve different mechanisms. Reportedly, RNase H naturally involves a single-stranded DNA molecule which binds to a mRNA target and decreases expression by either sterically hindering translation, or by the RNA/DNA duplex acting as a substrate for RNase H, which cleaves the mRNA target.

In contrast, reportedly, RNAi naturally involves a double-stranded RNA molecule, naturally produced by Dicer with two 3' overhangs, including an antisense and a sense strand. The strands are separated as the duplex is unwound and the antisense incorporated into the RISC (RNA interference silencing complex), including Argonaute-2. The antisense strand acts as a guide for RISC to identity the complementary mRNA target and cleave it. As shown herein, certain formats of single-stranded RNAi agents are also efficacious, although single-stranded RNAi agents are not naturally produced by Dicer.

Reportedly, RNase H and RISC naturally prefer two structurally distinct types of molecules. RNase H naturally uses a single-stranded DNA molecule to target the mRNA target, forming a DNA/RNA duplex. Reportedly, RISC reportedly naturally uses a single-stranded RNA antisense strand to target the mRNA target, forming a RNA/RNA duplex. Crooke et al. 1995 Biochem. J. 312: 599-608; and Elbashir et al. Nature 2001 411: 494.

Crooke et al. 1995 Biochem. J. 312: 599-608 also reported that *E. coli* RNase H1 had been crystallized and studied, and that the preferred substrate was reportedly a RNA/DNA duplex. In the DNA strand, 2'-modifications such as 2'-OMe and 2'-F reportedly reduced or eliminated RNase H activity. In addition, for RNA interference, full replacement of RNA by DNA reportedly abolishes RNA interference activity of double-stranded RNAi agents. Elbashir et al. 2001 EMBO J. 20: 6877-6888. Thus, reportedly, RNase H-mediated knockdown reportedly requires a span of DNA (2'-deoxy), while RNA interference can be abolished by replacement of a span of nucleotides with DNA (2'-deoxy).

In contrast, as shown herein, 2'-OMe and 2'-F modifications are highly suitable for single-stranded RNAi agents. See, for example, WV-2112, Table 2; WV-2113, WV-2146, and WV-2147, Table 3; WV-4010, WV-4270, WV-4011, and WV-4271, Table 5; and many other single-stranded RNAi agents disclosed herein.

The Applicants thus designed and constructed several oligonucleotides which comprise (a) a seed region comprising 2'-modified nucleotides; and (b) a post-seed region comprising a stretch of 2'-deoxy (2'-deoxy) nucleotides. These are shown herein to function via both the RNAi and RNase H-mediated knockdown mechanisms.

In some embodiments, a hybrid oligonucleotide comprises a (a) seed region capable of annealing to a first complementary target mRNA region and mediating RNA interference; and (b) a post-seed region comprising a 2'-deoxy (2'-deoxy) region capable of annealing a second complementary target mRNA region and directing RNase H-mediated knockdown. The seed region can optionally comprise RNA or a modified nucleotide, e.g., with a 2' modification (including but not limited to 2'-F, 2'-OMe and 2'-MOE), wherein the RNA or modified nucleotide comprise a natural sugar and/or a natural base, and/or a modified base, and/or an internucleotidic linkage.

A minimum length for a DNA (2'-deoxy) region efficacious for RNase H-mediated knockdown, in at least some cases, is reported to be about 5 consecutive DNA (2'-deoxy); this minimum deoxy length reportedly correlated with the minimum length required for efficient RNase H activation in vitro using partially purified mammalian RNase H enzyme. Monia et al. 1993 JBC 268: 14514-14522.

In some embodiments, a hybrid oligonucleotide comprises a (a) seed region capable of annealing to a first complementary target mRNA region; and (b) a post-seed region comprising a 2'-deoxy region, wherein the hybrid oligonucleotide is capable of directing both RNA interference and RNase H-mediated knockdown, wherein the 2'-deoxy region comprises at least 5 consecutive 2'-deoxy. In some embodiments, the 2'-deoxy can be DNA, or a modified nucleotide, e.g., a modified nucleotide with a 2'-deoxy, wherein the DNA or modified nucleotide comprise a natural sugar and/or a natural base, and/or a modified base, and/or any internucleotidic linkage. In some embodiments, the 2'-deoxy region comprises a stretch of consecutive nucleotides, wherein each nucleotide is 2'-deoxy and each internucleotidic linkage is a phosphorothioate. In some embodiments, the 2'-deoxy region comprises a stretch of consecutive nucleotides of at least 5, 6, 7, 8, 9, 10, 11, 12, 13, 14, 15, 16, 17, 18, 19, 20 or 21 nucleotides, wherein each nucleotide is 2'-deoxy and each internucleotidic linkage is a phosphorothioate.

In some embodiments, a hybrid oligonucleotide comprises a (a) seed region capable of annealing to a first complementary target mRNA region; and (b) a post-seed region comprising a 2'-deoxy region, wherein the hybrid oligonucleotide is capable of directing both RNA interference and RNase H-mediated knockdown, wherein the 2'-deoxy region comprises at least 5 consecutive 2'-deoxy. In some embodiments, the 2'-deoxy can be DNA, or a modified nucleotide, e.g., a modified nucleotide with a 2'-deoxy, wherein the DNA or modified nucleotide comprise a natural sugar and/or a natural base, and/or a modified base, and/or any internucleotidic linkage. In some embodiments, the 2'-deoxy region comprises or is a span of consecutive nucleotides, wherein each nucleotide is 2'-deoxy and each internucleotidic linkage is a phosphorothioate. In some embodiments, the 2'-deoxy region comprises or is a stretch of consecutive nucleotides, wherein each nucleotide is 2'-deoxy and each internucleotidic linkage is a phosphorothioate. In some embodiments, the 2'-deoxy region comprises a stretch of consecutive nucleotides of at least 5, 6, 7, 8, 9, 10, 11, 12, 13, 14, 15, 16, 17, 18, 19, 20 or 21 nucleotides, wherein each nucleotide is 2'-deoxy and each internucleotidic linkage is a phosphorothioate.

Without wishing to be bound by any particular theory, the present disclosure notes that WO 2015/107 425 has reported that cleavage mediated by RNase H can be modulated by the arrangement of chiral centers in phosphorothioates in an antisense oligonucleotide directing RNase H cleavage. For example, the placement of a single Rp flanked by at least 2 or 3 Sp can alter the cleavage pattern, such that the number of cleavage sites is reduced and the site of RNase H-mediated cleavage is controlled.

In some embodiments, a hybrid oligonucleotide comprises a (a) seed region capable of annealing to a first complementary target mRNA region; and (b) a post-seed region comprising a 2'-deoxy region, wherein the hybrid oligonucleotide is capable of directing both RNA interference and RNase H-mediated knockdown, wherein the 2'-deoxy region comprises a stretch of consecutive nucleotides of at least 5, 6, 7, 8, 9, 10, 11, 12, 13, 14, 15, 16, 17, 18, 19, 20 or 21 nucleotides, wherein each nucleotide is 2'-deoxy and each internucleotidic linkage is a phosphorothioate.

In some embodiments, a hybrid oligonucleotide comprises a (a) seed region capable of annealing to a first complementary target mRNA region; and (b) a post-seed region comprising a 2'-deoxy region, wherein the hybrid oligonucleotide is capable of directing both RNA interference and RNase H-mediated knockdown, wherein the 2'-deoxy region comprises a stretch of consecutive nucleotides of at least 9 nucleotides, wherein each nucleotide is 2'-deoxy and each internucleotidic linkage is a phosphorothioate.

In some embodiments, the first and second complementary target mRNA regions are regions of the same target mRNA.

In some embodiments, the first and second complementary target mRNA regions are regions of different target mRNAs.

In some embodiments of a hybrid oligonucleotide, a seed region is: -N2-PX2-N3-PX3-N4-PX4-N5-PX5-N6-PX6-N7-PX7-, -N2-PX2-N3-PX3-N4-PX4-N5-PX5-N6-PX6-N7-PX7-N8-PX8-, or -N2-PX2-N3-PX3-N4-PX4-N5-PX5-N6-PX6-N7-PX7-N8-PX8-(N9-PX9)$_{mz}$—, wherein $_{mz}$=1.

In some embodiments of a hybrid oligonucleotide, a seed region, e.g., -(N9-PX9)$_{mz}$—(N10-PX10)$_{mz}$—(N11-PX11)$_{pz}$—, comprises a DNA region capable of annealing to a complementary target mRNA region and directing RNase H-mediated knockdown.

Without wishing to be bound by any particular theory, the present disclosure notes that, in many cases, RNase H cleaves a single-stranded RNA target which is bound to a single-stranded DNA. In some embodiments, a hybrid oligonucleotide comprises a single-stranded 2'-deoxy portion, which is capable of binding to a target RNA transcript, forming a substrate for RNase H. In some embodiments, a hybrid oligonucleotide comprises a single-stranded 2'-deoxy portion (which comprises internucleotidic linkages which can be any internucleotidic linkage described herein or known in the art), which is capable of binding to a target RNA transcript, forming a substrate for RNase H.

In some embodiments, a hybrid oligonucleotide comprises a structure wherein the post-seed region (e.g., the region between the seed region and the 3'-end region), represented by N8-PX8-(N9-PX9)$_{mz}$—(N10-PX10)$_m$—(N11-PX11)$_{pz}$, comprises multiple consecutive 2'-deoxy.

In some embodiments of a single-stranded RNAi agent, a post-seed region comprises: a sequence of nucleotides comprising at least 4 consecutive 2'-deoxy. In some embodiments of a single-stranded RNAi agent, a post-seed region comprises: a sequence of nucleotides comprising at least 5 consecutive 2'-deoxy. In some embodiments of a single-stranded RNAi agent, a post-seed region comprises: a sequence of nucleotides comprising at least 6 consecutive 2'-deoxy. In some embodiments of a single-stranded RNAi agent, a post-seed region comprises: a sequence of nucleotides comprising at least 7 consecutive 2'-deoxy. In some embodiments of a single-stranded RNAi agent, a post-seed region comprises: a sequence of nucleotides comprising at least 8 consecutive 2'-deoxy. In some embodiments of a single-stranded RNAi agent, a post-seed region comprises: a sequence of nucleotides comprising at least 9 consecutive 2'-deoxy. In some embodiments of a single-stranded RNAi agent, a post-seed region comprises: a sequence of nucleotides comprising at least 10 to 20 consecutive 2'-deoxy. In some embodiments of a single-stranded RNAi agent, a post-seed region comprises: a sequence of nucleotides comprising at least 10, 11, 12, 13, 14, 15, 16, 17, 18, 19 or 20 consecutive 2'-deoxy.

In some embodiments of a hybrid oligonucleotide, a post-seed region comprises: at least 9 consecutive 2'-deoxy. In some embodiments of a single-stranded RNAi agent, a post-seed region comprises: at least 10 consecutive 2'-deoxy. Non-limiting examples of hybrid oligonucleotides include: WV-2111, Tables 21 and 24; WV-2113, Table 3; WV-2114, Table 29; WV-2146, WV-2147, WV-2148, WV-2149, Table 3; WV-2152, and WV-2153, Table 29; WV-2156 and WV-2157, Table 24; WV-2819; and WV-3069, Table 25.

The ability of various single-stranded RNAi agents and antisense oligonucleotides to mediate RNA interference or RNase H knockdown is described herein and shown, as non-limiting examples, in the Figures and Tables.

Experimental data (not shown) and described in detail elsewhere herein demonstrated that putative dual mechanism oligonucleotides are capable of mediating both RNA interference and RNase H knockdown. RNA interference was tested in either of two different in vitro Ago-2 assays, and RNase H knockdown was tested in an in vitro RNase H assay.

The experiments used an RNase H assay, with WV-1868 (ASO, mediating a RNase H knockdown mechanism) as a positive control, and WV-2110 (a single-stranded RNAi agent) as a negative control. RNA molecule WV-2372 is used as a test substrate. In the RNase H assay, dual mechanism oligonucleotide WV-2111 mediated RNase H knockdown.

In some embodiments, an oligonucleotide, an oligonucleotide that directs both RNA interference and RNase H-mediated knockdown can comprise structural element of any oligonucleotide described herein or known in the art. In some embodiments, an oligonucleotide, an oligonucleotide that directs both RNA interference and RNase H-mediated knockdown can comprise any structural element of any oligonucleotide described herein or known in the art in combination with any other structural element or modification described herein, including but not limited to, base sequence or portion thereof, sugar, base; internucleotidic linkage; stereochemistry or pattern thereof; seed region; post-seed region; 5'-end structure; 5'-end region; 5' nucleotide moiety; 3'-end region; 3'-terminal dinucleotide; 3'-end cap length; GC content; optional additional chemical moiety, including but not limited to, a targeting moiety, a lipid moiety, a carbohydrate moiety, a GalNAc moiety, etc.; pattern of modifications of sugars, bases or internucleotidic linkages; format or any structural element thereof, and/or any other structural element or modification described herein; and in some embodiments, the present disclosure pertains to multimers of any such oligonucleotides.

Allele Specific Suppression

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides are capable of mediating allele-specific suppression (or allele-specific knockdown).

In some embodiments, in some disease states, a patient (e.g., a human patient) can comprise two copies of the same gene, wherein one copy is wild-type (which is not disease-related), whereas the other copy on another chromosome has a mutation (which is disease-related). In some embodiments, the wild-type and mutant alleles can be differentiated by a particular sequence at the mutation, or else can be differentiated by a sequence outside the deleterious mutation (e.g., at a SNP). Knocking down both the mutant and wild-type alleles can sometimes be undesirable, because expression of the wild-type gene may be necessary or beneficial, while expression of the mutant gene may be deleterious or disease-related.

In some embodiments, a target sequence can be designed which recognizes the mutant transcript (e.g., one comprising the deleterious mutation or a targeted SNP) preferentially over the wild-type transcript.

In some embodiments, an allele-specific oligonucleotide maximizes knock-down of the mutant allele while minimizing knock-down of the wild-type allele, in a process referenced as allele-specific suppression or allele-specific knockdown. In some embodiments, an oligonucleotide is capable of selectively targeting the mutant allele of a gene. In some embodiments, an oligonucleotide is capable of knocking down the mutant allele compared to the wild-type allele with a specificity of at least 2-, 3-, 4-, 5-, 6-, 7-, 8-, 9-, 10-, 15-, 20-, 25-, 30-, 35-, 40-, 45- or 50-fold. In some embodiments, an oligonucleotide is capable of selectively targeting the mutant allele of a gene, wherein the mutant allele is represented by one allele and the wild-type allele is represented by a different allele. In some embodiments, a mutation can be a double mutation (e.g., two mutations in close proximity that often occur together in the same genome). In some embodiments, a mutation is in PNPLA3. In some embodiments, a mutation is a double mutation in PNPLA3. In some embodiments, the I148M mutation is in PNPLA3. In some embodiments, an allele-specific oligonucleotide is an antisense oligonucleotide. In some embodiments, an allele-specific oligonucleotide is an oligonucleotide or single-stranded RNAi agent. In some embodiments, an allele-specific oligonucleotide is an oligonucleotide or single-stranded RNAi agent which has or comprises any format or structure described herein.

In some embodiments, an allele-specific RNAi agent maximizes knock-down of the mutant allele while minimizing knock-down of the wild-type allele, in a process referenced as allele-specific suppression. In some embodiments, an oligonucleotide or single-stranded RNAi agent is capable of selectively targeting the mutant allele of a gene. In some embodiments, an oligonucleotide or single-stranded RNAi agent is capable of knocking down the mutant allele compared to the wild-type allele with a specificity of at least 2-, 3-, 4-, 5-, 6-, 7-, 8-, 9-, 10-, 15-, 20-, 25-, 30-, 35-, 40-, 45- or 50-fold. In some embodiments, an oligonucleotide or single-stranded RNAi agent is capable of selectively targeting the mutant allele of a gene, wherein the mutant allele is represented by one allele and the wild-type allele is represented by a different allele. In some embodiments, a mutation can be a double mutation (e.g., two mutations in close proximity that often occur together in the same genome). In some embodiments, a mutation is in PNPLA3. In some embodiments, a mutation is a double mutation in PNPLA3. In some embodiments, the I148M mutation is in PNPLA3.

In some embodiments, a non-limiting example of a method of designing an allele-specific RNAi agent is to incorporate into the base sequence a SNP or single-nucleotide polymorphism, wherein the mutant allele is represented by one allele of a SNP and the wild-type allele is represented by a different allele of the SNP. In some embodiments, a SNP can be at a location which is not the site of the disease-related mutation, but nonetheless serves to differentiate the two alleles.

In some embodiments, a non-limiting example of a method of designing an allele-specific RNAi agent is to incorporate into the base sequence a mutation, wherein the mutant allele is represented by one allele and the wild-type allele is represented by a different allele. In some embodiments, a mutation can be a double mutation (e.g., two mutations in close proximity that often occur together in the same genome). In some embodiments, a mutation is in PNPLA3. In some embodiments, a mutation is a double mutation in PNPLA3. In some embodiments, the I148M mutation is in PNPLA3.

In some embodiments, an oligonucleotide or single-stranded RNAi agent comprises a SNP or other sequence which differentiates between a mutant and a wild-type allele of a gene, and is capable of selectively knocking down the mutant allele relative to the wild-type allele.

In some embodiments, the target sequence of an oligonucleotide or single-stranded RNAi agent represents one allele of a target transcript.

As shown in the present disclosure, a provided single-stranded RNAi agent is capable of directing allele-specific RNA interference, wherein the ssRNAi is capable of knocking down a target mRNA having one sequence (e.g., a mutant sequence), but does not or does not significantly knock down a target mRNA having a related by different sequence (e.g., a wild-type version of the mutant sequence). In some embodiments, the mutant and wild-type sequences differ at one base position. In some embodiments, the mutant and wild-type sequences differ at two base positions. In some embodiments, the mutant and wild-type sequences differ at three base positions.

In some embodiments, an oligonucleotide or single-stranded RNAi agent is capable of directing RNA interference against an allele of a target gene while not mediating RNA interference against a different allele of a target gene at the same concentration.

In some embodiments, an oligonucleotide or single-stranded RNAi agent capable of directing allele-specific suppression comprises in its base sequence one or more SNPs at specific positions. These specific positions can be positions known or suspected to be sensitive to mismatches; e.g., a mismatch at one or more of these positions can alter the level of RNAi activity. See, for example, Miller et al. 2003 Proc. Natl. Acad. Sci. USA 100: 7195-7200; Brummelkamp et al. 2002 Cancer Cell 2: 243; and Naito et al. 2004 Nucl. Acids Res. 32: W124-W129. In many cases, full complementarity of the seed region to a mRNA target is necessary or beneficial for high RNAi activity; in contrast, complementary is not required in many cases at the 5' nucleotide moiety or at the 3'-terminal dinucleotide. In some embodiments, an allele-specific single-stranded RNAi agent has a SNP in the seed region.

In some embodiments, an oligonucleotide or single-stranded RNAi agent is capable of mediating allele-specific suppression.

In some embodiments, an oligonucleotide is capable of mediating allele-specific suppression.

In some embodiments, a single-stranded RNAi agent is capable of mediating allele-specific suppression.

In some embodiments, an oligonucleotide or single-stranded RNAi agent is capable of mediating allele-specific suppression of PNPLA3.

In some embodiments, an oligonucleotide is capable of mediating allele-specific suppression of PNPLA3.

In some embodiments, a single-stranded RNAi agent is capable of mediating allele-specific suppression of PNPLA3.

In some embodiments, an oligonucleotide or single-stranded RNAi agent is capable of mediating allele-specific suppression of APOC3.

In some embodiments, an oligonucleotide is capable of mediating allele-specific suppression of APOC3.

In some embodiments, a single-stranded RNAi agent is capable of mediating allele-specific suppression of APOC3.

In some embodiments, In some embodiments, an allele-specific single-stranded RNAi agent has a SNP in the seed region, which lies between the seed and the 3'-terminal dinucleotide.

In some embodiments, an oligonucleotide or single-stranded RNAi agent has a base sequence comprising one or more SNPs at any position.

In some embodiments, an oligonucleotide or single-stranded RNAi agent has a base sequence comprising one or more SNPs at any position selected from 3, 4, 5, 6, 7, 8, 9, 10, 11, 12, 13, 14, 15, 16, 17, 18, or 19.

In some embodiments, an oligonucleotide or single-stranded RNAi agent has a base sequence comprising one or more SNPs at any position inside the seed region.

In some embodiments, an oligonucleotide or single-stranded RNAi agent has a base sequence comprising one or more SNPs at any position outside the seed region.

In some embodiments, an oligonucleotide or single-stranded RNAi agent has a base sequence comprising one or more SNPs at any position in the post-seed region.

In some embodiments, an oligonucleotide or single-stranded RNAi agent has a base sequence comprising one or more SNPs at any of positions: 8, 9, 10, 11, 12, 13, 14, 15, 16, 17, or 18.

In some embodiments, an oligonucleotide or single-stranded RNAi agent has a base sequence comprising one or more SNPs at any of positions: 14 or 17.

In some embodiments, an oligonucleotide or single-stranded RNAi agent has a base sequence comprising one or more SNPs at any of positions: 9 or 10.

In some embodiments, an oligonucleotide or single-stranded RNAi agent has a base sequence comprising two or more SNPs.

In some embodiments, an oligonucleotide or single-stranded RNAi agent has a base sequence comprising two SNPs.

In some embodiments, an oligonucleotide or single-stranded RNAi agent has a base sequence comprising two SNPs, one each at positions 14 and 17.

In some embodiments, an oligonucleotide or single-stranded RNAi agent is capable of directing allele-specific suppression against a mutant allele of a gene relative to a wild-type allele of the same gene.

In some embodiments, an oligonucleotide or single-stranded RNAi agent is capable of directing allele-specific suppression against a mutant allele of PNPLA3 relative to a wild-type allele of PNPLA3.

Table 70A shows the in vitro potency and allelic specific suppression directed by different PNPLA3 single-stranded RNAi agents. Tested oligonucleotide is: WV-3387 in Huh7 and Hep3B cells. Table 70B and Table 70C shows the in vitro potency and IC50 for different single-stranded RNAi agents, which target PNPLA3. Tested oligonucleotides are: WV-4054 and WV-4098. WV-4054 has a sequence complementary to a pair of SNPs, rs738408 T and rs738409 G, at positions 14 and 17, and is able to mediate allele-specific RNA interference against cells (Huh7) which comprise these two SNPs. This oligonucleotide does not mediate significant RNAi interference at the tested concentrations in different cells (Hep3B) which do not comprise these SNPs, but rather have rs738408C and rs738409 C. In addition, single-stranded RNAi agent WV-4098 is also able to knock-down a complementary sequence (with SNPs rs738408 T and rs738409 G in Huh7 cells), but not a non-complementary sequence (with SNPs rs738408C and rs738409 C in Hep3B cells) at the tested concentrations.

Table 71 shows the in vitro potency and allele-specific knock-down directed by single-stranded RNAi agents to PNPLA3. Tested oligonucleotides are: Table 71A, WV-2477, WV-3387, and WV-4054; Table 71B, non-allele specific control ASO WV-3387; and Table 71C, allele specific ssRNAi WV-4054.

Table 90A to 90F shows in vitro allele-specific suppression of different oligonucleotides, which target PNPLA3. The double mutation in I148M in tested oligonucleotides is shown in Table 90A, as are cartoons of the oligonucleotide formats tested. Oligonucleotides with the I148M double mutation were tested against: Hep3B cells (wild-type) and Huh7 cells (with double mutation). Oligonucleotides were delivered with lipofectamine and cells were tested at 48 hours. Oligonucleotides tested are: Table 90B, WV-7778 to WV-7793; and WV-3858 to WV-3864; Table 90C, WV-7794 to WV-7816; Table 90D, WV-7817 to WV-7839; Table 90E, WV-7840 to WV-7862; and Table 90F, WV-993, WV-3390, and WV-4054, wherein WV-4054 is a single-stranded RNAi agent. In these data, oligonucleotides used were antisense oligonucleotides which have a wing-core-wing format, wherein the core was 2'-deoxy phosphorothioate (random in stereochemistry), and the wings were fully 2'-OMe, fully 2'-MOE, or all 2'-OMe with 5' and 3'-terminal LNA, or all 2'-MOE with 5' and 3'-terminal LNA. The wings are also phosphodiester and 5' and 3'-terminal stereorandom phosphorothioate.

The data demonstrate that many oligonucleotides were capable of directing allele-specific suppression (e.g., allele-specific knock-down). Oligonucleotides shown in Table 90B to 90E showed significant knock-down of the mutant allele in Huh7 cells and comparatively less knockdown of the wild-type allele in Hep3B cells. A single mismatch, even in the wings, was sufficient to mediate allele-specific suppression; however, in at least some cases, allele-specific suppression was increased when the two mismatches were both present in the DNA core.

Without wishing to be bound by any particular theory, the present disclosure notes that, in many cases, introduction of a stereocontrolled chiral internucleotidic linkage (in place of a stereorandom chiral internucleotidic linkage) can increase the allele-specific suppression, stability, efficacy, specificity, delivery, and/or albumin binding of an oligonucleotide.

In some embodiments, an oligonucleotide capable of mediating allele-specific suppression comprises one or more stereopure chiral internucleotidic linkages.

In some embodiments, an oligonucleotide capable of mediating allele-specific suppression comprises one or more stereopure chiral internucleotidic linkages in the Sp configuration.

In some embodiments, an oligonucleotide capable of mediating allele-specific suppression comprises one or more stereopure chiral internucleotidic linkages in the Sp configuration and one or more stereopure chiral internucleotidic linkages in the Rp configuration.

In some embodiments, an oligonucleotide capable of mediating allele-specific suppression comprises one or more stereopure phosphorothioates.

In some embodiments, an oligonucleotide capable of mediating allele-specific suppression comprises one or more stereopure phosphorothioates in the Sp configuration.

In some embodiments, an oligonucleotide capable of mediating allele-specific suppression comprises one or more stereopure phosphorothioates in the Rp configuration.

In some embodiments, an oligonucleotide capable of mediating allele-specific suppression comprises one or more stereopure phosphorothioates in the Sp configuration and one or more stereopure phosphorothioates in the Rp configuration.

In some embodiments, an oligonucleotide capable of allele-specific suppression of a target gene or its gene product can comprise any structure or format described herein.

In some embodiments, an oligonucleotide, an oligonucleotide that directs RNA interference, an oligonucleotide that directs RNase H-mediated knockdown, or an oligonucleotide that directs both RNA interference and RNase H-mediated knockdown can direct allele-specific suppression. In some embodiments, an oligonucleotide, an oligonucleotide that directs RNA interference, an oligonucleotide that directs RNase H-mediated knockdown, or an oligonucleotide that directs both RNA interference and RNase H-mediated knockdown can direct allele-specific suppression and can comprise any other structural element or modification described herein, including but not limited to, base sequence or portion thereof, sugar, base; internucleotidic linkage; stereochemistry or pattern thereof; additional chemical moiety, including but not limited to, a targeting moiety, lipid moiety, a carbohydrate moiety, a GalNAc moiety, etc.; 5'-end structure; 5'-end region; 5' nucleotide moiety; seed region; post-seed region; 3'-end region; 3'-terminal dinucleotide; 3'-end cap; GC content; long GC stretch; pattern of modifications of sugars, bases or internucleotidic linkages; format or any structural element thereof, and/or any other structural element or modification described herein; and in some embodiments, the present disclosure pertains to multimers of any such oligonucleotides.

Multimers of Oligonucleotides

In some embodiments, a multimer comprises two or more of: an oligonucleotide, an oligonucleotide that directs RNA interference, an oligonucleotide that directs RNase H-mediated knockdown and/or or an oligonucleotide that directs both RNA interference and RNase H-mediated knockdown can have any format or structural element thereof described herein or known in the art.

In some embodiments, a provided composition comprises a combination of one or more provided oligonucleotide types. One of skill in the chemical and medicinal arts will recognize that the selection and amount of each of the one or more types of provided oligonucleotides in a provided composition will depend on the intended use of that composition. That is to say, one of skill in the relevant arts would design a provided chirally controlled oligonucleotide composition such that the amounts and types of provided oligonucleotides contained therein cause the composition as a whole to have certain desirable characteristics (e.g., biologically desirable, therapeutically desirable, etc.).

In some embodiments, a provided oligonucleotide type is selected from those described in WO/2014/012081 and WO/2015/107425, the oligonucleotides, oligonucleotide types, oligonucleotide compositions, and methods thereof of each of which are incorporated herein by reference. In some embodiments, a provided chirally controlled oligonucleotide composition comprises oligonucleotides of an oligonucleotide type selected from those described in WO/2014/012081 and WO/2015/107425.

In some embodiments, the present disclosure pertains to a composition comprising a chirally controlled oligonucleotide composition, wherein the sequence of the oligonucleotide comprises or consists of the sequence of any chirally controlled oligonucleotide composition disclosed herein.

In some embodiments, the present disclosure pertains to a composition comprising a chirally controlled oligonucleotide composition, wherein the sequence of the oligonucleotide comprises or consists of the sequence of any single-stranded RNAi agent composition listed in Table 1A or otherwise described herein.

In some embodiments, the present disclosure pertains to compositions comprising a multimer of oligonucleotides, e.g., single-stranded RNAi agents, antisense oligonucleotides and/or other oligonucleotides, at least one of which has a structure, sequence or other characteristic as described herein.

In some embodiments, the present disclosure pertains to compositions comprising a multimer of single-stranded RNAi agents, antisense oligonucleotides and/or other oligonucleotides, wherein the multimer is at least about 16 kD in size.

In some embodiments, the present disclosure pertains to compositions comprising a multimer of single-stranded RNAi agents, antisense oligonucleotides and/or other oligonucleotides, and further comprises a carbohydrate moiety, lipid moiety, targeting moiety, or other compound.

In some embodiments, the present disclosure pertains to compositions comprising a multimer of single-stranded RNAi agents, antisense oligonucleotides and/or other oligonucleotides, and further comprises a carbohydrate moiety, lipid moiety, targeting moiety, or other compound, the total weight of which is at least about 16 kD in size.

In some embodiments, the multimer can comprise at least 2 single-stranded RNAi agents, antisense oligonucleotides and/or other oligonucleotides. In some embodiments, the multimer can comprise at least 3 single-stranded RNAi agents, antisense oligonucleotides and/or other oligonucleotides. In some embodiments, the multimer can comprise at least 4 single-stranded RNAi agents, antisense oligonucleotides and/or other oligonucleotides. In some embodiments, the multimer can comprise at least 5 single-stranded RNAi agents, antisense oligonucleotides and/or other oligonucleotides. In some embodiments, the multimer can comprise at least 6 single-stranded RNAi agents, antisense oligonucleotides and/or other oligonucleotides. In some embodiments, the multimer can comprise at least 7 single-stranded RNAi agents, antisense oligonucleotides and/or other oligonucleotides. In some embodiments, the multimer can comprise at least 8 single-stranded RNAi agents, antisense oligonucleotides and/or other oligonucleotides. In some embodiments, the multimer can comprise at least 9 single-stranded RNAi agents, antisense oligonucleotides and/or other oligonucleotides. In some embodiments, the multimer can comprise at least 10 single-stranded RNAi agents, antisense oligonucleotides and/or other oligonucleotides.

Without wishing to be bound by any particular theory, the present disclosure suggests that multimerization of oligonucleotides can provide a multimer which has a total molecular weight sufficient for transport via the lymphatic system. Supersaxo et al. reported that there is a linear relationship between the molecular weight of a drug and the proportion of a dose absorbed lymphatically, and that molecules with a molecular weight greater than 16 kD are absorbed mainly by the lymphatics, which drain a subcutaneous injection site. Supersaxo et al. 1990 Pharm. Res. 7: 167-9. In some embodiments, an oligonucleotide has a molecular weight of around 8 kD. In some embodiments, a multimer comprising multiple oligonucleotides has a molecular weight of at least around 16 kD.

Without wishing to be bound by any particular theory, the present disclosure notes that subcutaneous injections are reportedly widely utilized for delivery of drugs, including, but not limited to, those with limited oral availability, or as a means to modify or extend the release profile. McLennan et al. 2005 Drug Disc. Today: Technologies 2: 89-96. Subcutaneous injection reportedly results in delivery to the interstitial area underlying the dermis of the skin, from where drugs enter the circulatory system, or the lymphatic system; transport is reportedly affected by molecular weight, particle size, charge, hydrophilicity, and interaction with components in the interstitium. Drug formulation characteristics, such as drug concentration, injection volume, ionic strength, viscosity, and pH can also all reportedly play roles in diffusion from the subcutaneous injection site. McLennan et al. 2005; Paniagua et al. 2012 Lymphology 45: 144-153; and Bagby et al. 2012 Pharmaceutics 4: 276-295.

In some embodiments, one or more characteristic of molecular weight, particle size, charge, hydrophilicity, and interaction with components in the interstitium, drug concentration, injection volume, ionic strength, viscosity, and/or pH are modulated to improve or maximize the efficacy, bioavailability or delivery of a composition comprising an oligonucleotide.

As noted above, molecules with a molecular weight greater than 16 kD are reportedly absorbed mainly by the lymphatics. Supersaxo et al. 1990 Pharm. Res. 7: 167-9. In some embodiments, the present disclosure pertains to a composition comprising a multimer of oligonucleotides, wherein the multimer has a total molecular weight of at least about 16 kD. In some embodiments, the present disclosure pertains to a composition comprising two or more different types or sizes of multimers of oligonucleotides, wherein the one or more of the different types of multimer has a total molecular weight of at least about 16 kD.

In some embodiments, each oligonucleotide in a multimer can target the same or different targets. In some embodiments, wherein the each oligonucleotide in a multimer can target the same or different targets, administration of the multimer can be used to treat a disease involving overexpression or multiple target genes. In some embodiments, wherein the each oligonucleotide in a multimer can target the same or different targets, administration of the multimer can be used to treat different diseases involving overexpression of different target genes.

In some embodiments, each oligonucleotide in a multimer can target the same sequence in the same target. In some embodiments, each oligonucleotide in a multimer can target different sequences in the same target.

Non-limiting examples of multimers are shown in Table 89A.

In some embodiments, a multimer comprises two or more oligonucleotides directly connected to each other (e.g., via a bond or direct bond, such as a covalent bond), or via a linker.

Any linker described herein or known in the art can be used to link the oligonucleotides in a multimer. Various approaches for construction of multimers and use of various linkers is illustrated in Table 89B and 89C.

In some embodiments, a multimer comprising two or more single-stranded RNAi agents has the structure of:

5'4PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz-(N26-PX26-N27-PX27)yz-(CAP)zz-L]rn-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz-(N26-PX26-N27-PX27)yz-(CAP)zz-3'

[Multimer Type 1]

or

5'-[PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz-N26-PX26-N27-PX27-L]rn-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz-(N26-PX26-N27-PX27)yz-(CAP)zz-3'

[Multimer Type 2], wherein in Multimers type 1 and 2:

m=1 or more; L is a linker; and each PX is the same or different; and each N is the same or different; and each numerical subscript (e.g., mz, nz, pz, etc.) is the same or different.

In some embodiments, L is represented by a short linker oligonucleotide having the structure of:

-(N40-PX40)lzwherein lz is 0 to 10; and if lz=1 or more, each N40 is the same or different, and each PX40 is the same or different.

In some embodiments, PX40 is a chiral internucleotidic linkage in the Rp configuration.

In some embodiments, PX40 is a chiral internucleotidic linkage in the Sp configuration.

In some embodiments, PX40 is a phosphorothioate in the Rp configuration.

In some embodiments, PX40 is a phosphorothioate in the Sp configuration.

Without wishing to be bound by any particular theory, the present disclosure notes that, in at least some cases, a phosphorothioate in the Rp configuration is particularly susceptible to nuclease cleavage. Thus: In some embodiments, a linker comprises the structure of -(N40-PX40)lz-, wherein PX40 is a phosphorothioate in the Rp configuration, and lz=1 or more. In some embodiments, a linker comprises the structure of -(N40-PX40)lz-, wherein PX40 is a phosphorothioate in the Rp configuration, and lz=1 or more, or lz=2 or more, or lz=3 or more, or lz=4 or more.

In some embodiments of Multimer Type 2, a multimer is essentially a single long oligonucleotide, wherein the oligonucleotide comprises multiple shorter oligonucleotides, which are connected by short linker oligonucleotides. In some embodiments of Multimer Type 2, a multimer is essentially a single long oligonucleotide, wherein the oligonucleotide comprises multiple shorter oligonucleotides, which are connected by short linker oligonucleotides, wherein the short linker oligonucleotides comprise one or more internucleotidic linkages in the Rp configuration. In some embodiments of Multimer Type 2, a multimer is essentially a single long oligonucleotide, wherein the oligonucleotide comprises multiple shorter oligonucleotides, which are connected by short linker oligonucleotides, wherein the short linker oligonucleotides comprise one or more phosphorothioates in the Rp configuration.

Non-limiting examples of linkers include: a cleavable linker or a biodegradable linker; a non-cleavable or non-biodegradable linker; a linker comprising one or more internucleotidic linkages comprising a chiral center in the Rp configuration; a linker comprising one or more internucleotidic linkages comprising a chiral phosphorus in the Rp configuration; a linker comprising one or more phosphorothioate in the Rp configuration; a linker comprising two or more phosphorothioate in the Rp configuration; a linker comprising three or more phosphorothioate in the Rp configuration; a photocleavable linker; 1-(5-(N-maleimidomethyl)-2-nitrophenypethanol N-hydroxysuccinimide ester; a linker comprising a maleimido moiety; a linker comprising a N-hydroxysuccinimide ester moiety; a linker conjugated to an oligonucleotide at a base; a linker conjugated to an oligonucleotide at an internucleotidic linkage; a linker conjugated at a sugar; a phosphodiester; a phosphotriester; a methylphosphonate; a P3'→N5' phosphoramidate; a N3'→P5' phosphoramidate; a N3'→P5' thio-phosphoramidate; a phosphorothioate linkage; a thiourea linker; a C5 or C6 linker, as described in U.S. Pat. No. 9,572,891; a linker comprising a alkyl, cycloalkyl, aryl, heterocyclyl, and heteroaryl; a linker comprising a substituted alkyl, cycloalkyl, aryl, heterocyclyl, and heteroaryl; a linker of the structure of formula (A) of U.S. Pat. No. 9,512,163; a linker comprising a C1-C12 hydrocarbyl chain; a polyethylene glycol linker; a hexaethylene glycol linker; a hydrocarbyl chain; a substituted hydrocarbyl chain; a linker comprising one or more of: alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, or alkynylhereroaryl; a linker comprising a peptide having an amino acid sequence selected from: ALAL (SEQ ID NO: 3923), APISFFELG (SEQ ID NO: 3924), FL, GFN, R/KXX, GRWHTVGLRWE (SEQ ID NO: 3925), YL, GF, and FF, in which X is any amino acid; a linker comprising the formula —(CH2)wS-S(CH2)m-, wherein n and m are independently integers from 0 to 10; a linker comprising a low pH-labile bond; a linker comprising a low pH-labile bond comprising an amine, an imine, an ester, a benzoic imine, an amino ester, a diortho ester, a polyphosphoester, a polyphosphazene, an acetal, a vinyl ether, a hydrazone, an azidomethyl-methylmaleic anhydride, a thiopropionate, a masked endosomolytic agent or a citraconyl group; a branched linker; a cleavable linker susceptible to cleavage agents, e.g., pH, redox potential or the presence of degradative molecules; a redox cleavable linker; a phosphate-based cleavable linker; a phosphate-based cleavable linker comprising: —O—P(O)(OH)—O—, —O—P(S)(OH)—O—, —O—P(S)(SH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, or —O—P(S)(H)—S—; an acid cleavable linker; an ester-based linker; a peptide-based cleavable linker; and moieties comprising any of these linkers.

In some embodiments, a linker comprises a polypeptide that is more susceptible to cleavage by an endopeptidase in the mammalian extract than the targeting oligonucleotides. In some embodiments, the endopeptidase is trypsin, chymotrypsin, elastase, thermolysin, pepsin, or endopeptidase V8. In some embodiments, the endopeptidase is cathepsin B, cathepsin D, cathepsin L, cathepsin C, papain, cathepsin S or endosomal acidic insulinase.

Various linkers and methods of multimerization of oligonucleotides are described in, as non-limiting examples: U.S. Pat. Nos. 9,370,582; 9,371,348; 9,512,163; 9,572,891; and 6,031,091; and international published patent applications WO1998000435; WO2014043544; and WO2013040429.

The disclosure also notes that any linker described herein, or known in the art, can be used to link one or more oligonucleotides to each other, or to link one or more moiety (as non-limiting examples, a targeting moiety, a carbohydrate moiety, a GalNAc moiety, a lipid moiety, etc.) to one or more oligonucleotides (as non-limiting examples, a single-stranded RNAi agent, an antisense oligonucleotide, a double-stranded RNAi agent, an oligonucleotide capable of directing or inhibiting exon skipping, etc.).

In some embodiments, a multimer comprises two or more of: an oligonucleotide, an oligonucleotide that directs RNA interference, an oligonucleotide that directs RNase H-mediated knockdown, or an oligonucleotide that directs both RNA interference and RNase H-mediated knockdown can have any format or structural element thereof described herein or known in the art. In some embodiments, a multimer comprises two or more of: an oligonucleotide, an oligonucleotide that directs RNA interference, an oligonucleotide that directs RNase H-mediated knockdown, or an oligonucleotide that directs both RNA interference and RNase H-mediated knockdown can comprise any length described herein or known in the art in combination with any other structural element or modification described herein, including but not limited to, base sequence or portion thereof, sugar, base; internucleotidic linkage; stereochemistry or pattern thereof; additional chemical moiety, including but not limited to, a targeting moiety, lipid moiety, a carbohydrate moiety, a GalNAc, etc.; 5'-end structure; 5'-end region; 5' nucleotide moiety; seed region; post-seed region; 3'-end region; 3'-terminal dinucleotide; 3'-end cap; GC content; long GC stretch; format or any structural element thereof, and/or any other structural element or modification described herein; and in some embodiments, the present disclosure pertains to multimers of any such oligonucleotides.

Example Methods for Preparing Oligonucleotides and Compositions

Methods for preparing provided oligonucleotides and oligonucleotide compositions are widely known in the art, including but not limited to those described in WO/2010/064146, WO/2011/005761, WO/2013/012758, WO/2014/010250, US2013/0178612, WO/2014/012081, WO/2015/107425, PCT/US2016/043542, and PCT/US2016/043598, the methods and reagents of each of which is incorporated herein by reference.

Chirally Controlled Oligonucleotides.

In some embodiments, provided oligonucleotides are capable of directing a decrease in the expression and/or level of a target gene or its gene product. In some embodiments, provided oligonucleotides are chirally controlled.

In some embodiments, the present disclosure provides chirally controlled oligonucleotide compositions that, when compared to a reference condition [e.g., absence of the composition, presence of a reference composition (e.g., a stereorandom composition of oligonucleotides having the same base sequence, the same chemical modifications, etc., an oligonucleotide or single-stranded RNAi agent of another stereoisomer, etc.), and combinations thereof], are capable of directing a decrease in the expression and/or level of a target gene or its gene product.

In some embodiments, the present disclosure provides chirally controlled oligonucleotide compositions that, when compared to a reference condition [e.g., absence of the composition, presence of a reference composition (e.g., a stereorandom composition of oligonucleotides having the same base sequence, the same chemical modifications, etc., an oligonucleotide or single-stranded RNAi agent of another stereoisomer, etc.), and combinations thereof], mediate improved knockdown of transcripts via single-stranded RNA interference or RNase H.

Among other things, the present disclosure provides chirally controlled ssRNAi agents and chirally controlled compositions comprising one or more specific nucleotide types. In some embodiments, the phrase "oligonucleotide type," as used herein, defines an oligonucleotide that has a particular base sequence, pattern of backbone linkages, pattern of backbone chiral centers, and pattern of backbone phosphorus modifications (e.g., "—XLIV" groups). Oligonucleotides of a common designated "type" are structurally identical to one another with respect to base sequence, pattern of backbone linkages, pattern of backbone chiral centers, and pattern of backbone phosphorus modifications. In some embodiments, oligonucleotides of an oligonucleotide type are identical.

In some embodiments, a provided chirally controlled oligonucleotide or single-stranded RNAi agent in the disclosure has properties different from those of the corresponding stereorandom oligonucleotide or single-stranded RNAi agent mixture. In some embodiments, a chirally controlled oligonucleotide or single-stranded RNAi agent has lipophilicity different from that of the stereorandom oligonucleotide or single-stranded RNAi agent mixture. In some embodiments, a chirally controlled oligonucleotide or single-stranded RNAi agent has different retention time on HPLC. In some embodiments, a chirally controlled oligonucleotide or single-stranded RNAi agent may have a peak retention time significantly different from that of the corresponding stereorandom oligonucleotide or single-stranded RNAi agent mixture. During oligonucleotide or single-stranded RNAi agent purification using HPLC as generally practiced in the art, certain chirally controlled oligonucleotide or single-stranded RNAi agents will be largely if not totally lost. During oligonucleotide or single-stranded RNAi agent purification using HPLC as generally practiced in the art, certain chirally controlled oligonucleotide or single-stranded RNAi agents will be largely if not totally lost. One of the consequences is that certain diastereomers of a stereorandom oligonucleotide or single-stranded RNAi agent mixture (certain chirally controlled oligonucleotide or single-stranded RNAi agents) are not tested in assays. Another consequence is that from batches to batches, due to the inevitable instrumental and human errors, the supposedly "pure" stereorandom oligonucleotide or single-stranded RNAi agent will have inconsistent compositions in that diastereomers in the composition, and their relative and absolute amounts, are different from batches to batches. The chirally controlled oligonucleotide or single-stranded RNAi agent and chirally controlled oligonucleotide or single-stranded RNAi agent compositions provided in this disclosure overcome such problems, as a chirally controlled oligonucleotide or single-stranded RNAi agent is synthesized in a chirally controlled fashion as a single diastereomer (diastereoisomer), and an oligonucleotide or single-stranded RNAi agent comprises predetermined levels of one or more individual oligonucleotide or single-stranded RNAi agent types.

One of skill in the chemical and synthetic arts will appreciate that synthetic methods of the present disclosure provide for a degree of control during each step of the synthesis of a provided single-stranded RNAi agent such that each nucleotide unit of the single-stranded RNAi agent can be designed and/or selected in advance to have a particular stereochemistry at the linkage phosphorus and/or a particular modification at the linkage phosphorus, and/or a particular base, and/or a particular sugar. In some embodiments, a provided single-stranded RNAi agent is designed and/or selected in advance to have a particular combination of stereocenters at the linkage phosphorus of the internucleotidic linkage.

In some embodiments, a provided single-stranded RNAi agent made using methods of the present disclosure is designed and/or determined to have a particular combination of linkage phosphorus modifications. In some embodiments, a provided single-stranded RNAi agent made using methods of the present disclosure is designed and/or determined to have a particular combination of bases. In some embodiments, a provided single-stranded RNAi agent made using methods of the present disclosure is designed and/or determined to have a particular combination of sugars. In some embodiments, a provided single-stranded RNAi agent made using methods of the present disclosure is designed and/or determined to have a particular combination of one or more of the above structural characteristics.

Methods of the present disclosure exhibit a high degree of chiral control. For instance, methods of the present disclosure facilitate control of the stereochemical configuration of every single linkage phosphorus within a provided single-stranded RNAi agent. In some embodiments, methods of the present disclosure provide an single-stranded RNAi agent comprising one or more modified internucleotidic linkages independently having the structure of Formula I.

In some embodiments, methods of the present disclosure provide an single-stranded RNAi agent which is a unimer. In some embodiments, methods of the present disclosure provide an single-stranded RNAi agent which is a unimer of configuration Rp. In some embodiments, methods of the present disclosure provide an single-stranded RNAi agent which is a unimer of configuration Sp.

In some embodiments, methods of the present disclosure provide a chirally controlled single-stranded RNAi agent composition, i.e., an single-stranded RNAi agent composition that contains predetermined levels of individual single-stranded RNAi agent types. In some embodiments an oligonucleotide or a single-stranded RNAi agent comprises one single-stranded RNAi agent type. In some embodiments, a single-stranded RNAi agent comprises more than one single-stranded RNAi agent type. In some embodiments, an oligonucleotide or single-stranded RNAi agent composition comprises a plurality of oligonucleotide and/or single-stranded RNAi agent types. Example chirally controlled oligonucleotide and single-stranded RNAi agent compositions made in accordance with the present disclosure are described herein.

In some embodiments, an oligonucleotide comprises a chiral internucleotidic linkage (e.g., is stereocontrolled). In some embodiments, an oligonucleotide comprises a chiral internucleotidic linkage which is stereocontrolled and a chiral internucleotidic linkage which is not stereocontrolled. In some embodiments, an oligonucleotide comprises a chiral internucleotidic linkage which is stereocontrolled and an internucleotidic linkage which is not chiral. Various non-limiting examples of formats of stereocontrolled (chirally controlled) oligonucleotides are shown in Tables 71A to 71C. In some embodiments, an oligonucleotide has a structure of Format S1. In some embodiments, an oligonucleotide has a structure of Format S2. In some embodiments, an oligonucleotide has a structure of Format S3. In some embodiments, an oligonucleotide has a structure of Format S4. In some embodiments, an oligonucleotide has a structure of Format S5. In some embodiments, an oligonucleotide has a structure of Format S6. In some embodiments, an oligonucleotide has a structure of Format S7. In some embodiments, an oligonucleotide has a structure of Format S8. In some embodiments, an oligonucleotide has a structure of Format S9. In some embodiments, an oligonucleotide has a structure of Format S10. In some embodiments, an oligonucleotide has a structure of Format S11. In some embodiments, an oligonucleotide has a structure of Format S12. In some embodiments, an oligonucleotide has a structure of Format S13. In some embodiments, an oligonucleotide has a structure of Format S14. In some embodiments, an oligonucleotide has a structure of Format S15. In some embodiments, an oligonucleotide has a structure of Format S16. In some embodiments, an oligonucleotide has a structure of Format S17. In some embodiments, an oligonucleotide has a structure of Format S18. In some embodiments, an oligonucleotide has a structure of Format S19. In some embodiments, an oligonucleotide has a structure of Format S20. In some embodiments, an oligonucleotide has a structure of Format S21. In some embodiments, an oligonucleotide has a structure of Format S22. In some embodiments, an oligonucleotide has a structure of Format S23. In some embodiments, an oligonucleotide has a structure of Format S24. In some embodiments, an oligonucleotide has a structure of Format S25. In some embodiments, an oligonucleotide has a structure of Format S26. In some embodiments, an oligonucleotide has a structure of Format S27. In some embodiments, an oligonucleotide has a structure of Format S28. In some embodiments, an oligonucleotide has a structure of Format S29. In some embodiments, an oligonucleotide has a structure of Format S30. In some embodiments, an oligonucleotide has a structure of Format S31. In some embodiments, an oligonucleotide has a structure of Format S32. In some embodiments, an oligonucleotide has a structure of Format S33. In some embodiments, an oligonucleotide has a structure of Format S34. In some embodiments, an oligonucleotide has a structure of Format S35. In some embodiments, an oligonucleotide has a structure of Format S36. In some embodiments, an oligonucleotide has a structure of Format S37. In some embodiments, an oligonucleotide has a structure of Format S38. In some embodiments, an oligonucleotide has a structure of Format S39. In some embodiments, an oligonucleotide has a structure of Format S40. In some embodiments, an oligonucleotide has a structure of Format S41. In some embodiments, an oligonucleotide has a structure of Format S42. In some embodiments, an oligonucleotide has a structure of Format S43. In some embodiments, an oligonucleotide has a structure of Format S44.

A non-limiting example of an oligonucleotide which has a structure of Format S1 is WV-5288.

A non-limiting example of an oligonucleotide which has a structure of Format S2 is WV-5290.

A non-limiting example of an oligonucleotide which has a structure of Format S3 is WV-5291.

A non-limiting example of an oligonucleotide which has a structure of Format S4 is WV-7466.

A non-limiting example of an oligonucleotide which has a structure of Format S5 is WV-5292.

A non-limiting example of an oligonucleotide which has a structure of Format S6 is WV-5294.

A non-limiting example of an oligonucleotide which has a structure of Format S7 is WV-6411.

A non-limiting example of an oligonucleotide which has a structure of Format S8 is WV-6412.

A non-limiting example of an oligonucleotide which has a structure of Format S9 is WV-6413.

A non-limiting example of an oligonucleotide which has a structure of Format S10 is WV-6414.

A non-limiting example of an oligonucleotide which has a structure of Format S11 is WV-6415.

A non-limiting example of an oligonucleotide which has a structure of Format S12 is WV-6416.

A non-limiting example of an oligonucleotide which has a structure of Format S13 is WV-6417.

A non-limiting example of an oligonucleotide which has a structure of Format S14 is WV-6418.

A non-limiting example of an oligonucleotide which has a structure of Format S15 is WV-6419.

A non-limiting example of an oligonucleotide which has a structure of Format S16 is WV-6420.

A non-limiting example of an oligonucleotide which has a structure of Format S17 is WV-6421.

A non-limiting example of an oligonucleotide which has a structure of Format S18 is WV-6422.

A non-limiting example of an oligonucleotide which has a structure of Format S19 is WV-6423.

A non-limiting example of an oligonucleotide which has a structure of Format S20 is WV-6424.

A non-limiting example of an oligonucleotide which has a structure of Format S21 is WV-6425.

A non-limiting example of an oligonucleotide which has a structure of Format S22 is WV-6426.

A non-limiting example of an oligonucleotide which has a structure of Format S23 is WV-6427.

A non-limiting example of an oligonucleotide which has a structure of Format S24 is WV-6428.

A non-limiting example of an oligonucleotide which has a structure of Format S25 is WV-6429.

A non-limiting example of an oligonucleotide which has a structure of Format S26 is WV-6430.

A non-limiting example of an oligonucleotide which has a structure of Format S27 is WV-6431.

A non-limiting example of an oligonucleotide which has a structure of Format S28 is WV-6432.

A non-limiting example of an oligonucleotide which has a structure of Format S29 is WV-6433.

A non-limiting example of an oligonucleotide which has a structure of Format S30 is WV-6434.

A non-limiting example of an oligonucleotide which has a structure of Format S31 is WV-6435.

A non-limiting example of an oligonucleotide which has a structure of Format S32 is WV-6436.

A non-limiting example of an oligonucleotide which has a structure of Format S33 is WV-6437.

A non-limiting example of an oligonucleotide which has a structure of Format S34 is WV-6438.

A non-limiting example of an oligonucleotide which has a structure of Format S35 is WV-6763.

A non-limiting example of an oligonucleotide which has a structure of Format S36 is WV-6764.

A non-limiting example of an oligonucleotide which has a structure of Format S37 is WV-6765.

A non-limiting example of an oligonucleotide which has a structure of Format S38 is WV-7465.

A non-limiting example of an oligonucleotide which has a structure of Format S39 is WV-7521.

A non-limiting example of an oligonucleotide which has a structure of Format S40 is WV-7523.

A non-limiting example of an oligonucleotide which has a structure of Format S41 is WV-7525.

A non-limiting example of an oligonucleotide which has a structure of Format S42 is WV-7527.

A non-limiting example of an oligonucleotide which has a structure of Format S43 is WV-6763.

A non-limiting example of an oligonucleotide which has a structure of Format S44 is WV-6431.

In some embodiments, methods of the present disclosure provide chirally pure compositions with respect to the configuration of the linkage phosphorus. That is to say, in some embodiments, methods of the present disclosure provide compositions of wherein the oligonucleotide exists in the composition in the form of a single diastereomer with respect to the configuration of the linkage phosphorus.

In some embodiments, methods of the present disclosure provide chirally uniform compositions with respect to the configuration of the linkage phosphorus. That is to say, in some embodiments, methods of the present disclosure provide compositions of in which all nucleotide units therein have the same stereochemistry with respect to the configuration of the linkage phosphorus, e.g., all nucleotide units are of the Rp configuration at the linkage phosphorus or all nucleotide units are of the Sp configuration at the linkage phosphorus.

In some embodiments, a provided chirally controlled single-stranded RNAi agent is over 50% pure. In some embodiments, a provided chirally controlled single-stranded RNAi agent is over about 55% pure. In some embodiments, a provided chirally controlled single-stranded RNAi agent is over about 60% pure. In some embodiments, a provided chirally controlled single-stranded RNAi agent is over about 65% pure. In some embodiments, a provided chirally controlled single-stranded RNAi agent is over about 70% pure. In some embodiments, a provided chirally controlled single-stranded RNAi agent is over about 75% pure. In some embodiments, a provided chirally controlled single-stranded RNAi agent is over about 80% pure. In some embodiments, a provided chirally controlled single-stranded RNAi agent is over about 85% pure. In some embodiments, a provided chirally controlled single-stranded RNAi agent is over about 90% pure. In some embodiments, a provided chirally controlled single-stranded RNAi agent is over about 91% pure. In some embodiments, a provided chirally controlled single-stranded RNAi agent is over about 92% pure. In some embodiments, a provided chirally controlled single-stranded RNAi agent is over about 93% pure. In some embodiments, a provided chirally controlled single-stranded RNAi agent is over about 94% pure. In some embodiments, a provided chirally controlled single-stranded RNAi agent is over about 95% pure. In some embodiments, a provided chirally controlled single-stranded RNAi agent is over about 96% pure. In some embodiments, a provided chirally controlled single-stranded RNAi agent is over about 97% pure. In some embodiments, a provided chirally controlled single-stranded RNAi agent is over about 98% pure. In some embodiments, a provided chirally controlled single-stranded RNAi agent is over about 99% pure. In some embodiments, a provided chirally controlled single-stranded RNAi agent is over about 99.5% pure. In some embodiments, a provided chirally controlled single-stranded RNAi agent is over about 99.6% pure. In some embodiments, a provided chirally controlled single-stranded RNAi agent is over about 99.7% pure. In some embodiments, a provided chirally controlled single-stranded RNAi agent is over about 99.8% pure. In some embodiments, a provided chirally controlled single-stranded RNAi agent is over about 99.9% pure. In some embodiments, a provided chirally controlled single-stranded RNAi agent is over at least about 99% pure.

In some embodiments, an oligonucleotide or a single-stranded RNAi agent is a composition designed to comprise a single oligonucleotide or single-stranded RNAi agent type. In certain embodiments, such compositions are about 50% diastereomerically pure. In some embodiments, such compositions are about 50% diastereomerically pure. In some embodiments, such compositions are about 50% diastereomerically pure. In some embodiments, such compositions are about 55% diastereomerically pure. In some embodiments, such compositions are about 60% diastereomerically pure. In some embodiments, such compositions are about 65% diastereomerically pure. In some embodiments, such compositions are about 70% diastereomerically pure. In some embodiments, such compositions are about 75% diastereomerically pure. In some embodiments, such compositions are about 80% diastereomerically pure. In some embodiments, such compositions are about 85% diastereomerically pure. In some embodiments, such compositions are about 90% diastereomerically pure. In some embodiments, such compositions are about 91% diastereomerically pure. In some embodiments, such compositions are about 92% diastereomerically pure. In some embodiments, such compositions are about 93% diastereomerically pure. In some embodiments, such compositions are about 94% diastereomerically pure. In some embodiments, such compositions are about 95% diastereomerically pure. In some embodiments, such compositions are about 96% diastereomerically pure. In some embodiments, such compositions are about 97% diastereomerically pure. In some embodiments, such compositions are about 98% diastereomerically pure. In some embodiments, such compositions are about 99% diastereomerically pure. In some embodiments, such compositions are about 99.5% diastereomerically pure. In some embodiments, such compositions are about 99.6% diastereomerically pure. In some embodiments, such compositions are about 99.7% diastereomerically pure. In some embodiments, such compositions are about 99.8% diastereomerically pure. In some embodiments, such compositions are about 99.9% diastereomerically pure. In some embodiments, such compositions are at least about 99% diastereomerically pure.

In some embodiments, an oligonucleotide or a single-stranded RNAi agent comprises at least one Sp (e.g., a phosphorothioate or other internucleotidic linkage having a chiral center, in the Sp configuration). In some embodiments, an oligonucleotide or a single-stranded RNAi agent comprises at least 5 Sp. In some embodiments, an oligonucleotide or a single-stranded RNAi agent comprises at least 10 Sp. In some embodiments, an oligonucleotide or a single-stranded RNAi agent comprises at least 15 to 25 Sp.

As shown herein, the incorporation of one or more Sp internucleotidic linkage or one or more Sp PS (phosphorothioate) performs two functions for a single-stranded RNAi agent: (a) it increases stability against nucleases; and (b) does not interfere with RNA interference activity. While single-stranded RNAi agents and double-stranded RNAi agents differ in many aspects, this disclosure notes that, reportedly, many chemical modifications have been attempted for double-stranded RNAi agents, wherein the modifications did not both (a) stabilize the molecule against nucleases; and (b) allow RNA interference activity. Many chemical modifications reportedly perform one function but not the other. Some chemical modifications of double-stranded RNAi agents reportedly stabilized the molecule against nucleases, but interfered with or abolished RNAi activity. Other chemical modifications of double-stranded RNAi agents reportedly did not interfere with RNAi activity, but also did not stabilize the molecules against nucleases. See, for example, Czauderna et al. 2003 Nucl. Acids Res. 31: 2705-2716; Hadwiger et al. 2005, pages 194-206, in RNA interference Technology, ed. K. Appasani, Cambridge University Press, Cambridge, UK; Deleavey et al. 2009 Curr. Prot. Nucl. Acid Chem. 16.3.1-16.3.22; Terrazas et al. 2009 Nucl. Acids Res. 37: 346-353; Schwarz et al. 2002 Mol. Cell 10: 537-548; and Lipardi et al. 2001 Cell 107: 299-307. Only a minority of chemical modifications of double-stranded RNAi agents were capable of performing both functions. Furthermore, Matranga et al. 2005 Cell 123: 607-620 showed that introduction of a single Sp internucleotidic linkage (e.g., a single Sp PS) into the sense strand of a double-stranded RNAi agent greatly decreased RISC assembly and RNA interference activity. Thus, the chemical modification of a double-stranded RNAi agent with a single Sp internucleotidic linkage (e.g., a single Sp PS) did not (b) allow RNA interference activity. Thus, this disclosure endeavored to test the effect(s) of incorporation of Sp internucleotidic linkages or Sp PS into a single-stranded RNAi agent. The data shown herein show that, surprisingly, the incorporation of a Sp internucleotidic linkage or Sp PS performs two functions for a single-stranded RNAi agent: (a) it increases stability against nucleases; and (b) does not interfere with RNA interference activity. Non-limiting examples of single-stranded RNAi agent comprising at least 1 Sp include: WV-5288, WV-5290, WV-5292, WV-5294, WV-5296 and WV-5298, Table 37; WV-5290, WV-5291, WV-6431 to WV-6438 and WV-6763, Table 38; WV-5291, WV-6411 to WV-6430, WV-6764, and WV-6765, Table 39; WV-5291, WV-6764, and WV-6765, Table 44A; WV-5290, WV-6431, and WV-6763, Table 44B; WV-5288, WV-5290, WV-6763, WV-6431, WV-5289, WV-5291, WV-6765, and WV-6764, Table 45.

As shown in the data shown in Table 45, the stability of a single-stranded RNAi agent against nucleases was increased by converting a stereorandom phosphorothioate at the 5'-end and/or 3'-end to a phosphorothioate in the Sp configuration. Additional increases in stability were obtained by converting stereorandom phosphorothioates at nuclease cleavage sites identified herein to phosphorothioates in the Sp configuration. Non-limiting examples of single-stranded RNAi agents comprising one or more Sp internucleotidic linkages or one or more Sp PS include: WV-7464, WV-7467, and WV-7469, Table 68; WV-7465, WV-7466, and WV-7468, Table 69A; and WV-7469, Table 69B.

Without wishing to be bound by any particular theory, the disclosure suggests that incorporation of phosphorothioates or other chiral internucleotidic linkages in a Sp configuration may protect single-stranded RNAi agents from nucleases. Table 45 indicates various nuclease cleavage sites identified in a stereorandom APOC3 single-stranded RNAi agent, WV-2817. These major cleavage sites are between two pyrimidines (5'-U'U-3', 5'-U'U-3' or 5'-T'U-3', where indicates the cleavage site). Additional major nuclease cleavage sites were identified for stereorandom single-stranded RNAi agent WV-3242: 5'-U'U-3', 5'-C'U-3', and 5'-T'U-3'. Of the six major nuclease cleavage sites, five were between two adjacent pyrimidines and one was adjacent to a pyrimidine. Experimental data shown in Table 45 indicates that replacing one or more of the nuclease cleavage sites with a Sp internucleotidic linkage (or chiral internucleotidic linkage in a Sp configuration, e.g., a Sp PS or a phosphorothioate in the Sp configuration) greatly increased the stability of the single-stranded RNAi agents.

Single-stranded RNAi agents comprising multiple Sp internucleotidic linkages (e.g., Sp PS) were also tested to determine if the Sp abolished RNAi activity. The present disclosure notes that previous work has shown that many stereorandom oligonucleotides can decrease or completely lose their enzymatic or biological activity if converted into stereocontrolled versions. For many previously described oligonucleotides, introduction of Sp internucleotidic linkages can decrease or abolish activity.

Table 44 shows that, surprisingly, in addition to increasing stability, replacing multiple internucleotidic linkages (whether stereorandom or phosphodiester) with Sp internucleotidic linkages (e.g., Sp PS) did not decrease or eliminate RNA interference activity of a single-stranded RNAi agent. These results are also surprising because, reportedly, the introduction of a Sp PS into a stereorandom oligonucleotide in many cases is known to reduce biological activity. Thus, the introduction of one or more Sp internucleotidic linkages or Sp PS both increased stability of a single-stranded RNAi agent, and did not decrease or abolish RNAi activity.

Table 69A to C also shows that, surprisingly, in addition to increasing stability, replacing multiple internucleotidic linkages (whether stereorandom or phosphodiester) with Sp internucleotidic linkages (e.g., Sp PS) increased stability in and simultaneously did not decrease or eliminate RNA interference activity of a single-stranded RNAi agent. In some cases, activity was increased. These results are also surprising because, reportedly, the introduction of a Sp PS into a stereorandom oligonucleotide in many cases is known to reduce biological activity. Thus, the introduction of one or more Sp internucleotidic linkages or Sp PS both increased stability of a single-stranded RNAi agent, and did not decrease or abolish RNAi activity.

In some embodiments or a single-stranded RNAi agent, the oligonucleotide or single-stranded RNAi comprises 1 or more Sp internucleotidic linkages. In some embodiments or a single-stranded RNAi agent, the oligonucleotide or single-stranded RNAi comprises 1 or more Sp internucleotidic linkages at the 5' and/or 3'-end of the oligonucleotide or single-stranded RNAi agent. In some embodiments or a single-stranded RNAi agent, the oligonucleotide or single-stranded RNAi comprises 1 or more Sp internucleotidic linkages at sites susceptible to nuclease cleavage.

In some embodiments or a single-stranded RNAi agent, the oligonucleotide or single-stranded RNAi comprises 1 or more Sp PS. In some embodiments or a single-stranded RNAi agent, the oligonucleotide or single-stranded RNAi comprises 1 or more Sp PS at the 5' and/or 3'-end of the oligonucleotide or single-stranded RNAi agent. In some embodiments or a single-stranded RNAi agent, the oligonucleotide or single-stranded RNAi comprises 1 or more Sp PS at sites susceptible to nuclease cleavage.

Among other things, the present disclosure recognizes the challenge of stereoselective (rather than stereorandom or racemic) preparation of single-stranded RNAi agents. Among other things, the present disclosure provides methods and reagents for stereoselective preparation of single-stranded RNAi agents comprising multiple (e.g., more than 5, 6, 7, 8, 9, or 10) internucleotidic linkages, and particularly for single-stranded RNAi agents comprising multiple (e.g., more than 5, 6, 7, 8, 9, or 10) chiral internucleotidic linkages. In some embodiments, in a stereorandom or racemic preparation of single-stranded RNAi agents, at least one chiral internucleotidic linkage is formed with less than 90:10, 95:5, 96:4, 97:3, or 98:2 diastereoselectivity. In some embodiments, for a stereoselective or chirally controlled preparation of single-stranded RNAi agents, each chiral internucleotidic linkage is formed with greater than 90:10, 95:5, 96:4, 97:3, or 98:2 diastereoselectivity. In some embodiments, for a stereoselective or chirally controlled preparation of single-stranded RNAi agents, each chiral internucleotidic linkage is formed with greater than 95:5 diastereoselectivity. In some embodiments, for a stereoselective or chirally controlled preparation of single-stranded RNAi agents, each chiral internucleotidic linkage is formed with greater than 96:4 diastereoselectivity. In some embodiments, for a stereoselective or chirally controlled preparation of single-stranded RNAi agents, each chiral internucleotidic linkage is formed with greater than 97:3 diastereoselectivity. In some embodiments, for a stereoselective or chirally controlled preparation of single-stranded RNAi agents, each chiral internucleotidic linkage is formed with greater than 98:2 diastereoselectivity. In some embodiments, for a stereoselective or chirally controlled preparation of single-stranded RNAi agents, each chiral internucleotidic linkage is formed with greater than 99:1 diastereoselectivity. In some embodiments, diastereoselectivity of a chiral internucleotidic linkage in an single-stranded RNAi agent may be measured through a model reaction, e.g. formation of a dimer under essentially the same or comparable conditions wherein the dimer has the same internucleotidic linkage as the chiral internucleotidic linkage, the 5'-nucleoside of the dimer is the same as the nucleoside to the 5'-end of the chiral internucleotidic linkage, and the 3'-nucleoside of the dimer is the same as the nucleoside to the 3'-end of the chiral internucleotidic linkage.

In some embodiments, an oligonucleotide or a single-stranded RNAi agent is a composition designed to comprise multiple oligonucleotide or single-stranded RNAi agent types. In some embodiments, methods of the present disclosure allow for the generation of a library of chirally controlled single-stranded RNAi agents such that a pre-selected amount of any one or more chirally controlled single-stranded RNAi agent types can be mixed with any one or more other chirally controlled single-stranded RNAi agent types to create a chirally controlled single-stranded RNAi agent composition. In some embodiments, the pre-selected amount of an single-stranded RNAi agent type is a composition having any one of the above-described diastereomeric purities.

In some embodiments, the present disclosure provides methods for making a chirally controlled single-stranded RNAi agent comprising steps of:
(1) coupling;
(2) capping;
(3) modifying;
(4) deblocking; and
(5) repeating steps (1)-(4) until a desired length is achieved.

When describing the provided methods, the word "cycle" has its ordinary meaning as understood by a person of ordinary skill in the art. In some embodiments, one round of steps (1)-(4) is referred to as a cycle.

In some embodiments, the present disclosure provides methods for making chirally controlled single-stranded RNAi agent compositions, comprising steps of:
(a) providing an amount of a first chirally controlled single-stranded RNAi agent; and
(b) optionally providing an amount of one or more additional chirally controlled single-stranded RNAi agents.

In some embodiments, a first chirally controlled single-stranded RNAi agent is an single-stranded RNAi agent type, as described herein. In some embodiments, a one or more additional chirally controlled single-stranded RNAi agent is a one or more single-stranded RNAi agent type, as described herein.

One of skill in the relevant chemical and synthetic arts will recognize the degree of versatility and control over structural variation and stereochemical configuration of a provided single-stranded RNAi agent when synthesized using methods of the present disclosure. For instance, after a first cycle is complete, a subsequent cycle can be performed using a nucleotide unit individually selected for that subsequent cycle which, in some embodiments, comprises a nucleobase and/or a sugar that is different from the first cycle nucleobase and/or sugar. Likewise, the chiral auxiliary used in the coupling step of the subsequent cycle can be different from the chiral auxiliary used in the first cycle, such that the second cycle generates a phosphorus linkage of a different stereochemical configuration. In some embodiments, the stereochemistry of the linkage phosphorus in the newly formed internucleotidic linkage is controlled by using stereochemically pure phosphoramidites. Additionally, the modification reagent used in the modifying step of a subsequent cycle can be different from the modification reagent used in the first or former cycle. The cumulative effect of this iterative assembly approach is such that each component of a provided single-stranded RNAi agent can be structurally and configurationally tailored to a high degree. An additional advantage to this approach is that the step of capping minimizes the formation of "n–1" impurities that would otherwise make isolation of a provided single-stranded RNAi agent extremely challenging, and especially single-stranded RNAi agents of longer lengths.

In some embodiments, an example cycle of the method for making chirally controlled single-stranded RNAi agents is illustrated in example schemes described in the present disclosure. In some embodiments, an example cycle of the method for making chirally controlled single-stranded RNAi agents is illustrated in Scheme I. In some embodiments,

represents the solid support, and optionally a portion of the growing chirally controlled single-stranded RNAi agent attached to the solid support. The chiral auxiliary exemplified has the structure of formula 3-I:

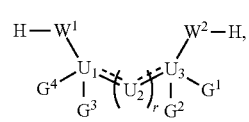

Formula 3-I which is further described below. "Cap" is any chemical moiety introduced to the nitrogen atom by the capping step, and in some embodiments, is an amino protecting group. One of ordinary skill in the art understands that in the first cycle, there may be only one nucleoside attached to the solid support when started, and cycle exit can be performed optionally before deblocking. As understood by a person of skill in the art, $B^{PRO}$ is a protected base used in single-stranded RNAi agent synthesis. Each step of the above-depicted cycle of Scheme I is described further below.

Scheme I. Synthesis of Chirally Controlled Single-Stranded RNAi Agent.

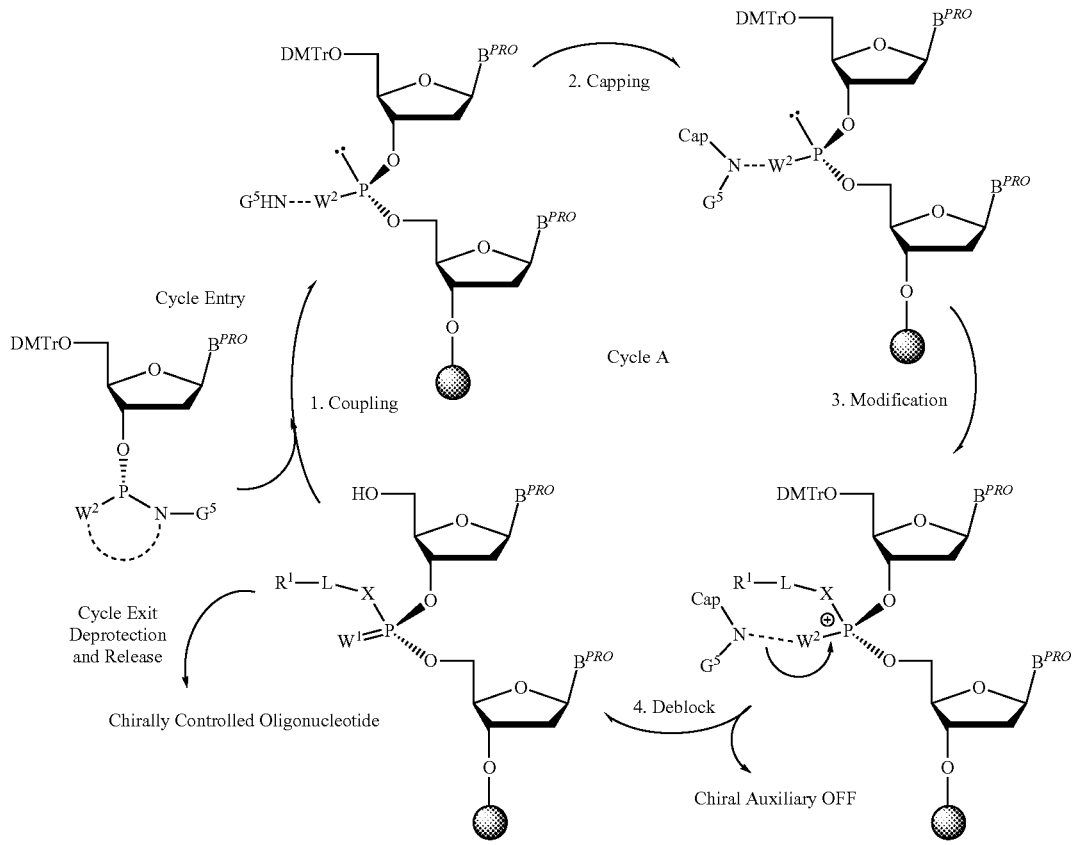

Scheme I. Synthesis of chirally controlled single-stranded RNAi agent.

Synthesis on Solid Support

In some embodiments, the synthesis of a provided single-stranded RNAi agent is performed on solid phase. In some embodiments, reactive groups present on a solid support are protected. In some embodiments, reactive groups present on a solid support are unprotected. During single-stranded RNAi agent synthesis a solid support is treated with various reagents in several synthesis cycles to achieve the stepwise elongation of a growing single-stranded RNAi agent chain with individual nucleotide units. The nucleoside unit at the end of the chain which is directly linked to the solid support is termed "the first nucleoside" as used herein. A first nucleoside is bound to a solid support via a linker moiety, i.e. a diradical with covalent bonds between either of a CPG, a polymer or other solid support and a nucleoside. The linker stays intact during the synthesis cycles performed to assemble the oligonucleotide chain and is cleaved after the chain assembly to liberate the oligonucleotide from the support.

Solid supports for solid-phase nucleic acid synthesis include the supports described in, e.g., U.S. Pat. Nos. 4,659,774, 5,141,813, 4,458,066; Caruthers U.S. Pat. Nos. 4,415,732, 4,458,066, 4,500,707, 4,668,777, 4,973,679, and 5,132,418; Andrus et al. U.S. Pat. Nos. 5,047,524, 5,262,530; and Koster U.S. Pat. No. 4,725,677 (reissued as RE34,069). In some embodiments, a solid phase is an organic polymer support. In some embodiments, a solid phase is an inorganic polymer support. In some embodiments, an organic polymer support is polystyrene, aminomethyl polystyrene, a polyethylene glycol-polystyrene graft copolymer, polyacrylamide, polymethacrylate, polyvinylalcohol, highly cross-linked polymer (HCP), or other synthetic polymers, carbohydrates such as cellulose and starch or other polymeric carbohydrates, or other organic polymers and any copolymers, composite materials or combination of the above inorganic or organic materials. In some embodiments, an inorganic polymer support is silica, alumina, controlled polyglass (CPG), which is a silica-gel support, or aminopropyl CPG. Other useful solid supports include fluorous solid supports (see e.g., WO/2005/070859), long chain alkylamine (LCAA) controlled pore glass (CPG) solid supports (see e.g., S. P. Adams, K. S. Kavka, E. J. Wykes, S. B. Holder and G. R. Galluppi, J. Am. Chem. Soc., 1983, 105, 661-663; G. R. Gough, M. J. Bruden and P. T. Gilham, Tetrahedron Lett., 1981, 22, 4177-4180). Membrane supports and polymeric membranes (see e.g. Innovation and Perspectives in Solid Phase Synthesis, Peptides, Proteins and Nucleic Acids, ch 21 pp 157-162, 1994, Ed. Roger Epton and U.S. Pat. No. 4,923,901) are also useful for the synthesis of nucleic acids. Once formed, a membrane can be chemically functionalized for use in nucleic acid synthesis. In addition to the attachment of a functional group to the membrane, the use of a linker or spacer group attached to the membrane is also used in some embodiments to minimize steric hindrance between the membrane and the synthesized chain.

Other suitable solid supports include those generally known in the art to be suitable for use in solid phase methodologies, including, for example, glass sold as Primer™ 200 support, controlled pore glass (CPG), oxalyl-controlled pore glass (see, e.g., Alul, et al., *Nucleic Acids Research*, 1991, 19, 1527), TentaGel Support—an aminopolyethyleneglycol derivatized support (see, e.g., Wright, et al., *Tetrahedron Lett.*, 1993, 34, 3373), and Poros-a copolymer of polystyrene/divinylbenzene.

Surface activated polymers have been demonstrated for use in synthesis of natural and modified nucleic acids and proteins on several solid supports mediums. A solid support material can be any polymer suitably uniform in porosity, having sufficient amine content, and sufficient flexibility to undergo any attendant manipulations without losing integrity. Examples of suitable selected materials include nylon, polypropylene, polyester, polytetrafluoroethylene, polystyrene, polycarbonate, and nitrocellulose. Other materials can serve as a solid support, depending on the design of the investigator. In consideration of some designs, for example, a coated metal, in particular gold or platinum can be selected (see e.g., US publication No. 20010055761). In one embodiment of single-stranded RNAi agent synthesis, for example, a nucleoside is anchored to a solid support which is functionalized with hydroxyl or amino residues. Alternatively, a solid support is derivatized to provide an acid labile trialkoxytrityl group, such as a trimethoxytrityl group (TMT). Without being bound by theory, it is expected that the presence of a trialkoxytrityl protecting group will permit initial detritylation under conditions commonly used on DNA synthesizers. For a faster release of single-stranded RNAi agent material in solution with aqueous ammonia, a diglycoate linker is optionally introduced onto the support.

In some embodiments, a provided single-stranded RNAi agent alternatively is synthesized from the 5' to 3' direction. In some embodiments, a nucleic acid is attached to a solid support through its 5' end of the growing nucleic acid, thereby presenting its 3' group for reaction, i.e. using 5'-nucleoside phosphoramidites or in enzymatic reaction (e.g. ligation and polymerization using nucleoside 5'-triphosphates). When considering the 5' to 3' synthesis the iterative steps of the present disclosure remain unchanged (i.e. capping and modification on the chiral phosphorus).

Linking Moiety

A linking moiety or linker is optionally used to connect a solid support to a compound comprising a free nucleophilic moiety. Suitable linkers are known such as short molecules which serve to connect a solid support to functional groups (e.g., hydroxyl groups) of initial nucleosides molecules in solid phase synthetic techniques. In some embodiments, the linking moiety is a succinamic acid linker, or a succinate linker (—CO—CH$_2$—CH$_2$—CO—), or an oxalyl linker (—CO—CO—). In some embodiments, the linking moiety and the nucleoside are bonded together through an ester bond. In some embodiments, a linking moiety and a nucleoside are bonded together through an amide bond. In some embodiments, a linking moiety connects a nucleoside to another nucleotide or nucleic acid. Suitable linkers are disclosed in, for example, *Oligonucleotides And Analogues A Practical Approach*, Ekstein, F. Ed., IRL Press, N.Y., 1991, Chapter 1 and Solid-Phase Supports for Oligonucleotide Synthesis, Pon, R. T., *Curr. Prot. Nucleic Acid Chem.*, 2000, 3.1.1-3.1.28.

A linker moiety is used to connect a compound comprising a free nucleophilic moiety to another nucleoside, nucleotide, or nucleic acid. In some embodiments, a linking moiety is a phosphodiester linkage. In some embodiments, a linking moiety is an H-phosphonate moiety. In some embodiments, a linking moiety is a modified phosphorus linkage as described herein. In some embodiments, a universal linker (UnyLinker) is used to attached the oligonucleotide to the solid support (Ravikumar et al., *Org. Process Res. Dev.*, 2008, 12 (3), 399-410). In some embodiments, other universal linkers are used (Pon, R. T., *Curr. Prot. Nucleic Acid Chem.*, 2000, 3.1.1-3.1.28). In some embodiments, various orthogonal linkers (such as disulfide linkers) are used (Pon, R. T., *Curr. Prot. Nucleic Acid Chem.*, 2000, 3.1.1-3.1.28).

Among other things, the present disclosure recognizes that a linker can be chosen or designed to be compatible with a set of reaction conditions employed in single-stranded RNAi agent synthesis. In some embodiments, to avoid degradation of single-stranded RNAi agents and to avoid desulfurization, auxiliary groups are selectively removed before de-protection. In some embodiments, DPSE group can selectively be removed by F ions. In some embodiments, the present disclosure provides linkers that are stable under a DPSE de-protection condition, e.g., 0.1M TBAF in MeCN, 0.5M HF-Et$_3$N in THF or MeCN, etc. In some embodiments, a provided linker is the SP linker. In some embodiments, the present disclosure demonstrates that the SP linker is stable under a DPSE de-protection condition, e.g., 0.1M TBAF in MeCN, 0.5M HF-Et$_3$N in THF or MeCN, etc.; they are also stable, e.g., under anhydrous basic conditions, such as om1M DBU in MeCN.

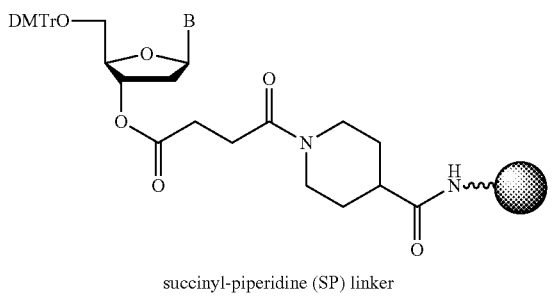

succinyl-piperidine (SP) linker

In some embodiments, an example linker is:

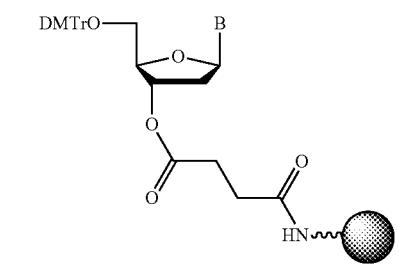

succinyl linker

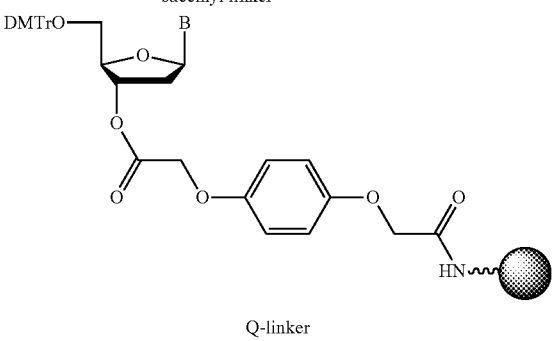

Q-linker

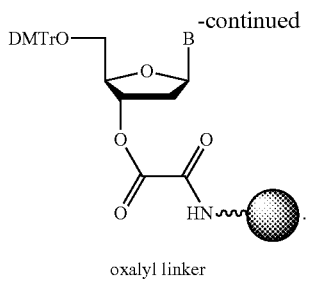

oxalyl linker

In some embodiments, the succinyl linker, Q-linker or oxalyl linker is not stable to one or more DPSE-deprotection conditions using F$^-$.

General Conditions—Solvents for Synthesis

Syntheses of provided oligonucleotides are generally performed in aprotic organic solvents. In some embodiments, a solvent is a nitrile solvent such as, e.g., acetonitrile. In some embodiments, a solvent is a basic amine solvent such as, e.g., pyridine. In some embodiments, a solvent is an ethereal solvent such as, e.g., tetrahydrofuran. In some embodiments, a solvent is a halogenated hydrocarbon such as, e.g., dichloromethane. In some embodiments, a mixture of solvents is used. In certain embodiments a solvent is a mixture of any one or more of the above-described classes of solvents.

In some embodiments, when an aprotic organic solvent is not basic, a base is present in the reacting step. In some embodiments where a base is present, the base is an amine base such as, e.g., pyridine, quinoline, or N,N-dimethylaniline. Example other amine bases include pyrrolidine, piperidine, N-methyl pyrrolidine, pyridine, quinoline, N,N-dimethylaminopyridine (DMAP), or N,N-dimethylaniline.

In some embodiments, a base is other than an amine base.

In some embodiments, an aprotic organic solvent is anhydrous. In some embodiments, an anhydrous aprotic organic solvent is freshly distilled. In some embodiments, a freshly distilled anhydrous aprotic organic solvent is a basic amine solvent such as, e.g., pyridine. In some embodiments, a freshly distilled anhydrous aprotic organic solvent is an ethereal solvent such as, e.g., tetrahydrofuran. In some embodiments, a freshly distilled anhydrous aprotic organic solvent is a nitrile solvent such as, e.g., acetonitrile.

Chiral Reagent/Chiral Auxiliary

In some embodiments, chiral reagents are used to confer stereoselectivity in the production of chirally controlled oligonucleotides. Many different chiral reagents, also referred to by those of skill in the art and herein as chiral auxiliaries, may be used in accordance with methods of the present disclosure. Examples of such chiral reagents are described herein and in Wada I, II and III, referenced above. In certain embodiments, a chiral reagent is as described by Wada I. In some embodiments, a chiral reagent for use in accordance with the methods of the present disclosure are of Formula 3-I, below:

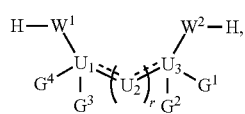

Formula 3-I wherein W$^1$ and W$^2$ are any of —O—, —S—, or -NG$^5$-, U$_1$ and U$_3$ are carbon atoms which are bonded to U$_2$ if present, or to each other if r is 0, via a single, double or triple bond.

U$_2$ is —C—, -CG$^8$G$^8$-, —N—, —O—, or —S— where r is an integer of 0 to 5 and no more than two heteroatoms are adjacent. When any one of U$_2$ is C, a triple bond must be formed between a second instance of U$_2$, which is C, or to one of U$_1$ or U$_3$. Similarly, when any one of U$_2$ is CG$^8$, a double bond is formed between a second instance of U$_2$ which is -CG$^8$- or —N—, or to one of U$_1$ or U$_3$.

In some embodiments, -U$_1$G$^3$ G$^4$-(U$_2$)$_r$-U$_3$G$^1$G$^2$- is -CG$^3$G$^4$-CG$^1$G$^2$-. In some embodiments, —U$_1$—(U$_2$)$_r$—U$_3$— is -CG$^3$=CG$^1$-. In some embodiments, —U$_1$—(U$_2$)$_r$—U$_3$— is —C≡C—. In some embodiments, —U$_1$—(U$_2$)$_r$—U$_3$— is -CG$^3$=CG$^8$-CG$^1$G$^2$-. In some embodiments, —U$_1$—(U$_2$)$_r$—U$_3$— is -CG$^3$G$^4$-O-CG$^1$G$^2$-. In some embodiments, —U$_1$—(U$_2$)$_r$—U$_3$— is -CG$^3$G$^4$-NG$^8$-CG$^1$G$^2$-. In some embodiments, —U$_1$—(U$_2$)$_r$—U$_3$— is -CG$^3$G$^4$-N-CG$^2$-. In some embodiments, —U$_1$—(U$_2$)$_r$—U$_3$— is -CG$^3$G$^4$-N=C G$^8$-CG$^1$G$^2$-.

As defined herein, G$^1$, G$^2$, G$^3$, G$^4$, G$^5$, and G$^8$ are independently hydrogen, or an optionally substituted group selected from alkyl, aralkyl, cycloalkyl, cycloalkylalkyl, heterocyclyl, heteroaryl, and aryl; or two of G$^1$, G$^2$, G$^3$, G$^4$, and G$^5$ are G$^6$ (taken together to form an optionally substituted, saturated, partially unsaturated or unsaturated carbocyclic or heteroatom-containing ring of up to about 20 ring atoms which is monocyclic or polycyclic, and is fused or unfused). In some embodiments, a ring so formed is substituted by oxo, thioxo, alkyl, alkenyl, alkynyl, heteroaryl, or aryl moieties. In some embodiments, when a ring formed by taking two G$^6$ together is substituted, it is substituted by a moiety which is bulky enough to confer stereoselectivity during the reaction.

In some embodiments, a ring formed by taking two of G$^6$ together is optionally substituted cyclopentyl, pyrrolyl, cyclopropyl, cyclohexenyl, cyclopentenyl, tetrahydropyranyl, or piperazinyl. In some embodiments, a ring formed by taking two of G$^6$ together is optionally substituted cyclopentyl, pyrrolyl, cyclopropyl, cyclohexenyl, cyclopentenyl, tetrahydropyranyl, pyrrolidinyl, or piperazinyl.

In some embodiments, G$^1$ is optionally substituted phenyl. In some embodiments, G$^1$ is phenyl. In some embodiments, G$^2$ is methyl or hydrogen. In some embodiments, G$^1$ is optionally substituted phenyl and G$^2$ is methyl. In some embodiments, G$^1$ is phenyl and G$^2$ is methyl.

In some embodiments, r is 0.

In some embodiments, W$^1$ is —NG$^5$-. In some embodiments, one of G$^3$ and G$^4$ is taken together with G$^5$ to form an optionally substituted pyrrolidinyl ring. In some embodiments, one of G$^3$ and G$^4$ is taken together with G$^5$ to form a pyrrolidinyl ring.

In some embodiments, W$^2$ is —O—.

In some embodiments, a chiral reagent is a compound of Formula 3-AA:

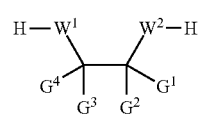

Formula 3-AA wherein each variable is independently as defined above and described herein.

In some embodiments of Formula 3AA, W$^1$ and W$^2$ are independently -NG$^5$-, —O—, or —S—; G$^1$, G$^2$, G$^3$, G$^4$, and G$^5$ are independently hydrogen, or an optionally substituted group selected from alkyl, aralkyl, cycloalkyl, cycloalkylalkyl, heterocyclyl, heteroaryl, and aryl; or two of $G^1$, $G^2$, $G^3$, $G^4$, and $G^5$ are $G^6$ (taken together to form an optionally substituted saturated, partially unsaturated or unsaturated carbocyclic or heteroatom-containing ring of up to about 20 ring atoms which is monocyclic or polycyclic, fused or unfused), and no more than four of $G^1$, $G^2$, $G^3$, $G^4$, and $G^5$ are $G^6$. Similarly to the compounds of Formula 3-I, any of $G^1$, $G^2$, $G^3$, $G^4$, or $G^5$ are optionally substituted by oxo, thioxo, alkyl, alkenyl, alkynyl, heteroaryl, or aryl moieties. In some embodiments, such substitution induces stereoselectivity in chirally controlled oligonucleotide production.

In some embodiments, a provided chiral reagent has the structure of

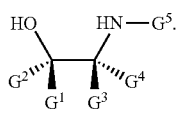

In some embodiments, a provided chiral reagent has the structure of

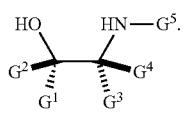

In some embodiments, a provided chiral reagent has the structure of

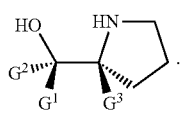

In some embodiments, a provided chiral reagent has the structure of

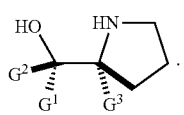

In some embodiments, a provided chiral reagent has the structure of

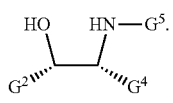

In some embodiments, a provided chiral reagent has the structure of

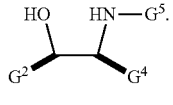

In some embodiments, a provided chiral reagent has the structure of

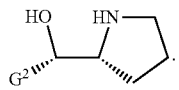

In some embodiments, a provided chiral reagent has the structure of

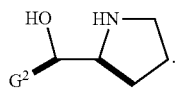

In some embodiments, $W^1$ is $-NG^5$, $W^2$ is O, each of $G^1$ and $G^3$ is independently hydrogen or an optionally substituted group selected from $C_{1-10}$ aliphatic, heterocyclyl, heteroaryl and aryl, $G^2$ is $-C(R)_2Si(R)_3$, and $G^4$ and $G^5$ are taken together to form an optionally substituted saturated, partially unsaturated or unsaturated heteroatom-containing ring of up to about 20 ring atoms which is monocyclic or polycyclic, fused or unfused. In some embodiments, each R is independently hydrogen, or an optionally substituted group selected from $C_1$-$C_6$ aliphatic, carbocyclyl, aryl, heteroaryl, and heterocyclyl. In some embodiments, $G^2$ is $-C(R)_2Si(R)_3$, wherein $-C(R)_2-$ is optionally substituted $-CH_2-$, and each R of $-Si(R)_3$ is independently an optionally substituted group selected from $C_{1-10}$ aliphatic, heterocyclyl, heteroaryl and aryl. In some embodiments, at least one R of $-Si(R)_3$ is independently optionally substituted $C_{1-10}$ alkyl. In some embodiments, at least one R of $-Si(R)_3$ is independently optionally substituted phenyl. In some embodiments, one R of $-Si(R)_3$ is independently optionally substituted phenyl, and each of the other two R is independently optionally substituted $C_{1-10}$ alkyl. In some embodiments, one R of $-Si(R)_3$ is independently optionally substituted $C_{1-10}$ alkyl, and each of the other two R is independently optionally substituted phenyl. In some embodiments, $G^2$ is optionally substituted $-CH_2Si(Ph)(Me)_2$. In some embodiments, $G^2$ is optionally substituted $-CH_2Si(Me)(Ph)_2$. In some embodiments, $G^2$ is $-CH_2Si(Me)(Ph)_2$. In some embodiments, $G^4$ and $G^5$ are taken together to form an optionally substituted saturated 5-6 membered ring containing one nitrogen atom (to which $G^5$ is attached). In some embodiments, $G^4$ and $G^5$ are taken together to form an optionally substituted saturated 5-membered ring containing one nitrogen atom. In some embodiments, $G^1$ is hydrogen. In some embodiments, $G^3$ is hydrogen. In some embodiments, both $G^1$ and $G^3$ are hydrogen.

In some embodiments, a chiral reagent has one of the following formulae:

Formula 3-AB

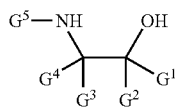

3-BB

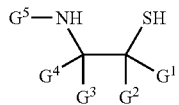

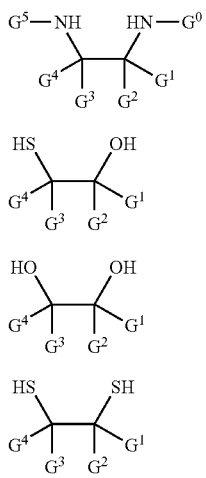

3-CC

3-DD

3-EE

3-FF

In some embodiments, a chiral reagent is an aminoalcohol. In some embodiments, a chiral reagent is an aminothiol. In some embodiments, a chiral reagent is an aminophenol. In some embodiments, a chiral reagent is (S)- and (R)-2-methylamino-1-phenylethanol, (1R,2,9-ephedrine, or (1R,2S)-2-methylamino-1,2-diphenylethanol.

In some embodiments of the disclosure, a chiral reagent is a compound of one of the following formulae:

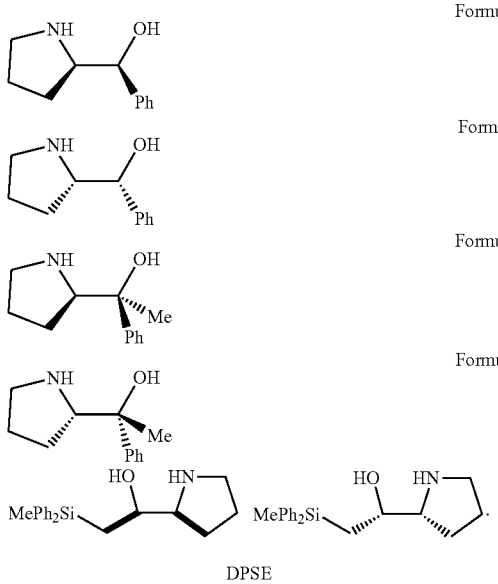

Formula O

Formula P

Formula Q

Formula R

DPSE

As demonstrated herein, when used for preparing a chiral internucleotidic linkage, to obtain stereoselectivity generally stereochemically pure chiral reagents are utilized. Among other things, the present disclosure provides stereochemically pure chiral reagents, including those having structures described.

The choice of chiral reagent, for example, the isomer represented by Formula Q or its stereoisomer, Formula R, permits specific control of chirality at a linkage phosphorus. Thus, either an Rp or Sp configuration can be selected in each synthetic cycle, permitting control of the overall three dimensional structure of a chirally controlled oligonucleotide. In some embodiments, a chirally controlled oligonucleotide has all Rp stereocenters. In some embodiments of the disclosure, a chirally controlled oligonucleotide has all Sp stereocenters. In some embodiments of the disclosure, each linkage phosphorus in the chirally controlled oligonucleotide is independently Rp or Sp. In some embodiments of the disclosure, each linkage phosphorus in the chirally controlled oligonucleotide is independently Rp or Sp, and at least one is Rp and at least one is Sp. In some embodiments, the selection of Rp and Sp centers is made to confer a specific three dimensional superstructure to a chirally controlled oligonucleotide. Examples of such selections are described in further detail herein.

In some embodiments, a chiral reagent for use in accordance with the present disclosure is selected for its ability to be removed at a particular step in the above-depicted cycle. For example, in some embodiments it is desirable to remove a chiral reagent during the step of modifying the linkage phosphorus. In some embodiments, it is desirable to remove a chiral reagent before the step of modifying the linkage phosphorus. In some embodiments, it is desirable to remove a chiral reagent after the step of modifying the linkage phosphorus. In some embodiments, it is desirable to remove a chiral reagent after a first coupling step has occurred but before a second coupling step has occurred, such that a chiral reagent is not present on the growing oligonucleotide during the second coupling (and likewise for additional subsequent coupling steps). In some embodiments, a chiral reagent is removed during the "deblock" reaction that occurs after modification of the linkage phosphorus but before a subsequent cycle begins. Example methods and reagents for removal are described herein.

In some embodiments, removal of chiral auxiliary is achieved when performing the modification and/or deblocking step, as illustrated in Scheme I. It can be beneficial to combine chiral auxiliary removal together with other transformations, such as modification and deblocking. A person of ordinary skill in the art would appreciate that the saved steps/transformation could improve the overall efficiency of synthesis, for instance, with respect to yield and product purity, especially for longer oligonucleotides. One example wherein the chiral auxiliary is removed during modification and/or deblocking is illustrated in Scheme I.

In some embodiments, a chiral reagent for use in accordance with methods of the present disclosure is characterized in that it is removable under certain conditions. For instance, in some embodiments, a chiral reagent is selected for its ability to be removed under acidic conditions. In certain embodiments, a chiral reagent is selected for its ability to be removed under mildly acidic conditions. In certain embodiments, a chiral reagent is selected for its ability to be removed by way of an E1 elimination reaction (e.g., removal occurs due to the formation of a cation intermediate on the chiral reagent under acidic conditions, causing the chiral reagent to cleave from the oligonucleotide). In some embodiments, a chiral reagent is characterized in that it has a structure recognized as being able to accommodate or facilitate an E1 elimination reaction. One of skill in the relevant arts will appreciate which structures would be envisaged as being prone toward undergoing such elimination reactions.

In some embodiments, a chiral reagent is selected for its ability to be removed with a nucleophile. In some embodiments, a chiral reagent is selected for its ability to be removed with an amine nucleophile. In some embodiments, a chiral reagent is selected for its ability to be removed with a nucleophile other than an amine.

In some embodiments, a chiral reagent is selected for its ability to be removed with a base. In some embodiments, a chiral reagent is selected for its ability to be removed with an amine. In some embodiments, a chiral reagent is selected for its ability to be removed with a base other than an amine.

Additional chiral auxiliaries and their use can be found in e.g., Wada I (JP4348077; WO2005/014609; WO2005/092909), Wada II (WO2010/064146), Wada III (WO2012/039448), Chiral Control (WO2010/064146), etc.

Activation

An achiral H-phosphonate moiety is treated with the first activating reagent to form the first intermediate. In one embodiment, the first activating reagent is added to the reaction mixture during the condensation step. Use of the first activating reagent is dependent on reaction conditions such as solvents that are used for the reaction. Examples of the first activating reagent are phosgene, trichloromethyl chloroformate, bis(trichloromethyl)carbonate (BTC), oxalyl chloride, $Ph_3PCl_2$, $(PhO)_3PCl_2$, N,N'-bis(2-oxo-3-oxazolidinyl)phosphinic chloride (BopCl), 1,3-dimethyl-2-(3-nitro-1,2,4-triazol-1-yl)-2-pyrrolidin-1-yl-1,3,2-diazaphospholidinium hexafluorophosphate (MNTP), or 3-nitro-1,2,4-triazol-1-yl-tris(pyrrolidin-1-yl)phosphonium hexafluorophosphate (PyNTP).

The example of achiral H-phosphonate moiety is a compound shown in the above Scheme. DBU represents 1,8-diazabicyclo[5.4.0]undec-7-ene. $1-1^+DBU$ may be, for example, ammonium ion, alkylammonium ion, heteroaromatic iminium ion, or heterocyclic iminium ion, any of which is primary, secondary, tertiary or quaternary, or a monovalent metal ion.

Reacting with Chiral Reagent

After the first activation step, the activated achiral H-phosphonate moiety reacts with a chiral reagent, which is represented by formula (Z-I) or (Z-I'), to form a chiral intermediate of formula (Z-Va), (Z-Vb), (Z-Va'), or (Z-Vb').

Stereospecific Condensation Step

A chiral intermediate of Formula Z-Va ((Z-Vb), (Z-Va'), or (Z-Vb')) is treated with the second activating reagent and a nucleoside to form a condensed intermediate. The nucleoside may be on solid support. Examples of the second activating reagent are 4,5-dicyanoimidazole (DCI), 4,5-dichloroimidazole, 1-phenylimidazolium triflate (PhIMT), benzimidazolium triflate (BIT), benztriazole, 3-nitro-1,2,4-triazole (NT), tetrazole, 5-ethylthiotetrazole (ETT), 5-benzylthiotetrazole (BTT), 5-(4-nitrophenyl)tetrazole, N-cyanomethylpyrrolidinium triflate (CMPT), N-cyanomethylpiperidinium triflate, N-cyanomethyldimethylammonium triflate. A chiral intermediate of Formula Z-Va ((Z-Vb), (Z-Va'), or (Z-Vb')) may be isolated as a monomer. Usually, the chiral intermediate of Z-Va ((Z-Vb), (Z-Va'), or (Z-Vb')) is not isolated and undergoes a reaction in the same pot with a nucleoside or modified nucleoside to provide a chiral phosphite compound, a condensed intermediate. In other embodiments, when the method is performed via solid phase synthesis, the solid support comprising the compound is filtered away from side products, impurities, and/or reagents.

Capping Step

If the final nucleic acid is larger than a dimer, the unreacted —OH moiety is capped with a blocking group and the chiral auxiliary in the compound may also be capped with a blocking group to form a capped condensed intermediate. If the final nucleic acid is a dimer, then the capping step is not necessary.

Modifying Step

The compound is modified by reaction with an electrophile. The capped condensed intermediate may be executed modifying step. In some embodiments, the modifying step is performed using a sulfur electrophile, a selenium electrophile or a boronating agent. Examples of modifying steps are step of oxidation and sulfurization.

In some embodiments of the method, the sulfur electrophile is a compound having one of the following formulas:

$Z^{z1}$—S—S—$Z^{z2}$, or $Z^{z1}$—S-$_{V_z}$-$Z^{z2}$;  $S_8$ (Formula Z-B), wherein $Z^{z1}$ and $Z^{z2}$ are independently alkyl, aminoalkyl, cycloalkyl, heterocyclic, cycloalkylalkyl, heterocycloalkyl, aryl, heteroaryl, alkyloxy, aryloxy, heteroaryloxy, acyl, amide, imide, or thiocarbonyl, or $Z^{z1}$ and $Z^{z2}$ are taken together to form a 3 to 8 membered alicyclic or heterocyclic ring, which may be substituted or unsubstituted; $v_z$ is $SO_2$, O, or $NR^f$; and $R^f$ is hydrogen, alkyl, alkenyl, alkynyl, or aryl.

In some embodiments of the method, the sulfur electrophile is a compound of following Formulae Z-A, Z-B, Z-C, Z-D, E, or Z-F:

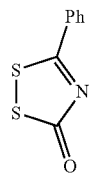
Formula Z-A $S_8$
Formula Z-B

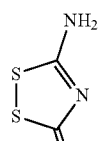
Formula Z-C

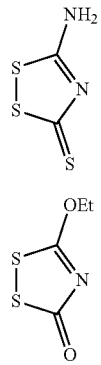
Formula Z-D

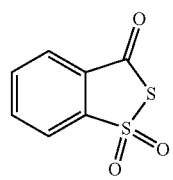
Formula Z-E

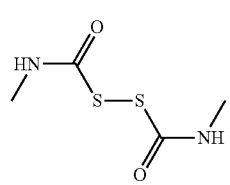
Formula Z-F

In some embodiments, a sulfurization reagent is 3-phenyl-1,2,4-dithiazolin-5-one.

In some embodiments, the selenium electrophile is a compound having one of the following formulae:

$Z^{z3}$—Se—Se—$Z^{z4}$, or $Z^{z3}$—Se-$_{V_z}$-$Z^{z4}$;  Se (Formula Z-G), wherein $Z^{z3}$ and $Z^{z4}$ are independently alkyl, aminoalkyl, cycloalkyl, heterocyclic, cycloalkylalkyl, heterocycloalkyl, aryl, heteroaryl, alkyloxy, aryloxy, heteroaryloxy, acyl, amide, imide, or thiocarbonyl, or $Z^{z3}$ and $Z^{z4}$ are taken together to form a 3 to 8 membered alicyclic or heterocyclic ring, which may be substituted or unsubstituted; vz is $SO_2$, S, O, or $NR^f$; and $R^f$ is hydrogen, alkyl, alkenyl, alkynyl, or aryl.

In some embodiments, the selenium electrophile is a compound of Formula Z-G, Z-H, Z-I, Z-J, Z-K, or Z-L.

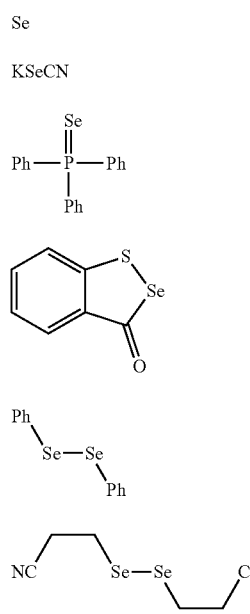

Formula Z-G
Formula Z-H
Formula Z-I
Formula Z-J
Formula Z-K
Formula Z-L

In some embodiments, the boronating agent is borane-N, N-diisopropylethylamine ($BH_3$ DIPEA), borane-pyridine ($BH_3$ Py), borane-2-chloropyridine ($BH_3$ CPy), borane-aniline ($BH_3$ An), borane-tetrahydrofiirane ($BH_3$ THF), or borane-dimethylsulfide ($BH_3$ $Me_2S$).

Additional sulfur electrophiles are known in the art and can be utilized in accordance with the present disclosure.

In some embodiments, after the modifying step, a chiral auxiliary group falls off from the growing oligonucleotide chain. In some embodiments, after the modifying step, a chiral auxiliary group remains connected to the internucleotidic phosphorus atom.

In some embodiments of the method, the modifying step is an oxidation step. In some embodiments of the method, the modifying step is an oxidation step using similar conditions as described above in this application. In some embodiments, an oxidation step is as disclosed in, e.g., JP 2010-265304 A and WO2010/064146.

In some embodiments, the present disclosure provides modifying reagents for introducing non-negatively charged internucleotidic linkages including neutral internucleotidic linkages.

In some embodiments, a P(III) linkage can be converted into a non-negatively charged internucleotidic linkage by reacting the P(III) linkage with an azide or an azido imidazolinium salt (e.g., a compound comprising

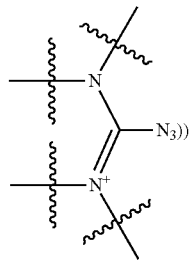

under suitable conditions. In some embodiments, an azido imidazolinium salt is a salt of $PF_6^-$. In some embodiments, an azido imidazolinium salt is a slat of

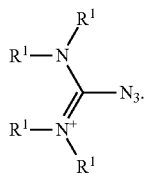

In some embodiments, an azido imidazolinium salt is 2-azido-1,3-dimethylimidazolinium hexafluorophosphate.

In some embodiments, a P(III) linkage is reacted with an electrophile having the structure of R-$G^Z$, wherein R is as described in the present disclosure, and $G^Z$ is a leaving group, e.g., —Cl, —Br, —I, -OTf, -Oms, -OTosyl, etc. In some embodiments, R is —$CH_3$. In some embodiments, R is —$CH_2CH_3$. In some embodiments, R is —$CH_2CH_2CH_3$. In some embodiments, R is —$CH_2OCH_3$. In some embodiments, R is $CH_3CH_2OCH_2$—. In some embodiments, R is $PhCH_2OCH_2$—. In some embodiments, R is HC≡C—$CH_2$—. In some embodiments, R is $H_3C$—C≡C—$CH_2$—. In some embodiments, R is $CH_2$=$CHCH_2$—. In some embodiments, R is $CH_3SCH_2$—. In some embodiments, R is —$CH_2COOCH_3$. In some embodiments, R is —$CH_2COOCH_2CH_3$. In some embodiments, R is —$CH_2CONHCH_3$.

Chain Elongation Cycle and De-Protection Step

The capped condensed intermediate is deblocked to remove the blocking group at the 5'-end of the growing nucleic acid chain to provide a compound. The compound is optionally allowed to re-enter the chain elongation cycle to form a condensed intermediate, a capped condensed intermediate, a modified capped condensed intermediate, and a 5'-deprotected modified capped intermediate. Following at least one round of chain elongation cycle, the 5'-deprotected modified capped intermediate is further deblocked by removal of the chiral auxiliary ligand and other protecting groups for, e.g., nucleobase, modified nucleobase, sugar and modified sugar protecting groups, to provide a nucleic acid. In other embodiments, the nucleoside comprising a 5'-OH moiety is an intermediate from a previous chain elongation cycle as described herein. In yet other embodiments, the nucleoside comprising a 5'-OH moiety is an intermediate obtained from another known nucleic acid synthetic method. In embodiments where a solid support is used, the phosphorus-atom modified nucleic acid is then cleaved from the solid support. In certain embodiments, the nucleic acids is left attached on the solid support for purification purposes and then cleaved from the solid support following purification.

In yet other embodiments, the nucleoside comprising a 5'-OH moiety is an intermediate obtained from another known nucleic acid synthetic method. In yet other embodiments, the nucleoside comprising a 5'-OH moiety is an intermediate obtained from another known nucleic acid synthetic method as described in this application. In yet other embodiments, the nucleoside comprising a 5'-OH moiety is an intermediate obtained from another known nucleic acid synthetic method comprising one or more cycles illustrated in Scheme I. In yet other embodiments, the nucleoside comprising a 5'-OH moiety is an intermediate obtained from another known nucleic acid synthetic method comprising one or more cycles illustrated in Scheme I-b, I-c or I-d.

In some embodiments, the present disclosure provides oligonucleotide synthesis methods that use stable and commercially available materials as starting materials. In some embodiments, the present disclosure provides oligonucleotide synthesis methods to produce stereocontrolled phosphorus atom-modified oligonucleotide derivatives using an achiral starting material.

In some embodiments, the method of the present disclosure does not cause degradations under the de-protection steps. Further the method does not require special capping agents to produce phosphorus atom-modified oligonucleotide derivatives.

Condensing Reagent

Condensing reagents ($C_R$) useful in accordance with methods of the present disclosure are of any one of the following general formulae:

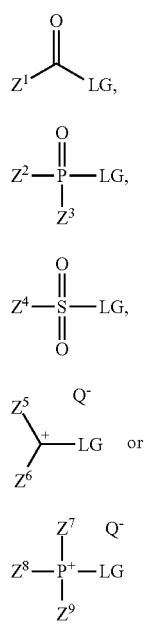

$C_R1$ $C_R2$ $C_R3$ $C_R4$ $C_R5$ wherein $Z^1$, $Z^2$, $Z^3$, $Z^4$, $Z^5$, $Z^6$, $Z^7$, $Z^8$, and $Z^9$ are independently optionally substituted group selected from alkyl, aminoalkyl, cycloalkyl, heterocyclic, cycloalkylalkyl, heterocycloalkyl, aryl, heteroaryl, alkyloxy, aryloxy, or heteroaryloxy, or wherein any of $Z^2$ and $Z^3$, $Z^5$ and $Z^6$, $Z^7$ and $Z^8$, $Z^8$ and $Z^9$, $Z^9$ and $Z^7$, or $Z^7$ and $Z^8$ and $Z^9$ are taken together to form a 3 to 20 membered alicyclic or heterocyclic ring; $Q^-$ is a counter anion; and LG is a leaving group.

In some embodiments, a counter ion of a condensing reagent $C_R$ is $Cl^-$, $Br^-$, $BF_4^-$, $PF_6^-$, $TfO^-$, $Tf_2N^-$, $AsF_6^-$, $ClO_4^-$, or $SbF_6^-$, wherein Tf is $CF_3SO_2$. In some embodiments, a leaving group of a condensing reagent CR is F, Cl, Br, I, 3-nitro-1,2,4-triazole, imidazole, alkyltriazole, tetrazole, pentafluorobenzene, or 1-hydroxybenzotriazole.

Examples of condensing reagents used in accordance with methods of the present disclosure include, but are not limited to, pentafluorobenzoyl chloride, carbonyldiimidazole (CDI), 1-mesitylenesulfonyl-3-nitrotriazole (MSNT), 1-ethyl-3-(3'-dimethylaminopropyl)carbodiimide hydrochloride (EDCI-HCl), benzotriazole-1-yloxytris(dimethylamino)phosphonium hexafluorophosphate (PyBOP), N,N'-bis(2-oxo-3-oxazolidinyl)phosphinic chloride (BopCl), 2-(1H-7-azabenzotriazol-1-yl)-1,1,3,3-tetramethyluronium hexafluorophosphate (HATU), and O-benzotriazole-N,N,N',N'-tetramethyluronium hexafluorophosphate (HBTU), DIPCDI; N,N'-bis(2-oxo-3-oxazolidinyl)phosphinic bromide (BopBr), 1,3-dimethyl-2-(3-nitro-1,2,4-triazol-1-yl)-2-pyrrolidin-1-yl-1,3,2-diazaphospholidinium hexafluorophosphate (MNTP), 3-nitro-1,2,4-triazol-1-yl-tris(pyrrolidin-1-yl)phosphonium hexafluorophosphate (PyNTP), bromotripyrrolidinophosphonium hexafluorophosphate (PyBrOP); O-(benzotriazol-1-yl)-N,N,N',N'-tetramethyluronium tetrafluoroborate (TBTU); and tetramethylfluoroformamidinium hexafluorophosphate (TFFH). In certain embodiments, a counter ion of the condensing reagent $C_R$ is $Cl^-$, $Br^-$, $BF_4^-$, $PF_6^-$, $TfO^-$, $Tf_2N^-$, $AsF_6^-$, $ClO_4^-$, or $SbF_6^-$, wherein Tf is $CF_3SO_2$.

In some embodiments, a condensing reagent is 1-(2,4,6-triisopropylbenzenesulfonyl)-5-(pyridin-2-yl) tetrazolide, pivaloyl chloride, bromotrispyrrolidinophosphonium hexafluorophosphate, N,N'-bis(2-oxo-3-oxazolidinyl) phosphinic chloride (BopCl), or 2-chloro-5,5-dimethyl-2-oxo-1,3,2-dioxaphosphinane. In some embodiment, a condensing reagent is N,N'-bis(2-oxo-3-oxazolidinyl)phosphinic chloride (BopCl). In some embodiments, a condensing reagent is selected from those described in WO/2006/066260.

In some embodiments, a condensing reagent is 1,3-dimethyl-2-(3-nitro-1,2,4-triazol-1-yl)-2-pyrrolidin-1-yl-1,3,2-diazaphospholidinium hexafluorophosphate (MNTP), or 3-nitro-1,2,4-triazol-1-yl-tris(pyrrolidin-1-yl)phosphonium hexafluorophosphate (PyNTP):

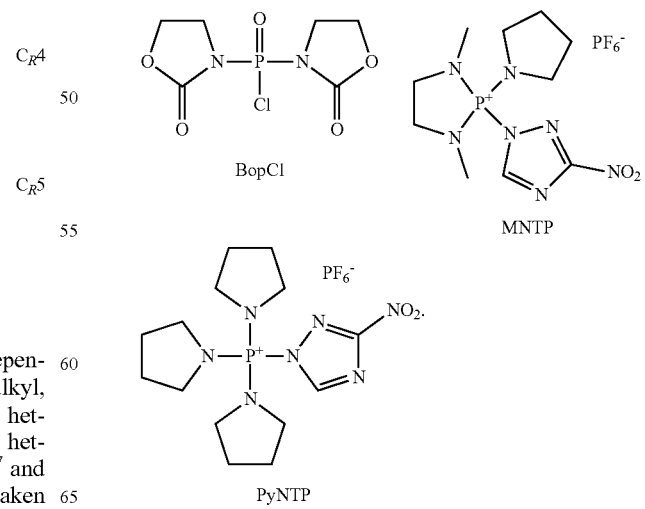

BopCl

MNTP

PyNTP

Selection of Base and Sugar of Nucleoside Coupling Partner

As described herein, nucleoside coupling partners for use in accordance with methods of the present disclosure can be the same as one another or can be different from one another. In some embodiments, nucleoside coupling partners for use in the synthesis of a provided oligonucleotide are of the same structure and/or stereochemical configuration as one another. In some embodiments, each nucleoside coupling partner for use in the synthesis of a provided oligonucleotide is not of the same structure and/or stereochemical configuration as certain other nucleoside coupling partners of the oligonucleotide. Example nucleobases and sugars for use in accordance with methods of the present disclosure are described herein. One of skill in the relevant chemical and synthetic arts will recognize that any combination of nucleobases and sugars described herein are contemplated for use in accordance with methods of the present disclosure.

Coupling Step

Example coupling procedures and chiral reagents and condensing reagents for use in accordance with the present disclosure are outlined in, inter alia, Wada I (JP4348077; WO2005/014609; WO2005/092909), Wada II (WO2010/064146), Wada III (WO2012/039448), and Chiral Control (WO2010/064146). Chiral nucleoside coupling partners for use in accordance with the present disclosure are also referred to herein as "Wada amidites." In some embodiments, a coupling partner has the structure of

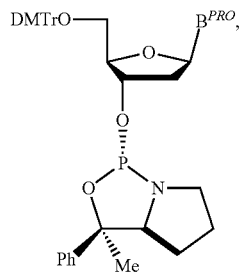

wherein $B^{PRO}$ is a protected nucleobase. In some embodiments, a coupling partner has the structure of

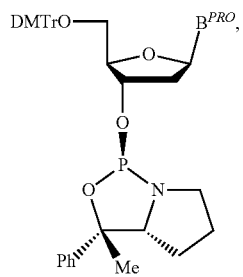

wherein $B^{PRO}$ is a protected nucleobase. In some embodiments, a coupling partner has the structure of

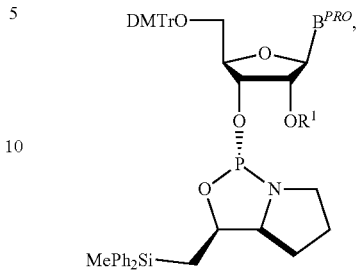

wherein $B^{PRO}$ is a protected nucleobase, and $R^1$ is as defined and described herein. In some embodiments, a coupling partner has the structure of

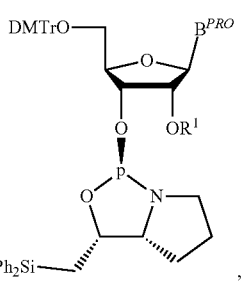

wherein $B^{PRO}$ is a protected nucleobase, and $R^1$ is as defined and described herein. In some embodiments, $R^1$ is optionally substituted $C_{1-6}$ alkyl. In some embodiments, $R^1$ is Me.

In some embodiments, the present disclosure provides a compound, which can be used as a phosphoramidite in oligonucleotide synthesis, having the structure of a formula selected from:

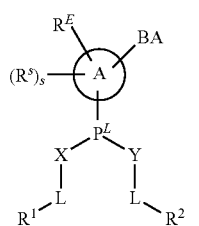

P-I

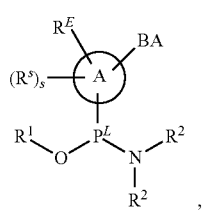

P-II

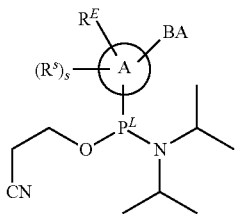

P-III

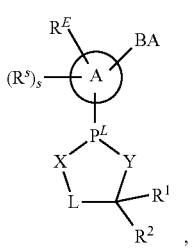

P-IV

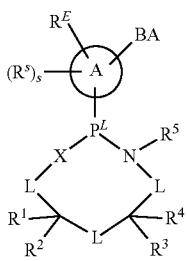

P-V

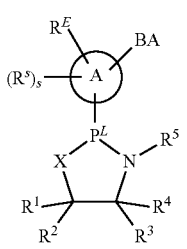

P-VI

, and

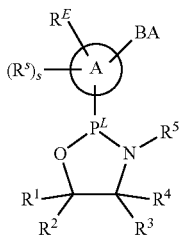

P-VII or a salt thereof, wherein:

$R^E$ is a 5'-end group;

each BA is independently an optionally substituted group selected from $C_{1-30}$ cycloaliphatic, $C_{6-30}$ aryl, $C_{5-30}$ heteroaryl having 1-10 heteroatoms, $C_{3-30}$ heterocyclyl having 1-10 heteroatoms, a natural nucleobase moiety, and a modified nucleobase moiety;

each $R^s$ is independently —F, —Cl, —Br, —I, —CN, —N$_3$, —NO, —NO$_2$, -L-R', -L-OR', -L-SR', -L-N(R')$_2$, —O-L-OR', —O-L-SR', or —O-L-N(R')$_2$;

each of $R^1$, $R^2$, $R^3$, $R^4$ and $R^5$ is independently $R^5$;

s is 0-20;

each L is independently a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N (R')—, —N(R')C(O)O—, —S(O)—, —S(O)$_2$—, —S(O)$_2$N (R')—, —C(O)S—, —C(O)O—, —P(O)(OR')—, —P(O) (SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP (NR')O—, —OP(R')O—, or —OP(OR')[B(R')$_3$]O—; and one or more carbon atoms are optionally and independently replaced with $Cy^L$;

each $Cy^L$ is independently an optionally substituted tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each Ring A is independently an optionally substituted 3-20 membered monocyclic, bicyclic or polycyclic ring having 0-10 heteroatoms;

$P^L$ is P(=W), P, or P→B(R')$_3$;

W is O, S or Se;

each of X and Y is independently —O—, —S—, —N(-L-R$^1$), or L;

each R' is independently —R, —C(O)R, —C(O)OR, or —S(O)$_2$R;

each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or:

two or more R groups on the same atom are optionally and independently taken together with the atom to form an optionally substituted, 3-30 membered monocyclic, bicyclic or polycyclic ring having, in addition to the atom, 0-10 heteroatoms; or two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms.

In some embodiments, each heteroatom is independently selected from oxygen, sulfur, nitrogen, silicon, boron and phosphorus. In some embodiments, each heteroatom is independently selected from oxygen, sulfur, nitrogen, or silicon.

In some embodiments, a provided compound has the structure of formula P-I. In some embodiments, a provided compound has the structure of formula P-II. In some embodiments, a provided compound has the structure of formula P-III. In some embodiments, a provided compound has the structure of formula P-IV. In some embodiments, a provided compound has the structure of formula P-V. In some embodiments, a provided compound has the structure of formula P-VI. In some embodiments, a provided compound has the structure of formula P-VII.

In some embodiments, $P^L$ is P=O. In some embodiments, $P^L$ is P=S. In some embodiments, $P^L$ is P.

In some embodiments, each of $R^1$ and $R^2$ is independently hydrogen or an optionally substituted group selected from $C_{1-6}$ aliphatic and $C_{6-14}$ aryl. In some embodiments, each of $R^1$ and $R^2$ is independently an optionally substituted group selected from $C_{1-6}$ aliphatic and $C_{6-14}$ aryl. In some embodiments, one of $R^1$ and $R^2$ is optionally substituted $C_{1-6}$ aliphatic and the other is optionally substituted $C_{6-14}$ aryl. In some embodiments, one of $R^1$ and $R^2$ is optionally substituted methyl and the other is optionally substituted phenyl. In some embodiments, one of $R^1$ and $R^2$ is hydrogen and the other is an optionally substituted group selected from $C_{1-6}$ aliphatic and $C_{6-14}$ aryl. In some embodiments, one of $R^1$ and $R^2$ is hydrogen and the other is optionally substituted phenyl. In some embodiments, one of $R^1$ and $R^2$ is hydrogen and the other is phenyl. In some embodiments, one of $R^1$ and $R^2$ is hydrogen and the other is an optionally substituted $C_{1-6}$ aliphatic. In some embodiments, one of $R^1$ and $R^2$ is hydrogen and the other is $-CH_2Si(R)_3$, wherein the $-CH_2-$ is optionally substituted. In some embodiments, one of $R^1$ and $R^2$ is hydrogen and the other is $-CH_2SiMe(Ph)_2$. In some embodiments, one of $R^3$ and $R^4$ is hydrogen and the other is taken together with $R^5$ to form an optionally substituted, saturated or partially saturated, monocyclic, bicyclic or polycyclic 3-10 membered ring having, in addition to the nitrogen to which $R^5$ is bonded, 0-5 heteroatoms. In some embodiments, one of $R^3$ and $R^4$ is hydrogen and the other is taken together with $R^5$ to form an optionally substituted, saturated, monocyclic, 3-7 membered ring having no heteroatoms other than the nitrogen to which $R^5$ is bonded. In some embodiments, one of $R^3$ and $R^4$ is hydrogen and the other is taken together with $R^5$ to form an optionally substituted, saturated, monocyclic, 5-6 membered ring having no heteroatoms other than the nitrogen to which $R^5$ is bonded. In some embodiments, one of $R^3$ and $R^4$ is hydrogen and the other is taken together with $R^5$ to form an optionally substituted, saturated, monocyclic, 5-membered ring having no heteroatoms other than the nitrogen to which $R^5$ is bonded. In some embodiments, one of $R^3$ and $R^4$ is hydrogen and the other is taken together with $R^5$ to form a saturated, monocyclic, 5-membered ring having no heteroatoms other than the nitrogen to which $R^5$ is bonded. In some embodiments, one of $R^3$ and $R^4$ is hydrogen and the other is taken together with $R^5$ to form optionally substituted

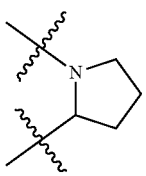

In some embodiments, one of $R^3$ and $R^4$ is hydrogen and the other is taken together with $R^5$ to form

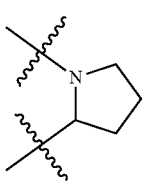

In some embodiments, the one of $R^1$ and $R^2$ being hydrogen and the one of $R^3$ and $R^4$ being hydrogen is syn. In some embodiments, $R^1$ and $R^3$ are hydrogen and they are syn to each other.

In some embodiments, variables are of such structures that

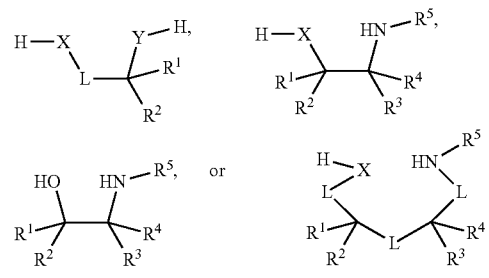

is a chiral reagent or chiral auxiliary described in the present disclosure. In some embodiments, a chiral reagent has the structure of

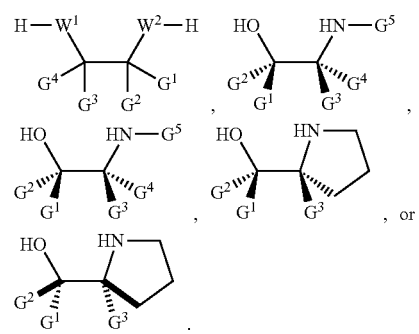

In some embodiments, a chiral reagent has the structure of

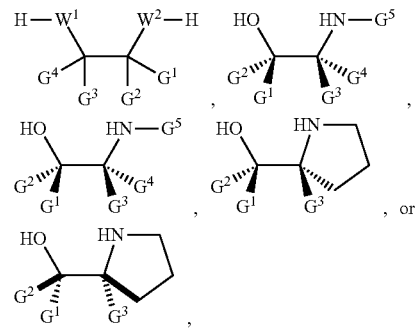

wherein $-W^1H$ and $-W^2H$, or the hydroxyl and amino groups, form bonds with the phosphorus atom of the phosphoramidite. In some embodiments, a provided compound, e.g., a phosphoramidite, has the structure of

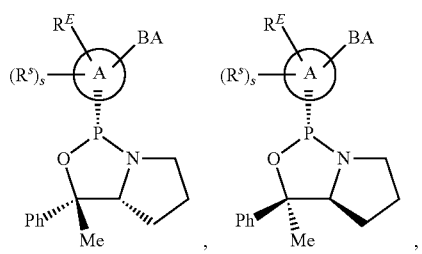

-continued

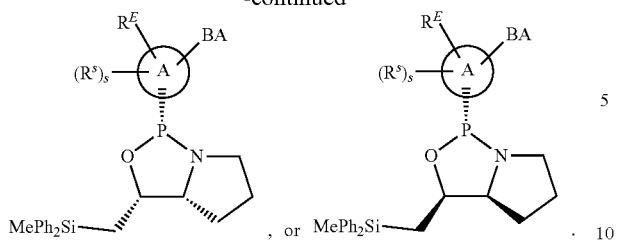
, or

In some embodiments, a provided compound has the structure of

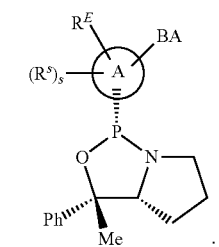

In some embodiments, a provided compound has the structure of

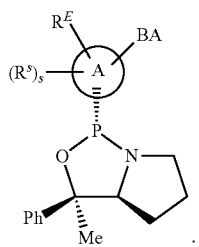

In some embodiments, a provided compound has the structure of

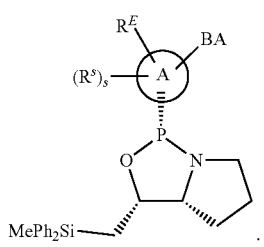

In some embodiments, a provided compound has the structure of

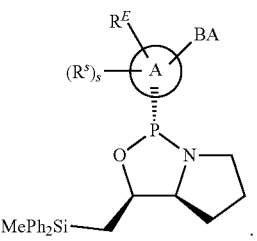

In some embodiments, Ring A is

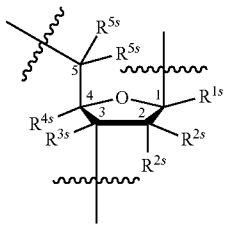

BA is connected at C1, and each of $R^{1s}$, $R^{2s}$, $R^{3s}$, $R^{4s}$ and $R^{5s}$ is independently $R^s$. In some embodiments, Ring A is

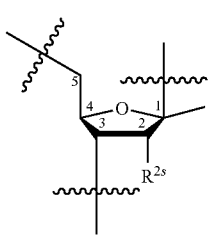

In some embodiments, Ring A is

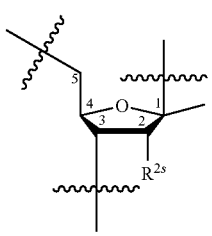

wherein $R^{2s}$ is not —OH. In some embodiments, Ring A is

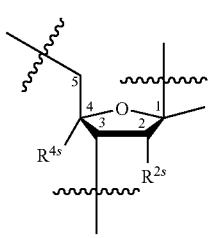

wherein $R^{2s}$ and $R^{4s}$ are R, and the two R groups are taken together with their intervening atoms to form a ring. In some embodiments, Ring A is optionally substituted

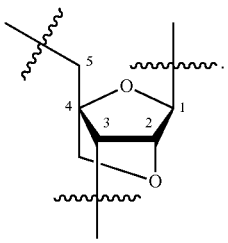

In some embodiments, Ring A is

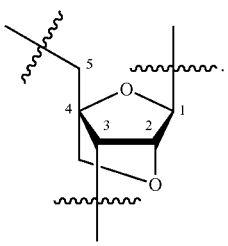 [SMILES: *C[C@]12CO[C@@H](C1*)[C@H](*)O2]

In some embodiments, Ring A is

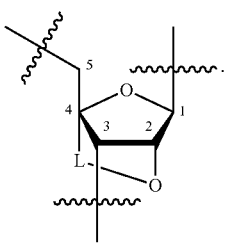

In some embodiments, BA is an optionally substituted group selected from $C_{1-30}$ cycloaliphatic, $C_{6-30}$ aryl, $C_{5-30}$ heteroaryl having 1-10 heteroatoms, and $C_{3-30}$ heterocyclyl having 1-10 heteroatoms. In some embodiments, BA is an optionally substituted group selected from $C_{6-30}$ aryl, $C_{5-30}$ heteroaryl having 1-10 heteroatoms, and $C_{3-30}$ heterocyclyl having 1-10 heteroatoms. In some embodiments, BA is an optionally substituted group selected from heteroaryl having 1-10 heteroatoms, and $C_{3-30}$ heterocyclyl having 1-10 heteroatoms. In some embodiments, BA is an optionally substituted $C_{5-30}$ heteroaryl group having 1-10 heteroatoms. In some embodiments, BA is optionally substituted or protected adenine, cytosine, guanosine, thymine, or uracil. In some embodiments, BA is optionally substituted adenine, cytosine, guanosine, thymine, or uracil. In some embodiments, BA is protected adenine, cytosine, guanosine, thymine, or uracil. Protected nucleobases suitable for oligonucleotide synthesis are widely known in the art, for example, those described in WO/2010/064146, WO/2011/005761, WO/2013/012758, WO/2014/010250, US2013/0178612, WO/2014/012081, WO/2015/107425, WO2017/015555, and WO2017/062862, the protected nucleobases of each of which is incorporated herein by reference, and can be utilized in accordance with the present disclosure. In some embodiments, BA is optionally substituted adenine. In some embodiments, BA is protected adenine. BA is optionally substituted thymine. In some embodiments, BA is protected thymine. BA is optionally substituted cytosine. In some embodiments, BA is protected cytosine. BA is optionally substituted uracil. In some embodiments, BA is protected uracil. BA is optionally substituted guanosine. In some embodiments, BA is protected guanosine. In some embodiments, BA is

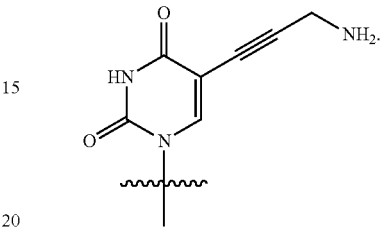

In some embodiments, BA is

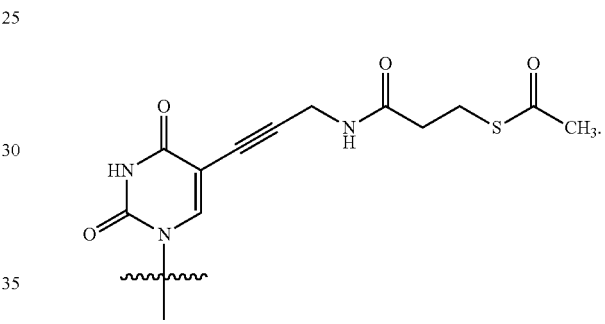

Example $R^E$ groups are extensively described in the present disclosure. For example, in some embodiments, $R^E$ is —CHR—O—RS, wherein R is —H or optionally substituted $C_{1-4}$ aliphatic, and $R^s$ is hydroxyl protecting group. In some embodiments, R is methyl and $R^s$ is DMTr. In some embodiments, $R^E$ is —(R)—CH(Me)-ODMTr. In some embodiments, $R^E$ is —(S)—CH(Me)-ODMTr. In some embodiments, $R^E$ is -L-P(O)(OR)$_2$. In some embodiments, $R^E$ is -L-P(O)(OR)$_2$, wherein each R is independently optionally substituted $C_{1-6}$ aliphatic. In some embodiments, -L- is -(E)-CH=CH—. In some embodiments, $R^E$ is -(E)-CH=CH—P(O)(OR)$_2$. In some embodiments, $R^E$ is -(E)-CH=CH—P(O)(OR)$_2$, wherein each R is independently optionally substituted $C_{1-6}$ aliphatic. In some embodiments, $R^E$ is -(E)-CH=CH—P(O)(OMe)$_2$.

In some embodiments, is

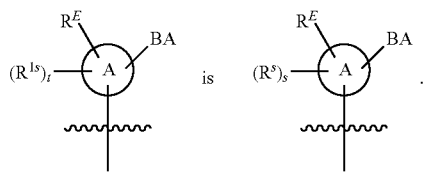

In some embodiments,
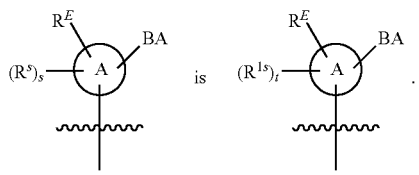
In some embodiments, is
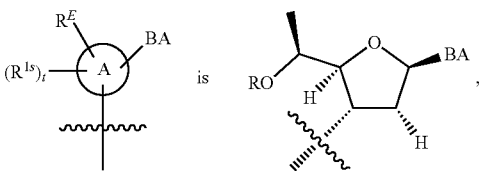
wherein R is a hydroxyl protecting group. In some embodiments, R is DMTr-. In some embodiments,
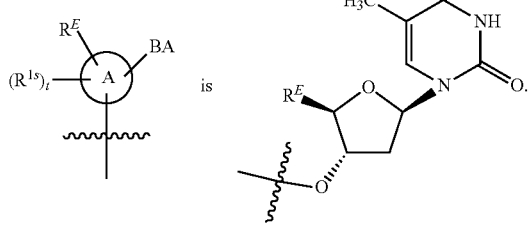
wherein R is a hydroxyl protecting group. In some embodiments, R is DMTr-.
In some embodiments, a provided compound, e.g., a provided phosphoramidite, is
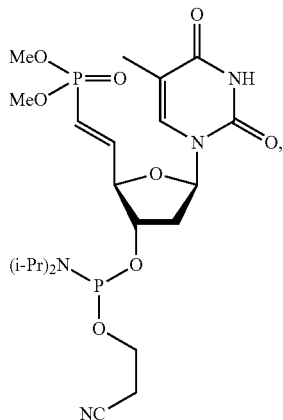
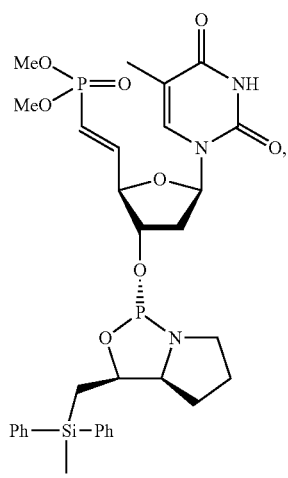

729
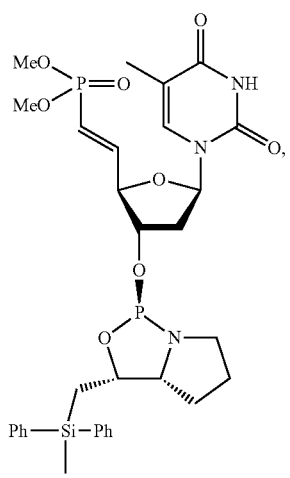
730
-continued
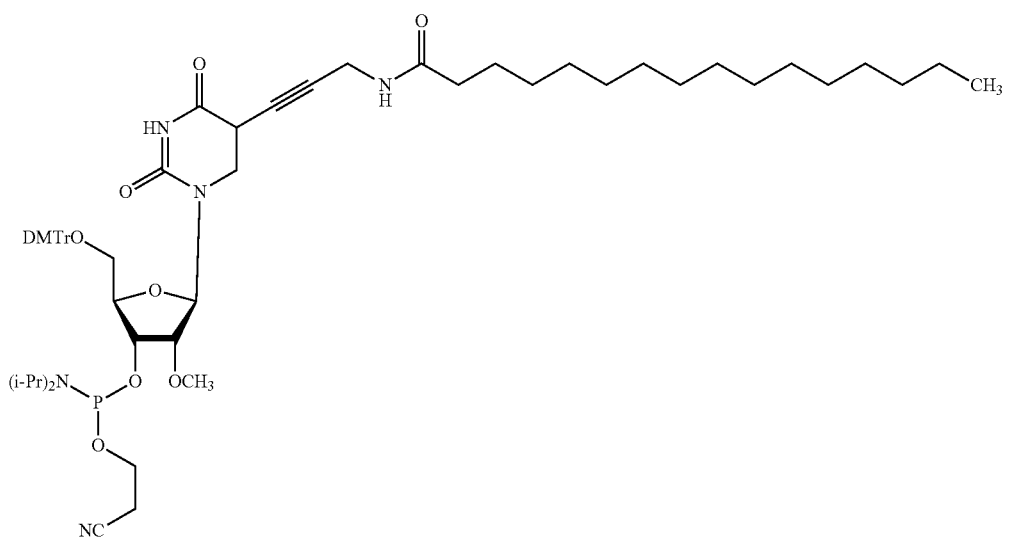
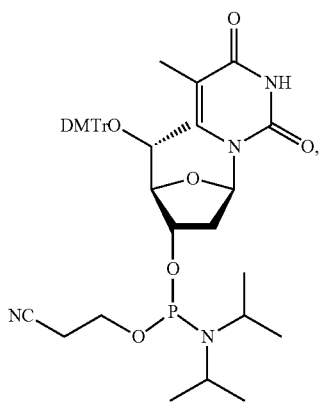

731
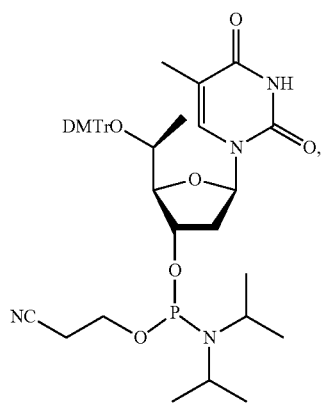
-continued
732
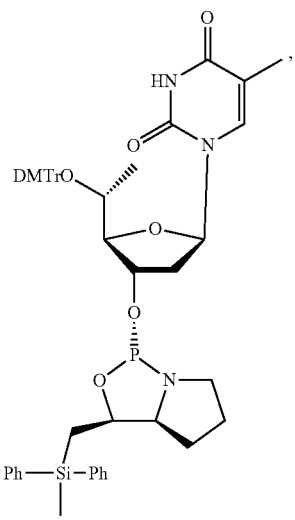
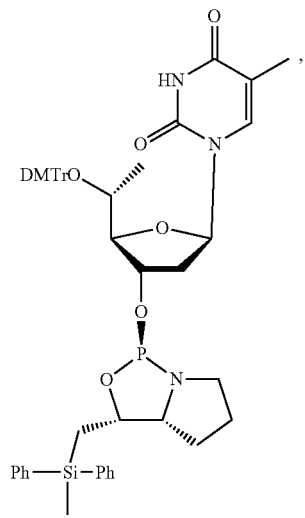

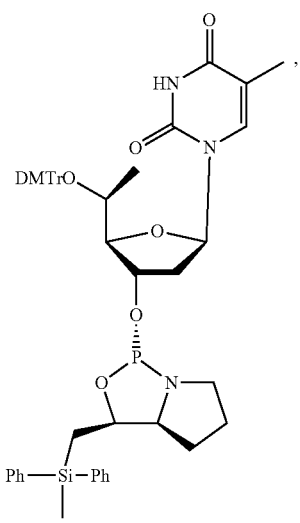
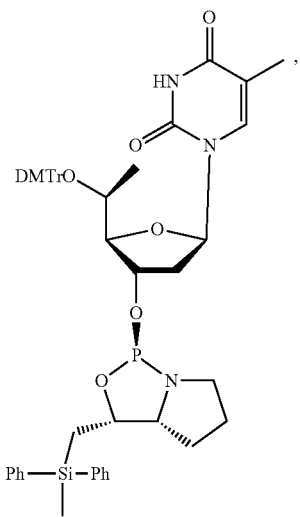
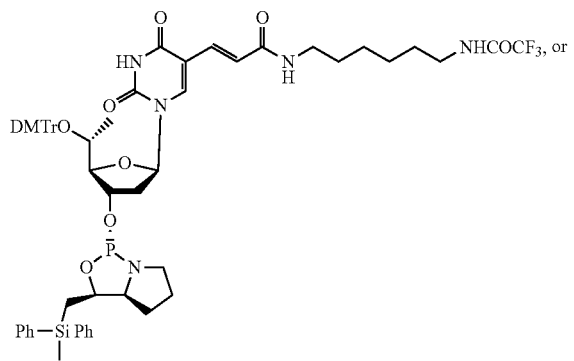

735
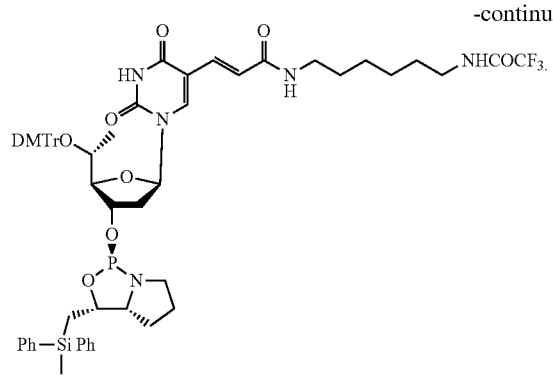
-continued
Example chiral phosphoramidites as coupling partner are depicted below:
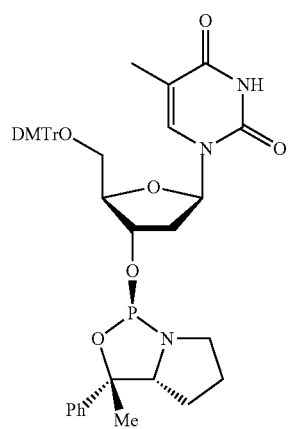
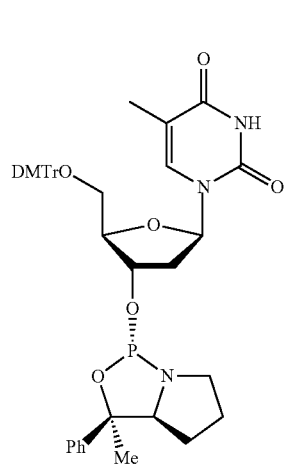
736
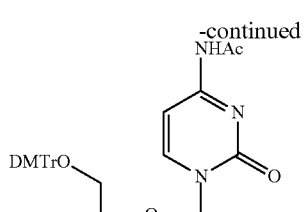
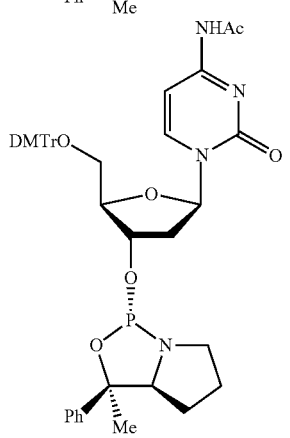
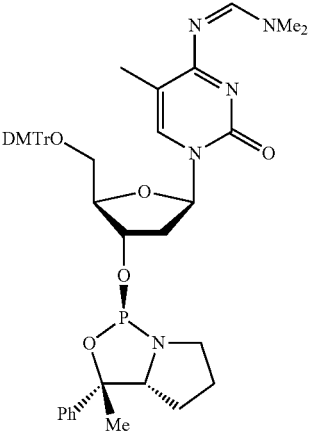

737
-continued
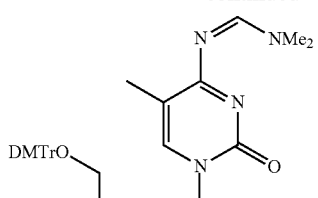
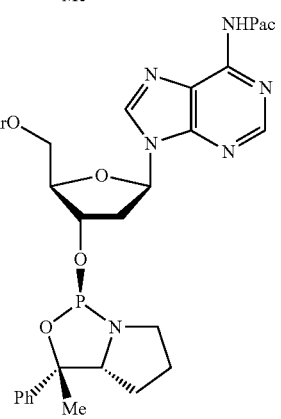
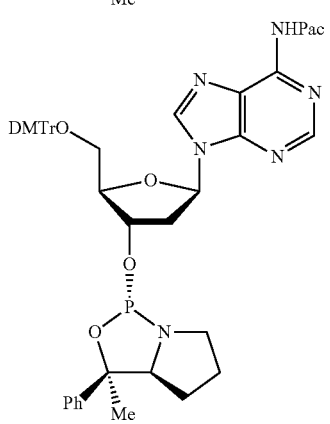
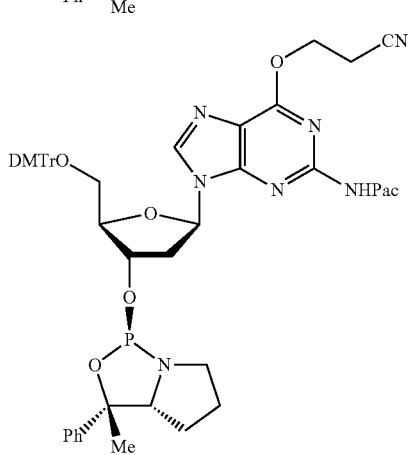
738
-continued
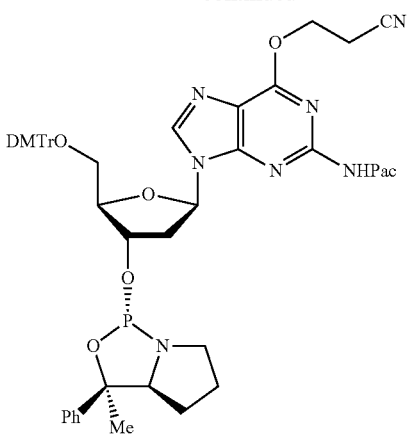
Additional examples are described in WO/2010/064146, WO/2011/005761, WO/2013/012758, WO/2014/010250, US2013/0178612, WO/2014/012081, WO/2015/107425, WO/2017/015555, and WO/2017/062862, the phosphoramidites of each of which is incorporated herein by reference.
One of the methods used for synthesizing the coupling partner is depicted in Scheme II, below.
Scheme II. Example Synthesis of Coupling Partner.
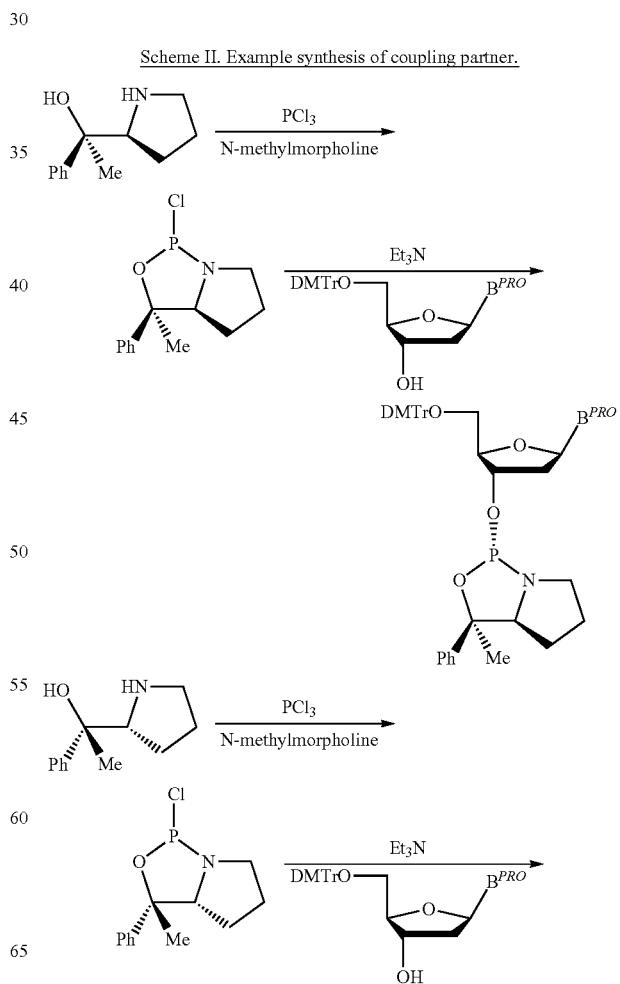

-continued

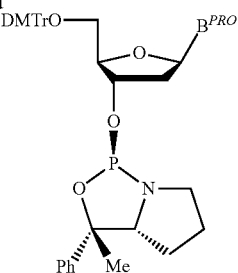

In some embodiments, the step of coupling comprises reacting a free hydroxyl group of a nucleotide unit of an oligonucleotide with a nucleoside coupling partner under suitable conditions to effect the coupling. In some embodiments, the step of coupling is preceded by a step of deblocking. For instance, in some embodiments, the 5' hydroxyl group of the growing oligonucleotide is blocked (i.e., protected) and must be deblocked in order to subsequently react with a nucleoside coupling partner.

Once the appropriate hydroxyl group of the growing oligonucleotide has been deblocked, the support is washed and dried in preparation for delivery of a solution comprising a chiral reagent and a solution comprising an activator. In some embodiments, a chiral reagent and an activator are delivered simultaneously. In some embodiments, co-delivery comprises delivering an amount of a chiral reagent in solution (e.g., a phosphoramidite solution) and an amount of activator in a solution (e.g., a CMPT solution) in a polar aprotic solvent such as a nitrile solvent (e.g., acetonitrile).

In some embodiments, the step of coupling provides a crude product composition in which the chiral phosphite product is present in a diastereomeric excess of >95%. In some embodiments, the chiral phosphite product is present in a diastereomeric excess of >96%. In some embodiments, the chiral phosphite product is present in a diastereomeric excess of >97%. In some embodiments, the chiral phosphite product is present in a diastereomeric excess of >98%. In some embodiments, the chiral phosphite product is present in a diastereomeric excess of >99%.

Capping Step:

Provided methods for making chirally controlled oligonucleotides comprise a step of capping. In some embodiments, a step of capping is a single step. In some embodiments, a step of capping is two steps. In some embodiments, a step of capping is more than two steps.

In some embodiments, a step of capping comprises steps of capping the free amine of the chiral auxiliary and capping any residual unreacted 5' hydroxyl groups. In some embodiments, the free amine of the chiral auxiliary and the unreacted 5' hydroxyl groups are capped with the same capping group. In some embodiments, the free amine of the chiral auxiliary and the unreacted 5' hydroxyl groups are capped with different capping groups. In certain embodiments, capping with different capping groups allows for selective removal of one capping group over the other during synthesis of the oligonucleotide. In some embodiments, the capping of both groups occurs simultaneously. In some embodiments, the capping of both groups occurs iteratively.

In certain embodiments, capping occurs iteratively and comprises a first step of capping the free amine followed by a second step of capping the free 5' hydroxyl group, wherein both the free amine and the 5' hydroxyl group are capped with the same capping group. For instance, in some embodiments, the free amine of the chiral auxiliary is capped using an anhydride (e.g., phenoxyacetic anhydride, i.e., Pac$_2$O) prior to capping of the 5' hydroxyl group with the same anhydride. In certain embodiments, the capping of the 5' hydroxyl group with the same anhydride occurs under different conditions (e.g., in the presence of one or more additional reagents). In some embodiments, capping of the 5' hydroxyl group occurs in the presence of an amine base in an etherial solvent (e.g., NMI (N-methylimidazole) in THF). The phrase "capping group" is used interchangeably herein with the phrases "protecting group" and "blocking group".

In some embodiments, an amine capping group is characterized in that it effectively caps the amine such that it prevents rearrangement and/or decomposition of the intermediate phosphite species. In some embodiments, a capping group is selected for its ability to protect the amine of the chiral auxiliary in order to prevent intramolecular cleavage of the internucleotide linkage phosphorus.

In some embodiments, a 5' hydroxyl group capping group is characterized in that it effectively caps the hydroxyl group such that it prevents the occurrence of "shortmers," e.g., "n-m" (m and n are integers and m<n; n is the number of bases in the targeted oligonucleotide) impurities that occur from the reaction of an oligonucleotide chain that fails to react in a first cycle but then reacts in one or more subsequent cycles. The presence of such shortmers, especially "n-1", has a deleterious effect upon the purity of the crude oligonucleotide and makes final purification of the oligonucleotide tedious and generally low-yielding.

In some embodiments, a particular cap is selected based on its tendency to facilitate a particular type of reaction under particular conditions. For instance, in some embodiments, a capping group is selected for its ability to facilitate an E1 elimination reaction, which reaction cleaves the cap and/or auxiliary from the growing oligonucleotide. In some embodiments, a capping group is selected for its ability to facilitate an E2 elimination reaction, which reaction cleaves the cap and/or auxiliary from the growing oligonucleotide. In some embodiments, a capping group is selected for its ability to facilitate a β-elimination reaction, which reaction cleaves the cap and/or auxiliary from the growing oligonucleotide.

Modifying Step:

As used herein, the phrase "modifying step", "modification step" and "P-modification step" are used interchangeably and refer generally to any one or more steps used to install a modified internucleotidic linkage. In some embodiments, the modified internucleotidic linkage having the structure of Formula I. A P-modification step of the present disclosure occurs during assembly of a provided oligonucleotide rather than after assembly of a provided oligonucleotide is complete. Thus, each nucleotide unit of a provided oligonucleotide can be individually modified at the linkage phosphorus during the cycle within which the nucleotide unit is installed.

In some embodiments, a suitable P-modification reagent is a sulfur electrophile, selenium electrophile, oxygen electrophile, boronating reagent, or an azide reagent.

For instance, in some embodiments, a selenium reagent is elemental selenium, a selenium salt, or a substituted diselenide. In some embodiments, an oxygen electrophile is elemental oxygen, peroxide, or a substituted peroxide. In some embodiments, a boronating reagent is a borane-amine (e.g., N,N-diisopropylethylamine (BH$_3$.DIPEA), borane-pyridine (BH$_3$.Py), borane-2-chloropyridine (BH$_3$. CPy), borane-aniline (BH$_3$. An)), a borane-ether reagent (e.g., borane-tetrahydrofuran (BH$_3$.THF)), a borane-dialkylsulfide reagent (e.g., BH$_3$.Me$_2$S), aniline-cyanoborane, or a triphenylphosphine-carboalkoxyborane. In some embodiments, an azide reagent is comprises an azide group capable of undergoing subsequent reduction to provide an amine group.

In some embodiments, a P-modification reagent is a sulfurization reagent as described herein. In some embodiments, a step of modifying comprises sulfurization of phosphorus to provide a phosphorothioate linkage or phosphorothioate triester linkage. In some embodiments, a step of modifying provides an oligonucleotide having an internucleotidic linkage of Formula I.

In some embodiments, the present disclosure provides sulfurizing reagents, and methods of making, and use of the same.

In some embodiments, such sulfurizing reagents are thiosulfonate reagents. In some embodiments, a thiosulfonate reagent has a structure of formula S-I:

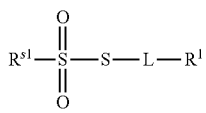

S-I wherein:
R$^{s1}$ is R; and
each of R, L and R$^1$ is independently as defined and described above and herein.

In some embodiments, the sulfurizing reagent is a bis(thiosulfonate) reagent. In some embodiments, the bis(thiosulfonate) reagent has the structure of formula S-II:

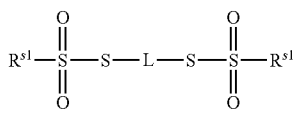

S-II wherein each of R$^{s1}$ and L is independently as defined and described above and herein.

As defined generally above, R$^{s1}$ is R, wherein R is as defined and described above and herein. In some embodiments, R$^{s1}$ is optionally substituted aliphatic, aryl, heterocyclyl or heteroaryl. In some embodiments, R$^{s1}$ is optionally substituted alkyl. In some embodiments, R$^{s1}$ is optionally substituted alkyl. In some embodiments, R$^{s1}$ is methyl. In some embodiments, R$^{s1}$ is cyanomethyl. In some embodiments, R$^{s1}$ is nitromethyl. In some embodiments, R$^{s1}$ is optionally substituted aryl. In some embodiments, R$^{s1}$ is optionally substituted phenyl. In some embodiments, R$^{s1}$ is phenyl. In some embodiments, R$^{s1}$ is p-nitrophenyl. In some embodiments, R$^{s1}$ is p-methylphenyl. In some embodiments, R$^{s1}$ is p-chlorophenyl. In some embodiments, R$^{s1}$ is o-chlorophenyl. In some embodiments, R$^{s1}$ is 2,4,6-trichlorophenyl. In some embodiments, R$^{s1}$ is pentafluorophenyl. In some embodiments, R$^{s1}$ is optionally substituted heterocyclyl. In some embodiments, R$^{s1}$ is optionally substituted heteroaryl.

In some embodiments, R$^{s1}$—S(O)$_2$S— is

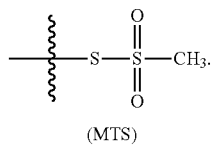

(MTS)

(MTS). In some embodiments, R$^{s1}$—S(O)$_2$S— is

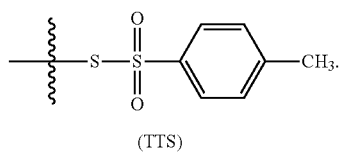

(TTS)

(TTS). In some embodiments, R$^{s1}$—S(O)$_2$S— is

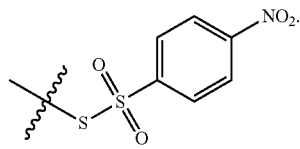

(NO$_2$PheTS)

(NO$_2$PheTS). In some embodiments, le-S(O)$_2$S— is

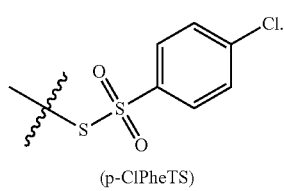 [SMILES: *SS(=O)(=O)c1ccc(Cl)cc1]

(p-ClPheTS)

(p-ClPheTS). In some embodiments, R$^{s1}$—S(O)$_2$S— is

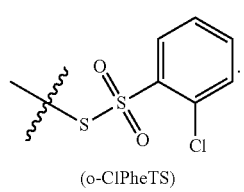 [SMILES: *SS(=O)(=O)c1ccccc1Cl]

(o-ClPheTS)

(o-ClPheTS). In some embodiments, R$^{s1}$—S(O)$_2$S— is

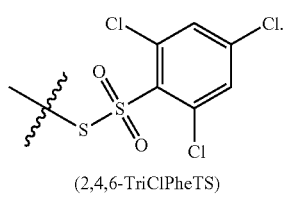 [SMILES: *SS(=O)(=O)c1c(Cl)cc(Cl)cc1Cl]

(2,4,6-TriClPheTS)

(2,4,6-TriClPheTS). In some embodiments, $R^{s1}$—S(O)$_2$S— is

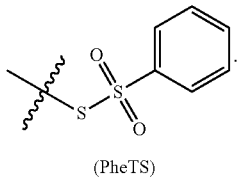 [SMILES: *SS(=O)(=O)c1ccccc1]

(PheTS)

(PheTS). In some embodiments, $R^{s1}$—S(O)$_2$S— is

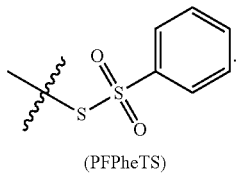 [SMILES: *SS(=O)(=O)c1ccccc1]

(PFPheTS)

(PFPheTS). In some embodiments, $R^1$—S(O)$_2$S— is

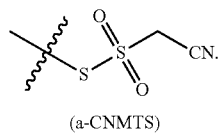 [SMILES: *SS(=O)(=O)CC#N]

(a-CNMTS)

(a-CNMTS). In some embodiments, $R^{s1}$—S(O)$_2$S— is

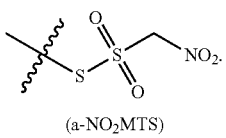

(a-NO$_2$MTS)

(a-NO$_2$MTS). In some embodiments, $R^{s1}$—S(O)$_2$S— is

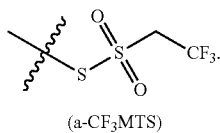

(a-CF$_3$MTS)

(a-CF$_3$MTS). In some embodiments, $R^{s1}$—S(O)$_2$S— is

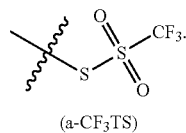

(a-CF$_3$TS)

(a-CF$_3$TS). In some embodiments, $R^{s1}$—S(O)$_2$S— is

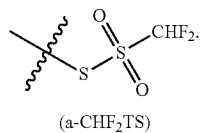

(a-CHF$_2$TS)

(a-CHF$_2$TS). In some embodiments, $R^{s1}$—S(O)$_2$S— is

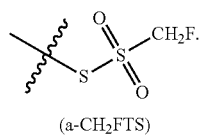

(a-CH$_2$FTS)

(a-CH$_2$FTS).

In some embodiments, the sulfurizing reagent has the structure of S-I or S-II, wherein L is —S—$R^{L3}$— or —S—C(O)—$R^{L3}$—. In some embodiments, L is —S—$R^{L3}$— or —S—C(O)—$R^{L3}$—, wherein $R^{L3}$ is an optionally substituted $C_1$-$C_6$ alkylene. In some embodiments, L is —S—$R^{L3}$— or —S—C(O)—$R^{L3}$—, wherein $R^{L3}$ is an optionally substituted $C_1$-$C_6$ alkenylene. In some embodiments, L is —S—$R^{L3}$— or —S—C(O)—$R^{L3}$—, wherein $R^{L3}$ is an optionally substituted $C_1$-$C_6$ alkylene wherein one or more methylene units are optionally and independently replaced by an optionally substituted $C_1$-$C_6$ alkenylene, arylene, or heteroarylene. In some embodiments, In some embodiments, $R^{L3}$ is an optionally substituted —S—($C_1$-$C_6$ alkenylene)-, alkylene)-, alkylene)-arylene-($C_1$-$C_6$ alkylene)-, —S—CO-arylene-($C_1$-$C_6$ alkylene)-, or —S—CO—($C_1$-$C_6$ alkylene)-arylene-($C_1$-$C_6$ alkylene)-. In some embodiments, the sulfurizing reagent has the structure of S-I or S-II, wherein L is —S—$R^{L3}$— or —S—C(O)—$R^{L3}$—, and the sulfur atom is connected to $R^1$.

In some embodiments, the sulfurizing reagent has the structure of S-I or S-II, wherein L is alkylene, alkenylene, arylene or heteroarylene.

In some embodiments, the sulfurizing reagent has the structure of S-I or S-II, wherein L is

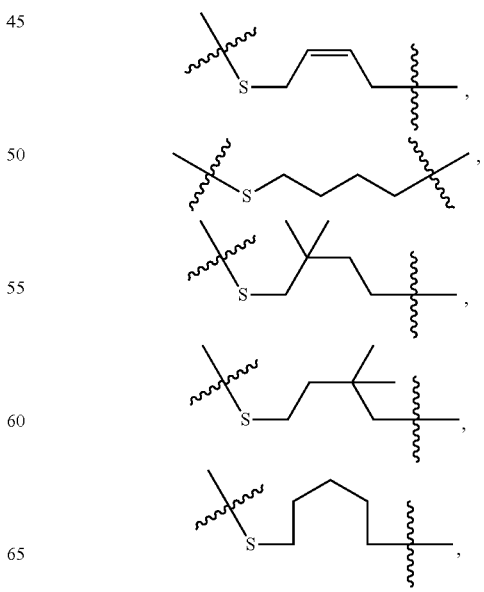

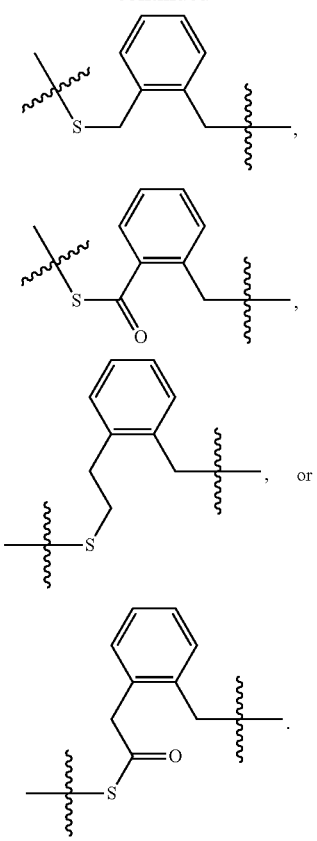
In some embodiments, L is
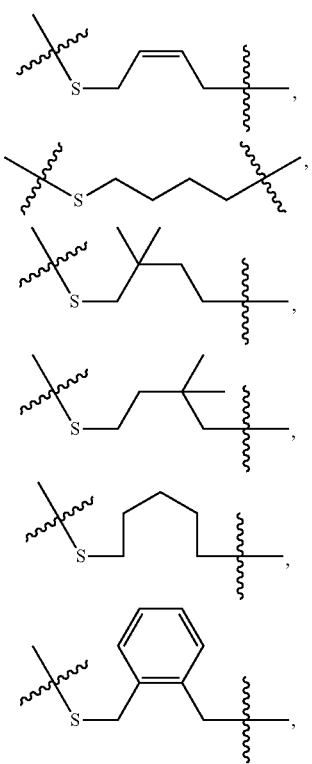
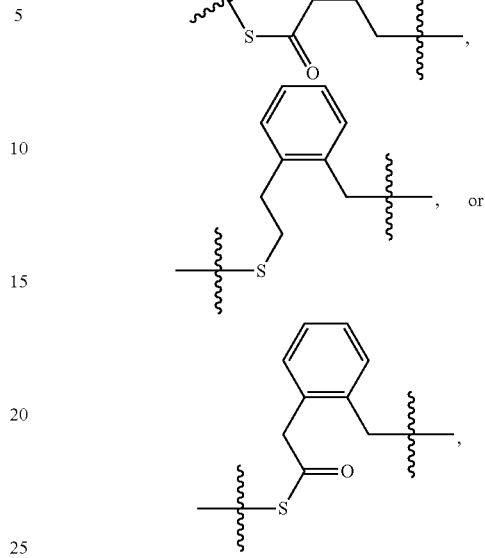
wherein the sulfur atom is connected to R¹. In some embodiments, the sulfurizing reagent has the structure of S-I or S-II, wherein R¹ is
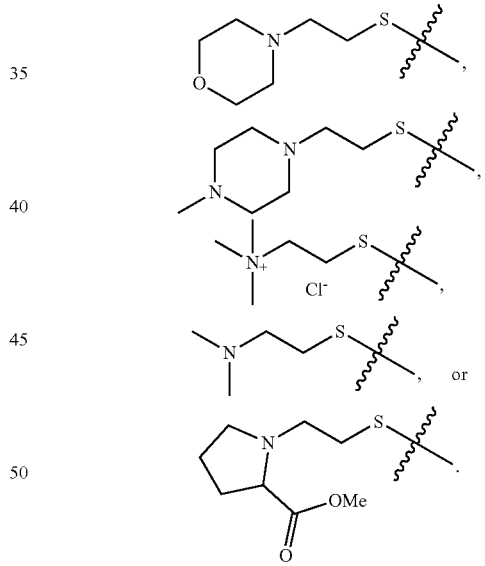
In some embodiments, R¹ is
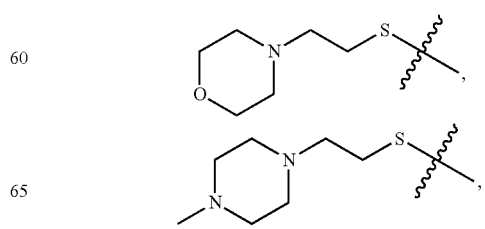

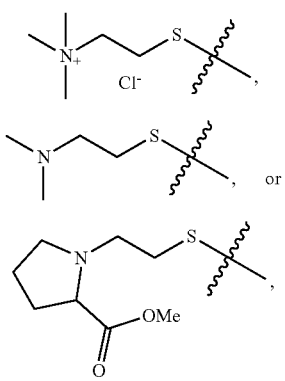

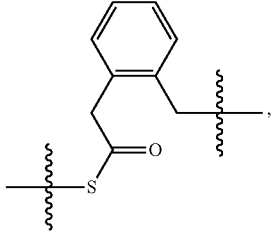

wherein the sulfur atom is connected to R¹; and R¹ is

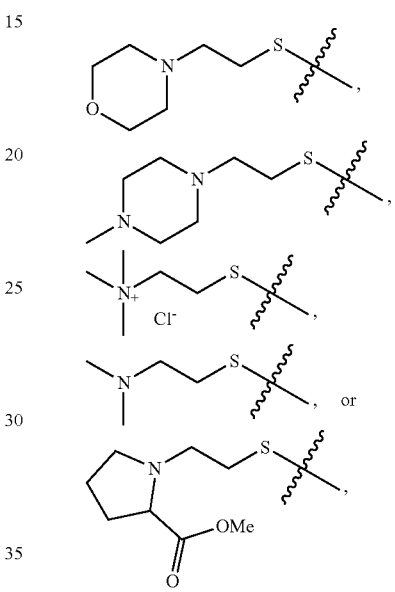

wherein the sulfur atom is connected to L. In some embodiments, the sulfurizing reagent has the structure of S-I or S-II, wherein L is

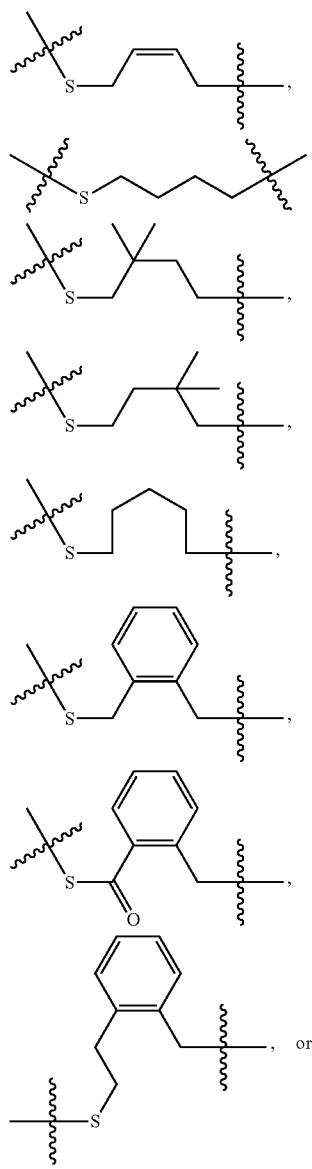

wherein the sulfur atom is connected to L.

In some embodiments, the sulfurizing reagent has the structure of S-I or S-II, wherein $R^1$ is $-S-R^{L2}$, wherein $R^{L2}$ is as defined and described above and herein. In some embodiments, $R^{L2}$ is an optionally substituted group selected from $-S-(C_1-C_6$ alkylene)-heterocyclyl, $-S-(C_1-C_6$ alkenylene)-heterocyclyl, $-S-(C_1-C_6$ alkylene)-N(R')$_2$, $-S-(C_1-C_6$ alkylene)-N(R')$_3$, wherein each R' is as defined above and described herein.

In some embodiments, -L-R¹ is $-R^{L3}-S-S-R^{L2}$, wherein each variable is independently as defined above and described herein. In some embodiments, -L-R¹ is $-R^{L3}-C(O)-S-S-R^{L2}$, wherein each variable is independently as defined above and described herein.

Example bis(thiosulfonate) reagents of formula S—II are depicted below:

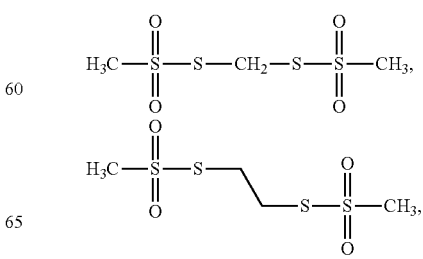

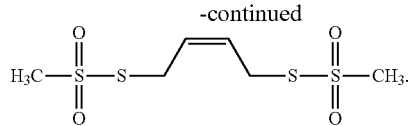

In some embodiments, the sulfurization reagent is a compound having one of the following formulae:

$S_8, R^{s2}-S-S-R^{s3}$, or $R^{s2}-S-X^s-R^{s3}$, wherein:

each of $R^{s2}$ and $R^{s3}$ is independently an optionally substituted group selected from aliphatic, aminoalkyl, carbocyclyl, heterocyclyl, heterocycloalkyl, aryl, heteroaryl, alkyloxy, aryloxy, heteroaryloxy, acyl, amide, imide, or thiocarbonyl; or $R^{s2}$ and $R^{s3}$ are taken together with the atoms to which they are bound to form an optionally substituted heterocyclic or heteroaryl ring;

$X^s$ is $-S(O)_2-$, $-O-$, or $-N(R')-$; and

R' is as defined and described above and herein.

In some embodiments, the sulfurization reagent is $S_8$,

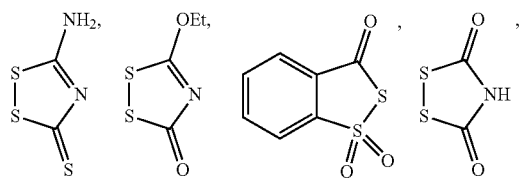

or

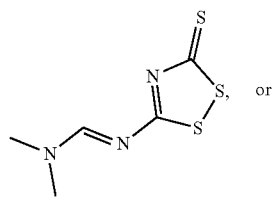

In some embodiments, the sulfurization reagent is $S_8$,

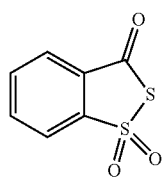, or 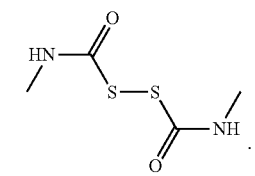

In some embodiments, the sulfurization reagent is

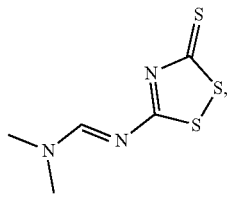

Example sulfuring reagents are depicted in below:

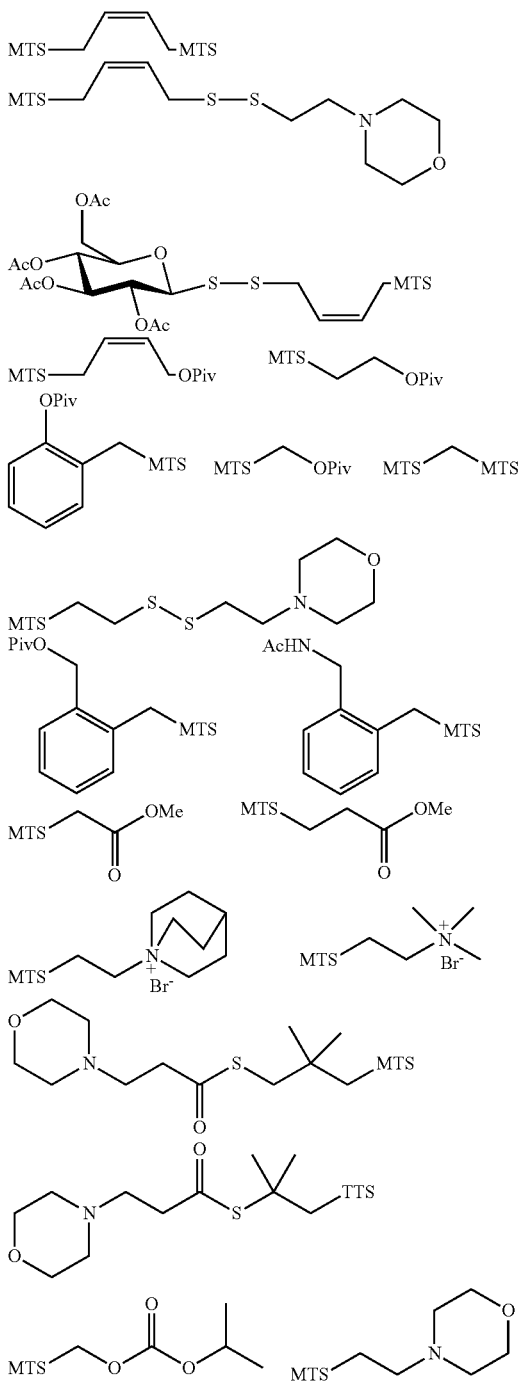

751
-continued
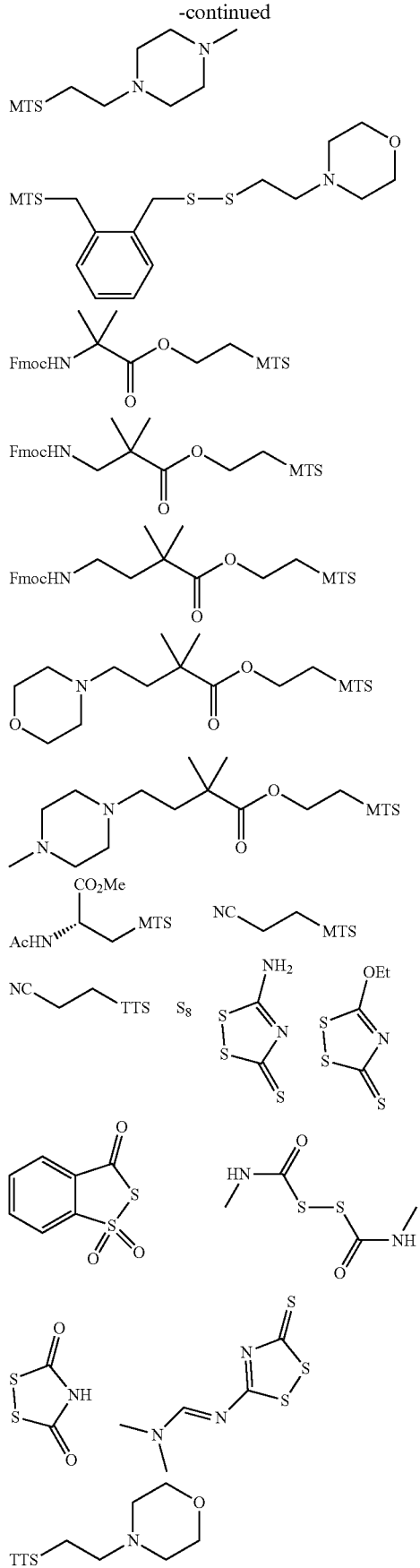
752
-continued
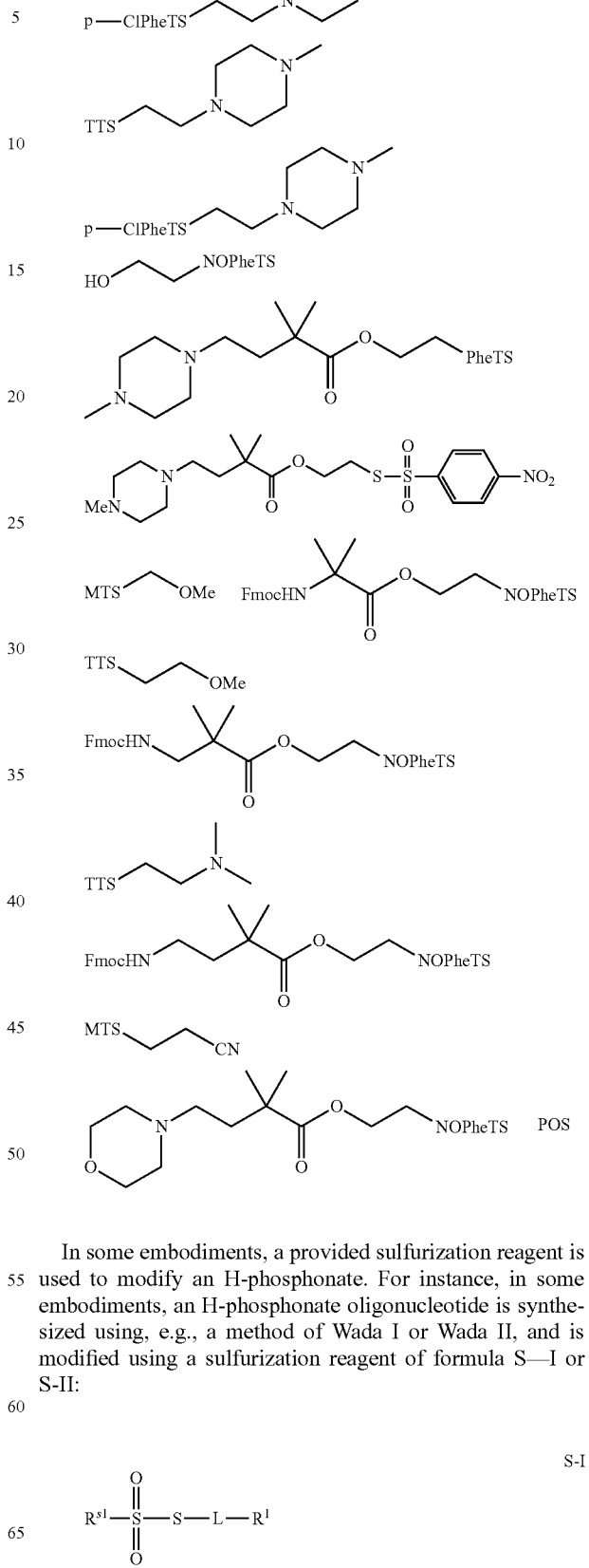
In some embodiments, a provided sulfurization reagent is used to modify an H-phosphonate. For instance, in some embodiments, an H-phosphonate oligonucleotide is synthesized using, e.g., a method of Wada I or Wada II, and is modified using a sulfurization reagent of formula S—I or S-II:
$$R^{s1}-\overset{O}{\underset{O}{S}}-S-L-R^1 \qquad \text{S-I}$$

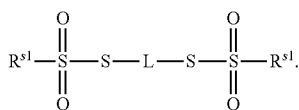

wherein each of $R^{S1}$, L, and $R^1$ are as described and defined above and herein.

In some embodiments, the present disclosure provides a process for synthesizing a phosphorothioate triester, comprising steps of:
i) reacting an H-phosphonate of structure:

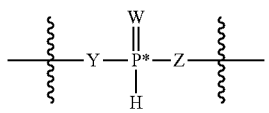

wherein each of W, Y, and Z are as described and defined above and herein, with a silylating reagent to provide a silyloxyphosphonate; and
ii) reacting the silyloxyphosphonate with a sulfurization reagent of structure S-I or S-II:

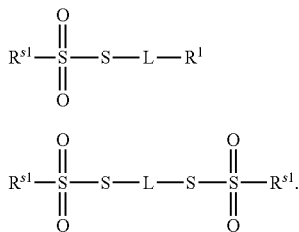

to provide a phosphorothiotriester.

In some embodiments, a selenium electrophile is used instead of a sulfurizing reagent to introduce modification to the internucleotidic linkage. In some embodiments, a selenium electrophile is a compound having one of the following formulae:

$$Se, R^{s2}-Se-Se-R^{s3}, \text{ or } R^{s2}-Se-X^5-R^{s3},$$

wherein:

each of $R^{s2}$ and $R^{s3}$ is independently an optionally substituted group selected from aliphatic, aminoalkyl, carbocyclyl, heterocyclyl, heterocycloalkyl, aryl, heteroaryl, alkyloxy, aryloxy, heteroaryloxy, acyl, amide, imide, and thiocarbonyl; or $R^{s2}$ and $R^{s3}$ are taken together with the atoms to which they are bound to form an optionally substituted heterocyclic or heteroaryl ring;

$X^s$ is $-S(O)_2-$, $-O-$, or $-N(R')-$; and

R' is as defined and described above and herein.

In other embodiments, the selenium electrophile is a compound of Se, KSeCN,

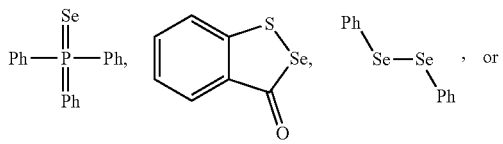

In some embodiments, the selenium electrophile is Se or

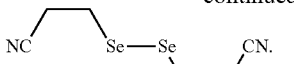

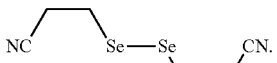

Various sulfurizing reagents and thiosulfonate reagents are known in the art and can be utilized in accordance with the present disclosure.

In some embodiments, a sulfurization reagent for use in accordance with the present disclosure is characterized in that the moiety transferred to phosphorus during sulfurization is a substituted sulfur (e.g., —SR) as opposed to a single sulfur atom (e.g., —S⁻ or ═S).

In some embodiments, a sulfurization reagent for use in accordance with the present disclosure is characterized in that the activity of the reagent is tunable by modifying the reagent with a certain electron withdrawing or donating group.

In some embodiments, a sulfurization reagent for use in accordance with the present disclosure is characterized in that it is crystalline. In some embodiments, a sulfurization reagent for use in accordance with the present disclosure is characterized in that it has a high degree of crystallinity. In certain embodiments, a sulfurization reagent for use in accordance with the present disclosure is characterized by ease of purification of the reagent via, e.g., recrystallization. In certain embodiments, a sulfurization reagent for use in accordance with the present disclosure is characterized in that it is substantially free from sulfur-containing impurities. In some embodiments, sulfurization reagents which are substantially free from sulfur-containing impurities show increased efficiency.

In some embodiments, the provided chirally controlled oligonucleotide comprises one or more phosphate diester linkages. To synthesize such chirally controlled oligonucleotides, one or more modifying steps are optionally replaced with an oxidation step to install the corresponding phosphate diester linkages. In some embodiments, the oxidation step is performed in a fashion similar to ordinary oligonucleotide synthesis. In some embodiments, an oxidation step comprises the use of $I_2$. In some embodiments, an oxidation step comprises the use of $I_2$ and pyridine. In some embodiments, an oxidation step comprises the use of 0.02 M $I_2$ in a THF/pyridine/water (70:20:10-v/v/v) co-solvent system. An example cycle is depicted in Scheme I-c.

In some embodiments, a phosphorothioate is directly formed through sulfurization by a sulfurization reagents, e.g., 3-phenyl-1,2,4-dithiazolin-5-one. In some embodiments, after a direct installation of a phosphorothioate, a chiral auxiliary group remains attached to the internucleotidic phosphorus atom. In some embodiments, an additional de-protecting step is required to remove the chiral auxiliary (e.g., for DPSE-type chiral auxiliary, using TBAF, HF-Et₃N, etc.).

In some embodiments, a phosphorothioate precursor is used to synthesize chirally controlled oligonucleotides comprising phosphorothioate linkages. In some embodiments, such a phosphorothioate precursor is

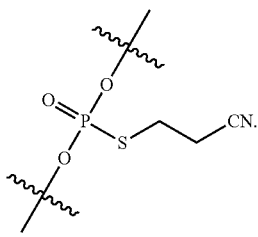

In some embodiments,

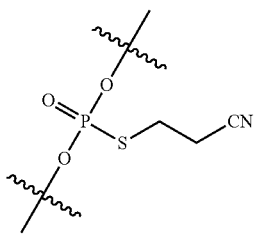

is converted into phosphorothioate diester linkages during standard deprotection/release procedure after cycle exit. Examples are further depicted below.

In some embodiments, the provided chirally controlled oligonucleotide comprises one or more phosphate diester linkages and one or more phosphorothioate diester linkages. In some embodiments, the provided chirally controlled oligonucleotide comprises one or more phosphate diester linkages and one or more phosphorothioate diester linkages, wherein at least one phosphate diester linkage is installed after all the phosphorothioate diester linkages when synthesized from 3' to 5'. To synthesize such chirally controlled oligonucleotides, in some embodiments, one or more modifying steps are optionally replaced with an oxidation step to install the corresponding phosphate diester linkages, and a phosphorothioate precursor is installed for each of the phosphorothioate diester linkages. In some embodiments, a phosphorothioate precursor is converted to a phosphorothioate diester linkage after the desired oligonucleotide length is achieved. In some embodiments, the deprotection/release step during or after cycle exit converts the phosphorothioate precursors into phosphorothioate diester linkages. In some embodiments, a phosphorothioate precursor is characterized in that it has the ability to be removed by a beta-elimination pathway. In some embodiments, a phosphorothioate precursor

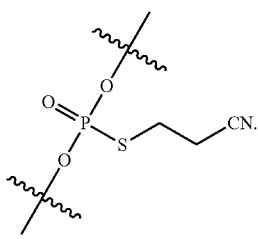

As understood by one of ordinary skill in the art, one of the benefits of using a phosphorothioate precursor, for instance,

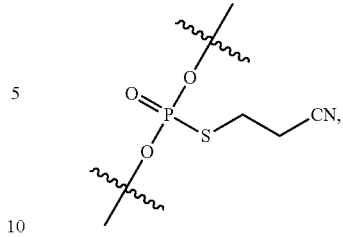

during synthesis is that

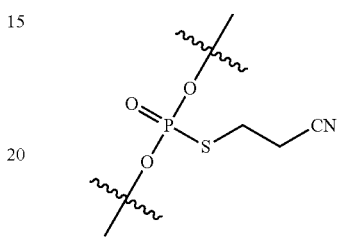

is more stable than phosphorothioate in certain conditions.

In some embodiments, a phosphorothioate precursor is a phosphorus protecting group as described herein, e.g., 2-cyanoethyl (CE or Cne), 2-trimethylsilylethyl, 2-nitroethyl, 2-sulfonylethyl, methyl, benzyl, o-nitrobenzyl, 2-(p-nitrophenyl)ethyl (NPE or Npe), 2-phenylethyl, 3-(N-tert-butylcarboxamido)-1-propyl, 4-oxopentyl, 4-methylthio-1-butyl, 2-cyano-1,1-dimethylethyl, 4-N-methylaminobutyl, 3-(2-pyridyl)-1-propyl, 2- [N-methyl-N-(2-pyridyl)] aminoethyl, 2-(N-formyl,N-methyl)aminoethyl, 4-[N-methyl-N-(2,2,2-trifluoroacetyl)amino]butyl. Examples are further depicted below.

As noted above, in some embodiments, sulfurization occurs under conditions which cleave the chiral reagent from the growing oligonucleotide. In some embodiments, sulfurization occurs under conditions which do not cleave the chiral reagent from the growing oligonucleotide.

In some embodiments, a sulfurization reagent is dissolved in a suitable solvent and delivered to the column. In certain embodiments, the solvent is a polar aprotic solvent such as a nitrile solvent. In some embodiments, the solvent is acetonitrile. In some embodiments, a solution of sulfurization reagent is prepared by mixing a sulfurization reagent (e.g., a thiosulfonate derivative as described herein) with BSTFA (N,O-bis-trimethylsilyl-trifluoroacetamide) in a nitrile solvent (e.g., acetonitrile). In some embodiments, BSTFA is not included. For example, the present inventors have found that relatively more reactive sulfurization reagents of general formula $R^{s1}$—S—$S(O)_2$—$R^{s3}$ can often successfully participate in sulfurization reactions in the absence of BSTFA. To give but one example, the inventors have demonstrated that where $R^{s2}$ is p-nitrophenyl and $R^{s3}$ is methyl then no BSTFA is required. In light of this disclosure, those skilled in the art will readily be able to determine other situations and/or sulfurization reagents that do not require BSTFA.

In some embodiments, the sulfurization step is performed at room temperature. In some embodiments, the sulfurization step is performed at lower temperatures such as about 0° C., about 5° C., about 10° C., or about 15° C. In some embodiments, the sulfurization step is performed at elevated temperatures of greater than about 20° C.

In some embodiments, a sulfurization reaction is run for about 1 minute to about 120 minutes. In some embodiments, a sulfurization reaction is run for about 1 minute to about 90 minutes. In some embodiments, a sulfurization reaction is run for about 1 minute to about 60 minutes. In some embodiments, a sulfurization reaction is run for about 1 minute to about 30 minutes. In some embodiments, a sulfurization reaction is run for about 1 minute to about 25 minutes. In some embodiments, a sulfurization reaction is run for about 1 minute to about 20 minutes. In some embodiments, a sulfurization reaction is run for about 1 minute to about 15 minutes. In some embodiments, a sulfurization reaction is run for about 1 minute to about 10 minutes. In some embodiments, a sulfurization reaction is run for about 5 minute to about 60 minutes.

In some embodiments, a sulfurization reaction is run for about 5 minutes. In some embodiments, a sulfurization reaction is run for about 10 minutes. In some embodiments, a sulfurization reaction is run for about 15 minutes. In some embodiments, a sulfurization reaction is run for about 20 minutes. In some embodiments, a sulfurization reaction is run for about 25 minutes. In some embodiments, a sulfurization reaction is run for about 30 minutes. In some embodiments, a sulfurization reaction is run for about 35 minutes. In some embodiments, a sulfurization reaction is run for about 40 minutes. In some embodiments, a sulfurization reaction is run for about 45 minutes. In some embodiments, a sulfurization reaction is run for about 50 minutes. In some embodiments, a sulfurization reaction is run for about 55 minutes. In some embodiments, a sulfurization reaction is run for about 60 minutes.

It was unexpectedly found that certain of the sulfurization modification products made in accordance with methods of the present disclosure are unexpectedly stable. In some embodiments, it the unexpectedly stable products are phosphorothioate triesters. In some embodiments, the unexpectedly stable products are chirally controlled oligonucleotides comprising one or more internucleotidic linkages having the structure of Formula I-c.

One of skill in the relevant arts will recognize that sulfurization methods described herein and sulfurization reagents described herein are also useful in the context of modifying H-phosphonate oligonucleotides such as those described in Wada II (WO2010/064146).

In some embodiments, the sulfurization reaction has a stepwise sulfurization efficiency that is at least about 80%, 85%, 90%, 95%, 96%, 97%, or 98%. In some embodiments, the sulfurization reaction provides a crude dinucleotide product composition that is at least 98% pure. In some embodiments, the sulfurization reaction provides a crude tetranucleotide product composition that is at least 90% pure. In some embodiments, the sulfurization reaction provides a crude dodecanucleotide product composition that is at least 70% pure. In some embodiments, the sulfurization reaction provides a crude icosanucleotide product composition that is at least 50% pure.

Once the step of modifying the linkage phosphorus is complete, the oligonucleotide undergoes another deblock step in preparation for re-entering the cycle. In some embodiments, a chiral auxiliary remains intact after sulfurization and is deblocked during the subsequent deblock step, which necessarily occurs prior to re-entering the cycle. The process of deblocking, coupling, capping, and modifying, are repeated until the growing oligonucleotide reaches a desired length, at which point the oligonucleotide can either be immediately cleaved from the solid support or left attached to the support for purification purposes and later cleaved. In some embodiments, one or more protecting groups are present on one or more of the nucleotide bases, and cleavage of the oligonucleotide from the support and deprotection of the bases occurs in a single step. In some embodiments, one or more protecting groups are present on one or more of the nucleotide bases, and cleavage of the oligonucleotide from the support and deprotection of the bases occurs in more than one step. In some embodiments, deprotection and cleavage from the support occurs under basic conditions using, e.g., one or more amine bases. In certain embodiments, the one or more amine bases comprise propyl amine. In certain embodiments, the one or more amine bases comprise pyridine.

In some embodiments, cleavage from the support and/or deprotection occurs at elevated temperatures of about 30° C. to about 90° C. In some embodiments, cleavage from the support and/or deprotection occurs at elevated temperatures of about 40° C. to about 80° C. In some embodiments, cleavage from the support and/or deprotection occurs at elevated temperatures of about 50° C. to about 70° C. In some embodiments, cleavage from the support and/or deprotection occurs at elevated temperatures of about 60° C. In some embodiments, cleavage from the support and/or deprotection occurs at ambient temperatures.

Example purification procedures are described herein and/or are known generally in the relevant arts.

Noteworthy is that the removal of the chiral auxiliary from the growing oligonucleotide during each cycle is beneficial for at least the reasons that (1) the auxiliary will not have to be removed in a separate step at the end of the oligonucleotide synthesis when potentially sensitive functional groups are installed on phosphorus; and (2) unstable phosphorus-auxiliary intermediates prone to undergoing side reactions and/or interfering with subsequent chemistry are avoided. Thus, removal of the chiral auxiliary during each cycle makes the overall synthesis more efficient.

While the step of deblocking in the context of the cycle is described above, additional general methods are included below.

Deblocking Step

In some embodiments, the step of coupling is preceded by a step of deblocking. For instance, in some embodiments, the 5' hydroxyl group of the growing oligonucleotide is blocked (i.e., protected) and must be deblocked in order to subsequently react with a nucleoside coupling partner.

In some embodiments, acidification is used to remove a blocking group. In some embodiments, the acid is a Brønsted acid or Lewis acid. Useful Brønsted acids are carboxylic acids, alkylsulfonic acids, arylsulfonic acids, phosphoric acid and its derivatives, phosphonic acid and its derivatives, alkylphosphonic acids and their derivatives, arylphosphonic acids and their derivatives, phosphinic acid, dialkylphosphinic acids, and diarylphosphinic acids which have a pKa (25° C. in water) value of −0.6 (trifluoroacetic acid) to 4.76 (acetic acid) in an organic solvent or water (in the case of 80% acetic acid). The concentration of the acid (1 to 80%) used in the acidification step depends on the acidity of the acid. Consideration to the acid strength must be taken into account as strong acid conditions will result in depurination/depyrimidination, wherein purinyl or pyrimidinyl bases are cleaved from ribose ring and or other sugar ring. In some embodiments, an acid is selected from $R^{a1}COOH$, $R^{a1}SO_3H$, $R^{a3}SO_2H$

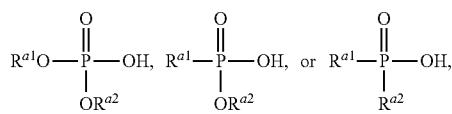

wherein each of $R^{a1}$ and $R^{a2}$ is independently hydrogen or an optionally substituted alkyl or aryl, and $R^{a3}$ is an optionally substituted alkyl or aryl.

In some embodiments, acidification is accomplished by a Lewis acid in an organic solvent. Examples of such useful Lewis acids are $Zn(X^a)_2$ wherein $X^a$ is Cl, Br, I, or $CF_3SO_3$.

In some embodiments, the step of acidifying comprises adding an amount of a Brønsted or Lewis acid effective to remove a blocking group without removing purine moieties from the condensed intermediate.

Acids that are useful in the acidifying step also include, but are not limited to 10% phosphoric acid in an organic solvent, 10% hydrochloric acid in an organic solvent, 1% trifluoroacetic acid in an organic solvent, 3% dichloroacetic acid or trichloroacetic acid in an organic solvent or 80% acetic acid in water. The concentration of any Brønsted or Lewis acid used in this step is selected such that the concentration of the acid does not exceed a concentration that causes cleavage of a nucleobase from a sugar moiety.

In some embodiments, acidification comprises adding 1% trifluoroacetic acid in an organic solvent. In some embodiments, acidification comprises adding about 0.1% to about 8% trifluoroacetic acid in an organic solvent. In some embodiments, acidification comprises adding 3% dichloroacetic acid or trichloroacetic acid in an organic solvent. In some embodiments, acidification comprises adding about 0.1% to about 10% dichloroacetic acid or trichloroacetic acid in an organic solvent. In some embodiments, acidification comprises adding 3% trichloroacetic acid in an organic solvent. In some embodiments, acidification comprises adding about 0.1% to about 10% trichloroacetic acid in an organic solvent. In some embodiments, acidification comprises adding 80% acetic acid in water. In some embodiments, acidification comprises adding about 50% to about 90%, or about 50% to about 80%, about 50% to about 70%, about 50% to about 60%, about 70% to about 90% acetic acid in water. In some embodiments, the acidification comprises the further addition of cation scavengers to an acidic solvent. In certain embodiments, the cation scavengers can be triethylsilane or triisopropylsilane. In some embodiments, a blocking group is deblocked by acidification, which comprises adding 1% trifluoroacetic acid in an organic solvent. In some embodiments, a blocking group is deblocked by acidification, which comprises adding 3% dichloroacetic acid in an organic solvent. In some embodiments, a blocking group is deblocked by acidification, which comprises adding 3% trichloroacetic acid in an organic solvent. In some embodiments, a blocking group is deblocked by acidification, which comprises adding 3% trichloroacetic acid in dichloromethane.

In certain embodiments, methods of the present disclosure are completed on a synthesizer and the step of deblocking the hydroxyl group of the growing oligonucleotide comprises delivering an amount solvent to the synthesizer column, which column contains a solid support to which the oligonucleotide is attached. In some embodiments, the solvent is a halogenated solvent (e.g., dichloromethane). In certain embodiments, the solvent comprises an amount of an acid. In some embodiments, the solvent comprises an amount of an organic acid such as, for instance, trichloroacetic acid. In certain embodiments, the acid is present in an amount of about 1% to about 20% w/v. In certain embodiments, the acid is present in an amount of about 1% to about 10% w/v. In certain embodiments, the acid is present in an amount of about 1% to about 5% w/v. In certain embodiments, the acid is present in an amount of about 1 to about 3% w/v. In certain embodiments, the acid is present in an amount of about 3% w/v. Methods for deblocking a hydroxyl group are described further herein. In some embodiments, the acid is present in 3% w/v is dichloromethane.

In some embodiments, the chiral auxiliary is removed before the deblocking step. In some embodiments, the chiral auxiliary is removed during the deblocking step.

In some embodiments, cycle exit is performed before the deblocking step. In some embodiments, cycle exit is preformed after the deblocking step.

General Conditions for Blocking Group/Protecting Group Removal

Functional groups such as hydroxyl or amino moieties which are located on nucleobases or sugar moieties are routinely blocked with blocking (protecting) groups (moieties) during synthesis and subsequently deblocked. In general, a blocking group renders a chemical functionality of a molecule inert to specific reaction conditions and can later be removed from such functionality in a molecule without substantially damaging the remainder of the molecule (see e.g., Green and Wuts, Protective Groups in Organic Synthesis, 2nd Ed., John Wiley & Sons, New York, 1991). For example, amino groups can be blocked with nitrogen blocking groups such as phthalimido, 9-fluorenylmethoxycarbonyl (FMOC), triphenylmethylsulfenyl, t-BOC, 4,4'-dimethoxytrityl (DMTr), 4-methoxytrityl (MMTr), 9-phenylxanthin-9-yl (Pixyl), trityl (Tr), or 9-(p-methoxyphenyl)xanthin-9-yl (MOX). Carboxyl groups can be protected as acetyl groups. Hydroxy groups can be protected such as tetrahydropyranyl (THP), t-butyldimethylsilyl (TBDMS), 1-[(2-chloro-4-methyl)phenyl]-4-methoxypiperidin-4-yl (Ctmp), 1-(2-fluorophenyl)-4-methoxypiperidin-4-yl (Fpmp), 1-(2-chloroethoxy)ethyl, 3-methoxy-1,5-dicarbomethoxypentan-3-yl (MDP), bis(2-acetoxyethoxy)methyl (ACE), triisopropylsilyloxymethyl (TOM), 1-(2-cyanoethoxy)ethyl (CEE), 2-cyanoethoxymethyl (CEM), [4-(N-dichloroacetyl-N-methylamino)benzyloxy]methyl, 2-cyanoethyl (CN), pivaloyloxymethyl (PivOM), levunyloxymethyl (ALE). Other representative hydroxyl blocking groups have been described (see e.g., Beaucage et al., *Tetrahedron*, 1992, 46, 2223). In some embodiments, hydroxyl blocking groups are acid-labile groups, such as the trityl, monomethoxytrityl, dimethoxytrityl, trimethoxytrityl, 9-phenylxanthin-9-yl (Pixyl) and 9-(p-methoxyphenyl)xanthin-9-yl (MOX). Chemical functional groups can also be blocked by including them in a precursor form. Thus an azido group can be considered a blocked form of an amine as the azido group is easily converted to the amine. Further representative protecting groups utilized in nucleic acid synthesis are known (see e.g. Agrawal et al., Protocols for Oligonucleotide Conjugates, Eds., Humana Press, New Jersey, 1994, Vol. 26, pp. 1-72).

Various methods are known and used for removal of blocking groups from nucleic acids. In some embodiments, all blocking groups are removed. In some embodiments, a portion of blocking groups are removed. In some embodiments, reaction conditions can be adjusted to selectively remove certain blocking groups.

In some embodiments, nucleobase blocking groups, if present, are cleavable with an acidic reagent after the assembly of a provided oligonucleotide. In some embodiment, nucleobase blocking groups, if present, are cleavable under neither acidic nor basic conditions, e.g. cleavable with fluoride salts or hydrofluoric acid complexes. In some embodiments, nucleobase blocking groups, if present, are cleavable in the presence of base or a basic solvent after the assembly of a provided oligonucleotide. In certain embodiments, one or more of the nucleobase blocking groups are characterized in that they are cleavable in the presence of base or a basic solvent after the assembly of a provided oligonucleotide but are stable to the particular conditions of one or more earlier deprotection steps occurring during the assembly of the provided oligonucleotide.

In some embodiments, blocking groups for nucleobases are not required. In some embodiments, blocking groups for nucleobases are required. In some embodiments, certain nucleobases require one or more blocking groups while other nucleobases do not require one or more blocking groups.

In some embodiments, the oligonucleotide is cleaved from the solid support after synthesis. In some embodiments, cleavage from the solid support comprises the use of propylamine. In some embodiments, cleavage from the solid support comprises the use of propylamine in pyridine. In some embodiments, cleavage from the solid support comprises the use of 20% propylamine in pyridine. In some embodiments, cleavage from the solid support comprises the use of propylamine in anhydrous pyridine. In some embodiments, cleavage from the solid support comprises the use of 20% propylamine in anhydrous pyridine. In some embodiments, cleavage from the solid support comprises use of a polar aprotic solvent such as acetonitrile, NMP, DMSO, sulfone, and/or lutidine. In some embodiments, cleavage from the solid support comprises use of solvent, e.g., a polar aprotic solvent, and one or more primary amines (e.g., a $C_{1-10}$ amine), and/or one or more of methoxylamine, hydrazine, and pure anhydrous ammonia.

In some embodiments, deprotection of oligonucleotide comprises the use of propylamine. In some embodiments, deprotection of oligonucleotide comprises the use of propylamine in pyridine. In some embodiments, deprotection of oligonucleotide comprises the use of 20% propylamine in pyridine. In some embodiments deprotection of oligonucleotide comprises the use of propylamine in anhydrous pyridine. In some embodiments, deprotection of oligonucleotide comprises the use of 20% propylamine in anhydrous pyridine.

In some embodiments, the oligonucleotide is deprotected during cleavage.

In some embodiments, cleavage of oligonucleotide from solid support, or deprotection of oligonucleotide, is performed at about room temperature. In some embodiments, cleavage of oligonucleotide from solid support, or deprotection of oligonucleotide, is performed at elevated temperature. In some embodiments, cleavage of oligonucleotide from solid support, or deprotection of oligonucleotide, is performed at above about 30° C., 40° C., 50° C., 60° C., 70° C., 80° C. 90° C. or 100° C. In some embodiments, cleavage of oligonucleotide from solid support, or deprotection of oligonucleotide, is performed at about 30° C., 40° C., 50° C., 60° C., 70° C., 80° C. 90° C. or 100° C. In some embodiments, cleavage of oligonucleotide from solid support, or deprotection of oligonucleotide, is performed at about 40-80° C. In some embodiments, cleavage of oligonucleotide from solid support, or deprotection of oligonucleotide, is performed at about 50-70° C. In some embodiments, cleavage of oligonucleotide from solid support, or deprotection of oligonucleotide, is performed at about 60° C.

In some embodiments, cleavage of oligonucleotide from solid support, or deprotection of oligonucleotide, is performed for more than 0.1 hr, 1 hr, 2 hrs, 5 hrs, 10 hrs, 15 hrs, 20 hrs, 24 hrs, 30 hrs, or 40 hrs. In some embodiments, cleavage of oligonucleotide from solid support, or deprotection of oligonucleotide, is performed for about 0.1-5 hrs. In some embodiments, cleavage of oligonucleotide from solid support, or deprotection of oligonucleotide, is performed for about 3-10 hrs. In some embodiments, cleavage of oligonucleotide from solid support, or deprotection of oligonucleotide, is performed for about 5-15 hrs. In some embodiments, cleavage of oligonucleotide from solid support, or deprotection of oligonucleotide, is performed for about 10-20 hrs. In some embodiments, cleavage of oligonucleotide from solid support, or deprotection of oligonucleotide, is performed for about 15-25 hrs. In some embodiments, cleavage of oligonucleotide from solid support, or deprotection of oligonucleotide, is performed for about 20-40 hrs. In some embodiments, cleavage of oligonucleotide from solid support, or deprotection of oligonucleotide, is performed for about 2 hrs. In some embodiments, cleavage of oligonucleotide from solid support, or deprotection of oligonucleotide, is performed for about 5 hrs. In some embodiments, cleavage of oligonucleotide from solid support, or deprotection of oligonucleotide, is performed for about 10 hrs. In some embodiments, cleavage of oligonucleotide from solid support, or deprotection of oligonucleotide, is performed for about 15 hrs. In some embodiments, cleavage of oligonucleotide from solid support, or deprotection of oligonucleotide, is performed for about 18 hrs. In some embodiments, cleavage of oligonucleotide from solid support, or deprotection of oligonucleotide, is performed for about 24 hrs.

In some embodiments, cleavage of oligonucleotide from solid support, or deprotection of oligonucleotide, is performed at room temperature for more than 0.1 hr, 1 hr, 2 hrs, 5 hrs, 10 hrs, 15 hrs, 20 hrs, 24 hrs, 30 hrs, or 40 hrs. In some embodiments, cleavage of oligonucleotide from solid support, or deprotection of oligonucleotide, is performed at room temperature for about 5-48 hrs. In some embodiments, cleavage of oligonucleotide from solid support, or deprotection of oligonucleotide, is performed at room temperature for about 10-24 hrs. In some embodiments, cleavage of oligonucleotide from solid support, or deprotection of oligonucleotide, is performed at room temperature for about 18 hrs. In some embodiments, cleavage of oligonucleotide from solid support, or deprotection of oligonucleotide, is performed at elevated temperature for more than 0.1 hr, 1 hr, 2 hrs, 5 hrs, 10 hrs, 15 hrs, 20 hrs, 24 hrs, 30 hrs, or 40 hrs. In some embodiments, cleavage of oligonucleotide from solid support, or deprotection of oligonucleotide, is performed at elevated temperature for about 0.5-5 hrs. In some embodiments, cleavage of oligonucleotide from solid support, or deprotection of oligonucleotide, is performed at about 60° C. for about 0.5-5 hrs. In some embodiments, cleavage of oligonucleotide from solid support, or deprotection of oligonucleotide, is performed at about 60° C. for about 2 hrs.

In some embodiments, cleavage of oligonucleotide from solid support, or deprotection of oligonucleotide comprises the use of propylamine and is performed at room temperature or elevated temperature for more than 0.1 hr, 1 hr, 2 hrs, 5 hrs, 10 hrs, 15 hrs, 20 hrs, 24 hrs, 30 hrs, or 40 hrs. Example conditions are 20% propylamine in pyridine at room temperature for about 18 hrs, and 20% propylamine in pyridine at 60° C. for about 18 hrs.

In some embodiments, prior to cleavage from solid support, a step is performed to remove a chiral auxiliary group, if one is still attached to an internucleotidic phosphorus atom. In some embodiments, for example, one or more DPSE type chiral auxiliary groups remain attached to internucleotidic phosphorus atoms during the oligonucleotide synthesis cycle. Suitable conditions for removing remaining chiral auxiliary groups are widely known in the art, e.g., those described in Wada I, Wada II, Wada III, Chiral Control, etc. In some embodiments, a condition for removing DPSE type chiral auxiliary is TBAF or HF-Et$_3$N, e.g., 0.1M TBAF in MeCN, 0.5M HF-Et$_3$N in THF or MeCN, etc. In some embodiments, the present disclosure recognizes that a linker may be cleaved during the process of removing a chiral auxiliary group. In some embodiments, the present disclosure provides linkers, such as the SP linker, that provides better stability during chiral auxiliary group removal. Among other things, certain linkers provided by the present disclosure provided improved yield and/or purity.

In some embodiments, an activator is a "Wada" activator, i.e., the activator is from any one of Wada I, II, or III documents cited above.

Example activating groups are depicted below:

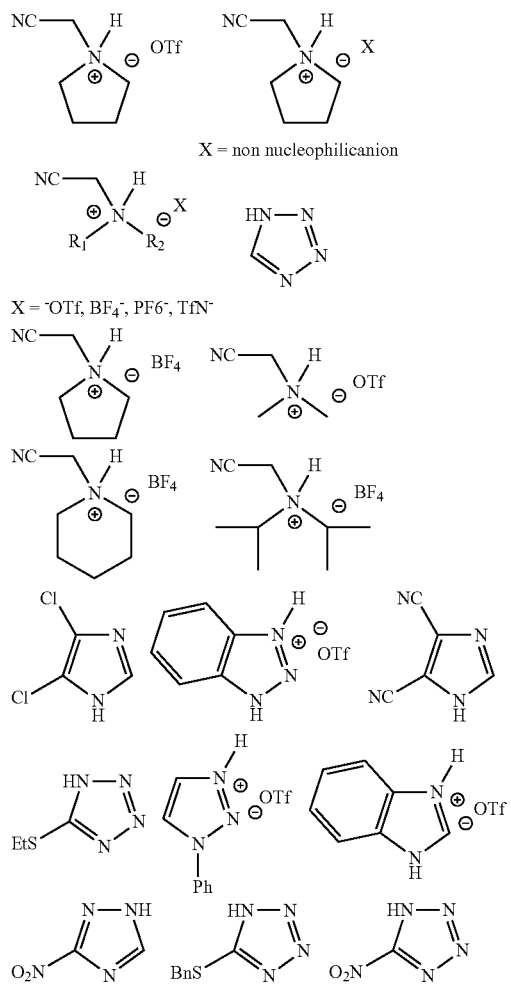

In some embodiments, an activating reagent is selected from

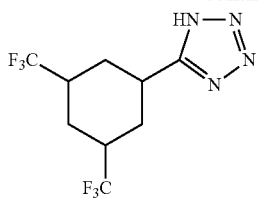

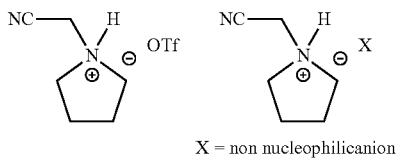

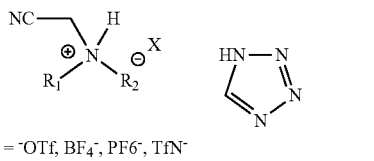

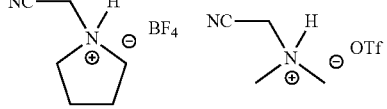

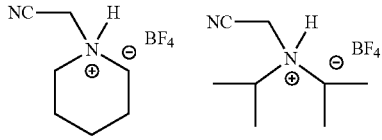

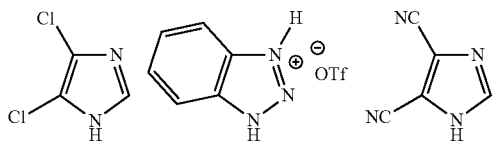

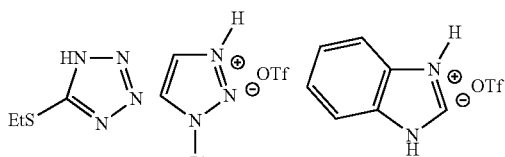

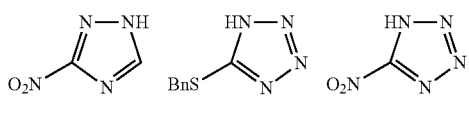

In some embodiments, an example cycle is depicted in Scheme I-b.
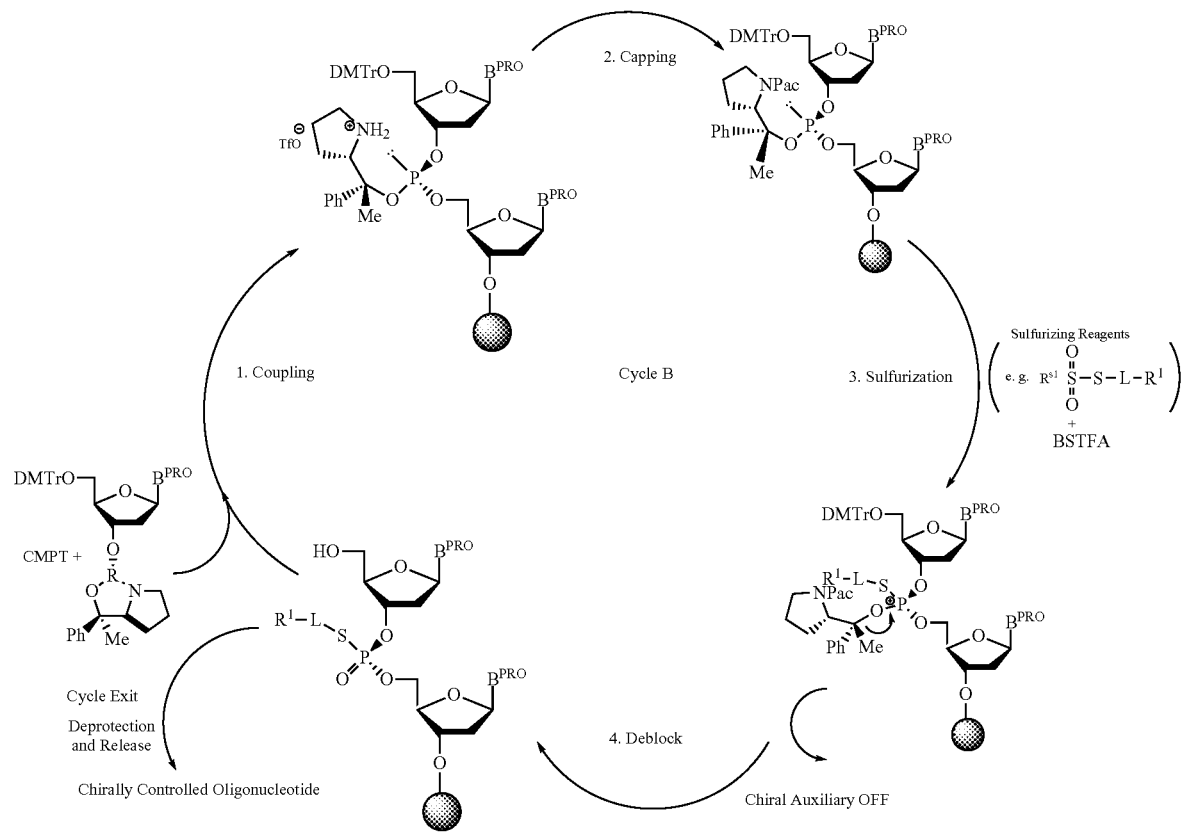
Scheme I-b. Installation of phosphorothioate linkages.

In some embodiments, an example cycle is illustrated in Scheme I-c.
Scheme I-c. Installation of both phosphate diester and modified internucleotidic linkages in a chirally controlled oligononucleotide.
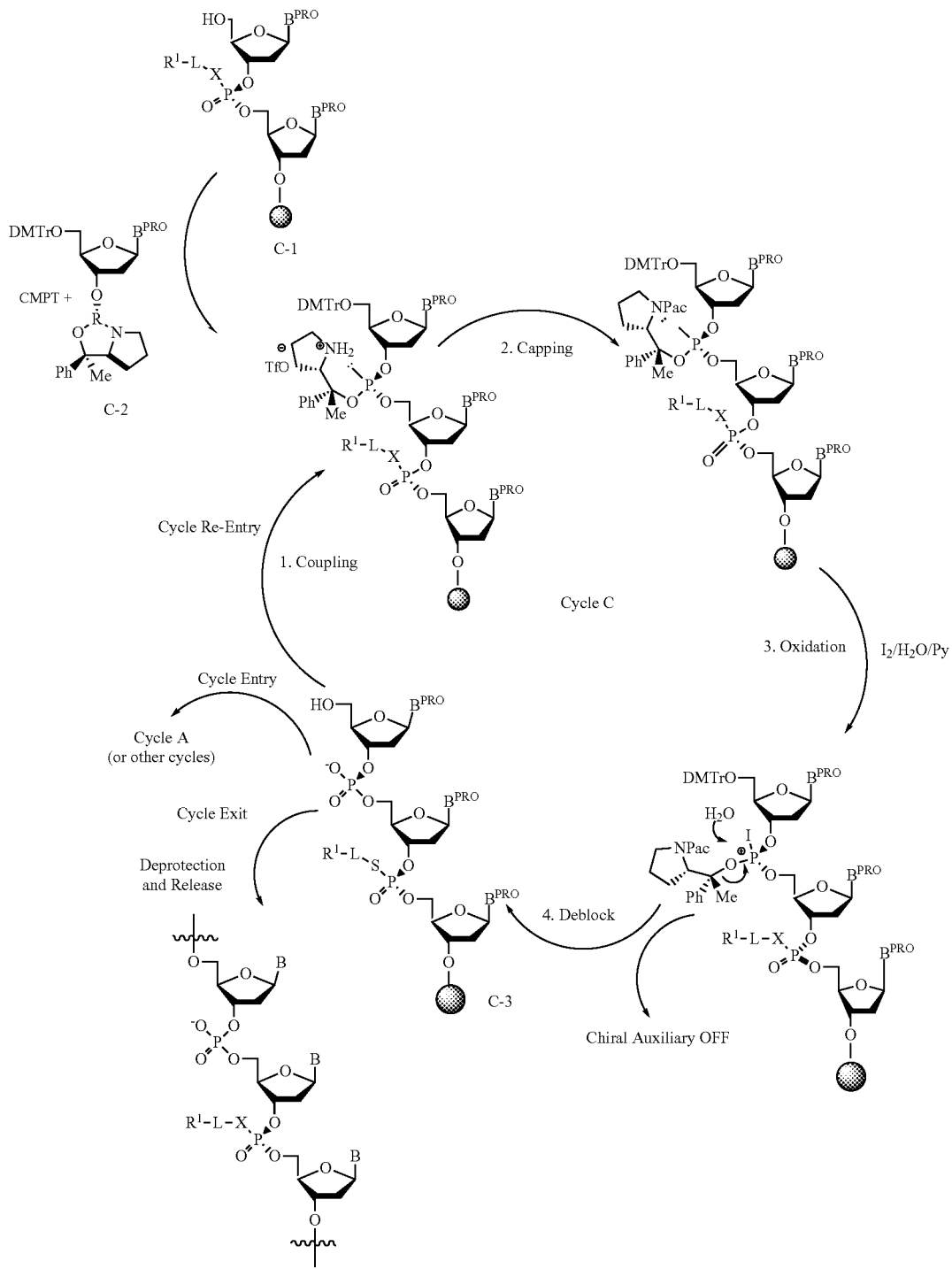

In Scheme I-c, oligonucleotide (or nucleotide, or oligonucleotide with modified internucleotidic linkage) on solid support (C-1) is coupled with phosphoramidite C-2. After coupling and capping, an oxidation step is performed. After deblocking, a phosphate diester linkage is formed. The cycle product C-3 can either re-enter cycle C to install more phosphate diester linkage, or enter other cycles to install other types of internucleotidic linkages, or go to cycle exit.

In some embodiments, non-chirally pure phosphoramidite can be used instead of C-2 in Scheme I-c. In some embodiments, β-cyanoethylphosphoramidites protected with DMTr is used. In some embodiments, the phosphoramidite being used has the structure of

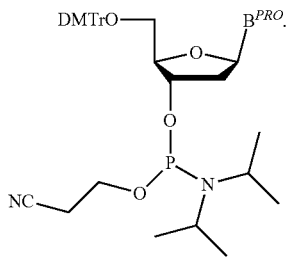

In some embodiments, the phosphorothioate diester precursor in the above-mentioned methods is

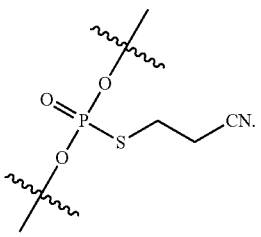

In some embodiments,

In some embodiments, the use of a phosphorothioate diester precursor increases the stability of oligonucleotide during synthesis. In some embodiments, the use of a phosphorothioate diester precursor improves the efficiency of chirally controlled oligonucleotide synthesis. In some embodiments, the use of a phosphorothioate diester precursor improves the yield of chirally controlled oligonucleotide synthesis. In some embodiments, the use of a phosphorothioate diester precursor improves the product purity of chirally controlled oligonucleotide synthesis.

is converted to a phosphorothioate diester linkage during deprotection/release. In some embodiments, an example cycle is depicted in Scheme I-d. More examples are depicted below.

Scheme I-D. Phosphorothioate diester precursor in chirally controlled oligonucleotide synthesis.

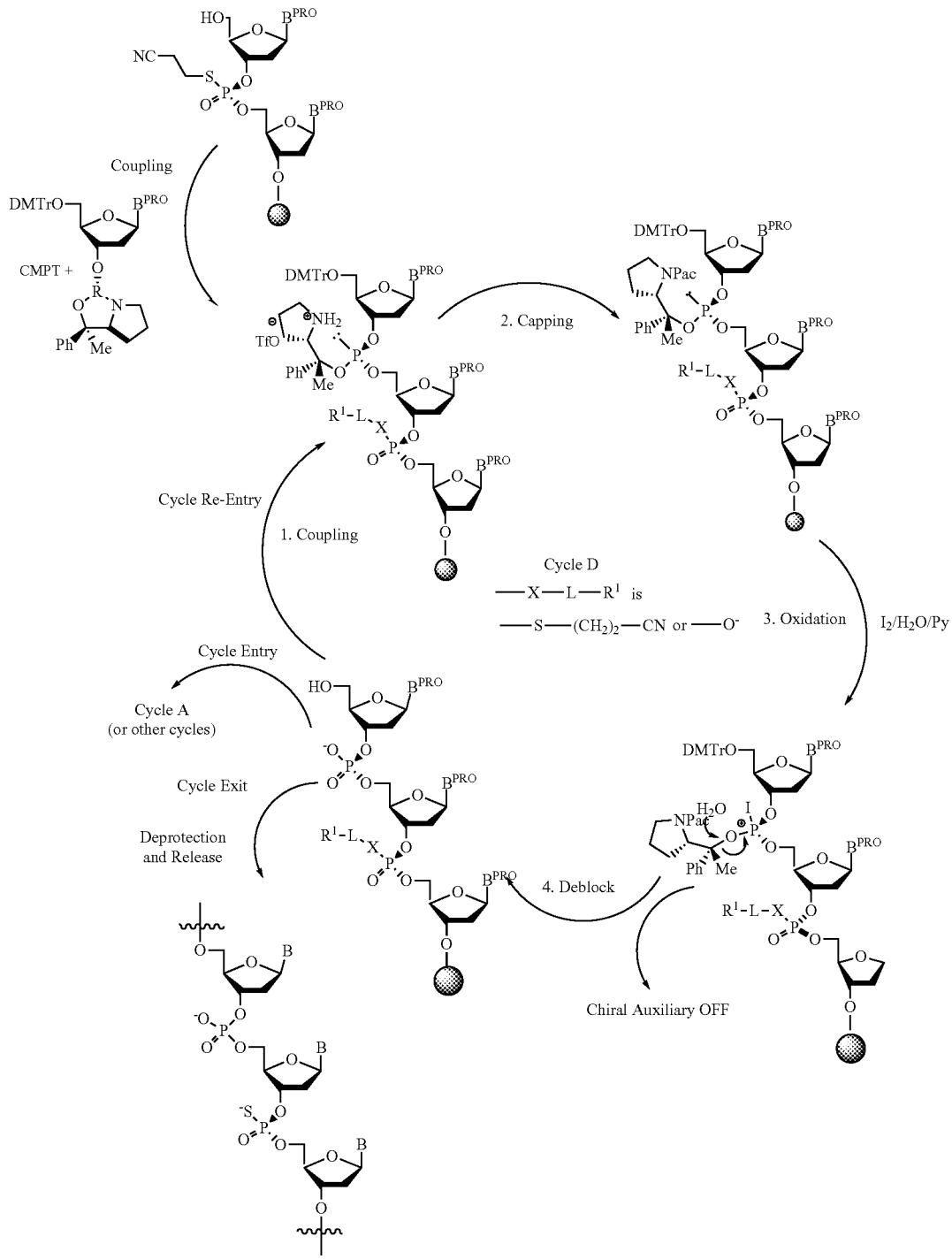

As illustrated in Scheme I-d, both phosphorothioate and phosphate diester linkages can be incorporated into the same chirally controlled oligonucleotide. As understood by a person of ordinary skill in the art, the provided methods do not require that the phosphorothioate diester and the phosphate diester to be consecutive—other internucleotidic linkages can form between them using a cycle as described above. In Scheme I-d, phosphorothioate diester precursors,

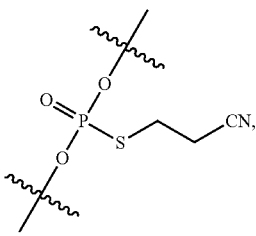

are installed in place of the phosphorothioate diester linkages. In some embodiments, such replacement provided increased synthesis efficiency during certain steps, for instance, the oxidation step. In some embodiments, the use of phosphorothioate diester precursors generally improve the stability of chirally controlled oligonucleotides during synthesis and/or storage. After cycle exit, during deprotection/release, the phosphorothioate diester precursor is converted to phosphorothioate diester linkage. In some embodiments, it is beneficial to use phosphorothioate diester precursor even when no phosphate diester linkage is present in the chirally controlled oligonucleotide, or no oxidation step is required during synthesis.

As in Scheme I-c, in some embodiments, non-chirally pure phosphoramidite can be used for cycles comprising oxidation steps. In some embodiments, β-cyanoethylphosphoramidites protected with DMTr is used. In some embodiments, the phosphoramidite being used has the structure of

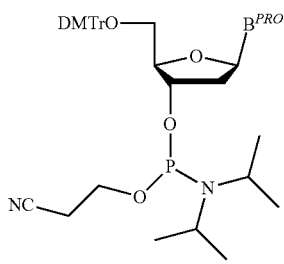

In some embodiments, methods of the present disclosure provide chirally controlled oligonucleotide compositions that are enriched in a particular oligonucleotide type.

In some embodiments, at least about 10% of a provided crude composition is of a particular oligonucleotide type. In some embodiments, at least about 20% of a provided crude composition is of a particular oligonucleotide type. In some embodiments, at least about 30% of a provided crude composition is of a particular oligonucleotide type. In some embodiments, at least about 40% of a provided crude composition is of a particular oligonucleotide type. In some embodiments, at least about 50% of a provided crude composition is of a particular oligonucleotide type. In some embodiments, at least about 60% of a provided crude composition is of a particular oligonucleotide type. In some embodiments, at least about 70% of a provided crude composition is of a particular oligonucleotide type. In some embodiments, at least about 80% of a provided crude composition is of a particular oligonucleotide type. In some embodiments, at least about 90% of a provided crude composition is of a particular oligonucleotide type. In some embodiments, at least about 95% of a provided crude composition is of a particular oligonucleotide type.

In some embodiments, at least about 1% of a provided composition is of a particular oligonucleotide type. In some embodiments, at least about 2% of a provided composition is of a particular oligonucleotide type. In some embodiments, at least about 3% of a provided composition is of a particular oligonucleotide type. In some embodiments, at least about 4% of a provided composition is of a particular oligonucleotide type. In some embodiments, at least about 5% of a provided composition is of a particular oligonucleotide type. In some embodiments, at least about 10% of a provided composition is of a particular oligonucleotide type. In some embodiments, at least about 20% of a provided composition is of a particular oligonucleotide type. In some embodiments, at least about 30% of a provided composition is of a particular oligonucleotide type. In some embodiments, at least about 40% of a provided composition is of a particular oligonucleotide type. In some embodiments, at least about 50% of a provided composition is of a particular oligonucleotide type. In some embodiments, at least about 60% of a provided composition is of a particular oligonucleotide type. In some embodiments, at least about 70% of a provided composition is of a particular oligonucleotide type. In some embodiments, at least about 80% of a provided composition is of a particular oligonucleotide type. In some embodiments, at least about 90% of a provided composition is of a particular oligonucleotide type. In some embodiments, at least about 95% of a provided composition is of a particular oligonucleotide type.

In some embodiments, an example cycle is depicted in Scheme I-e, below.

Scheme I-e. Example Cycle Using PhMe Chiral Auxiliary.

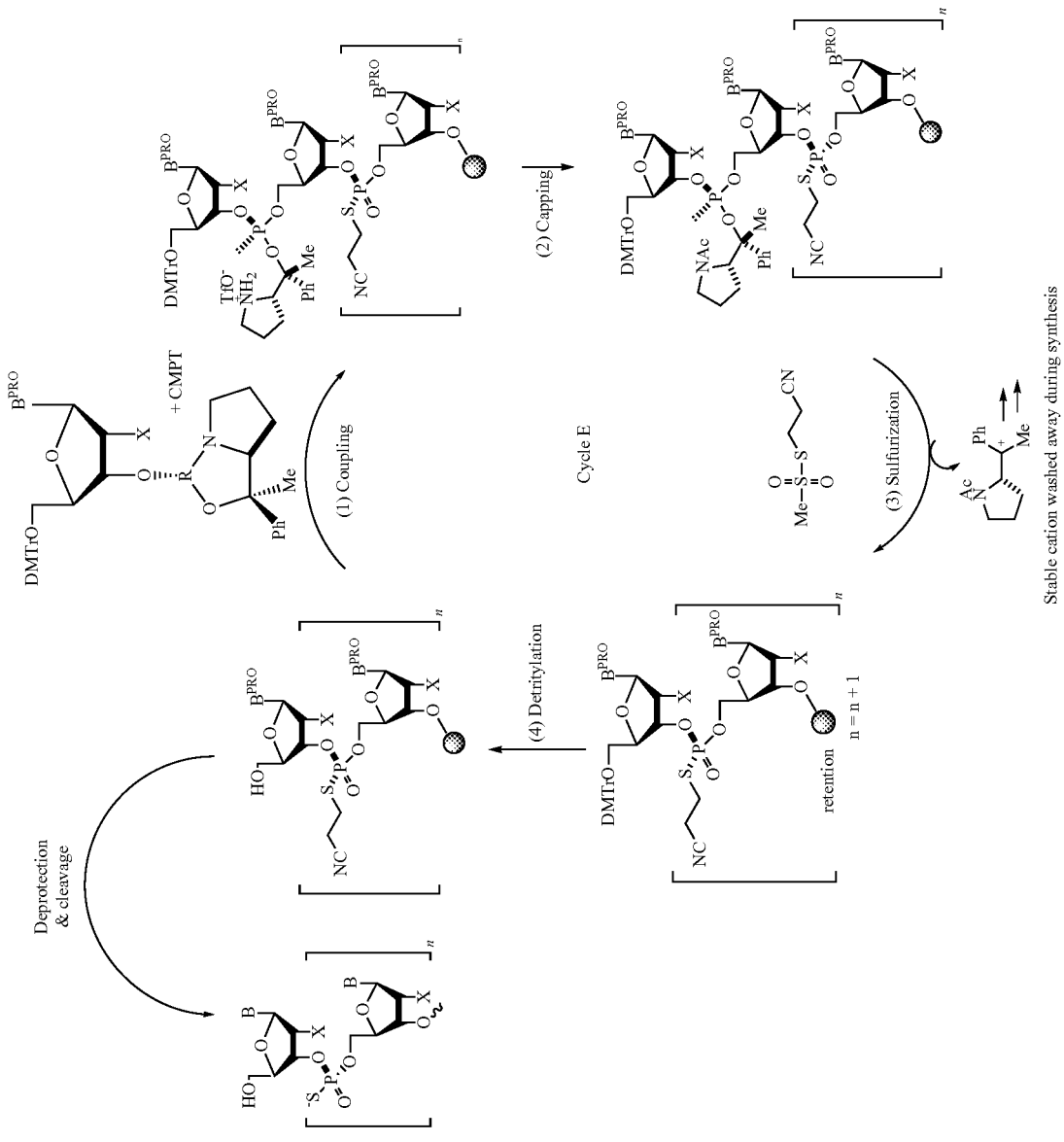
Scheme I-e. Example cycle using PhMe chiral auxiliary.

In some embodiments, X is H or a 2'-modification. In some embodiments, X is H or —OR$^1$, wherein R$^1$ is not hydrogen. In some embodiments, X is H or —OR$^1$, wherein R$^1$ is optionally substituted C$_{1-6}$ alkyl. In some embodiments, X is H. In some embodiments, X is —OMe. In some embodiments, X is —OCH$_2$CH$_2$OCH$_3$. In some embodiments, X is —F.

In some embodiments, an example cycle is depicted in Scheme I-f.

example, an oligonucleotide synthesis process may contain one or more Cycles A-F. In some embodiments, a provided method comprises at least one cycle using a DPSE-type chiral auxiliary.

In some embodiments, the present disclosure provides methods for preparing provided oligonucleotide and oligonucleotide compositions. In some embodiments, a provided method comprises the step of providing a provided chiral reagent having the structure of

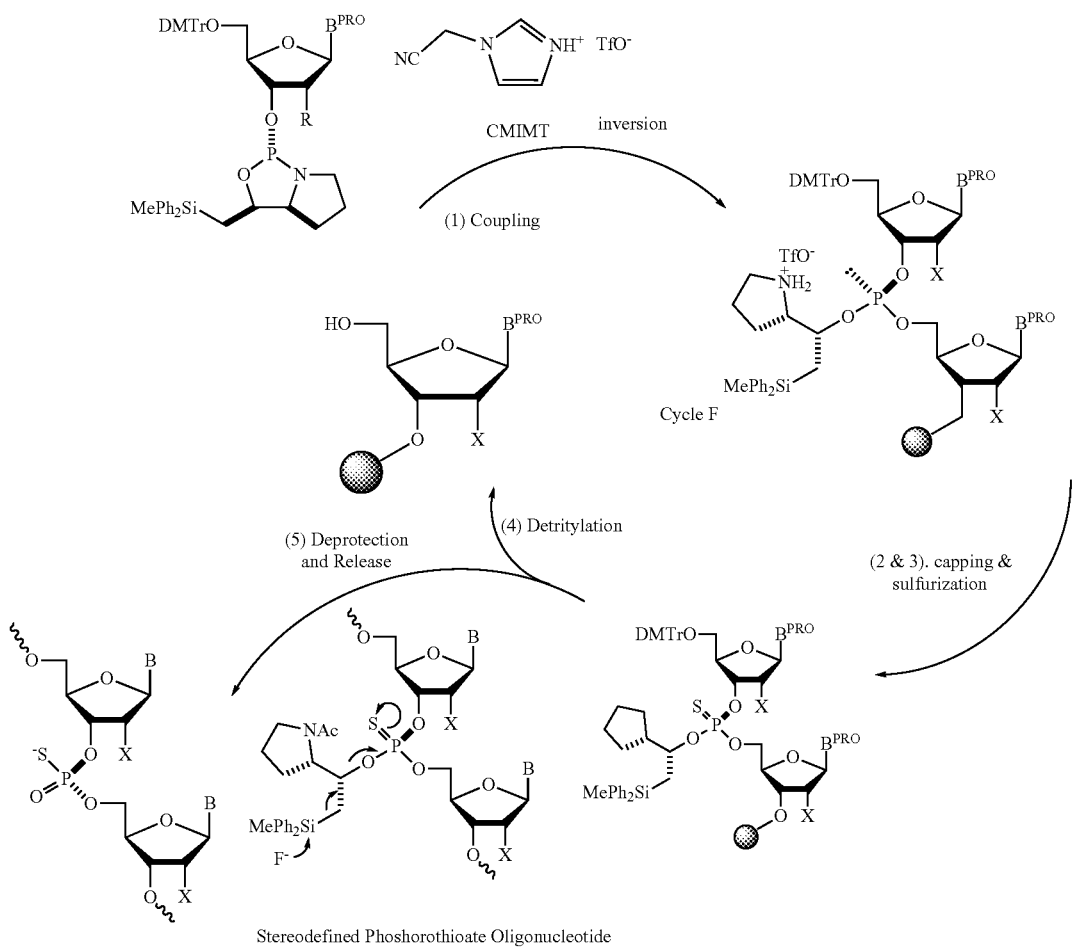

In some embodiments, X is H or a 2'-modification. In some embodiments, X is H or —OR$^1$, wherein R$^1$ is not hydrogen. In some embodiments, X is H or —OR$^1$ wherein R$^1$ is optionally substituted C$_1$-6 alkyl. In some embodiments, X is H. In some embodiments, X is —OMe. In some embodiments, X is —OCH$_2$CH$_2$OCH$_3$. In some embodiments, X is —F.

It is understood by a person having ordinary skill in the art that different types of cycles may be combined to provide complete control of the chemical modifications and stereochemistry of oligonucleotides. In some embodiments, for

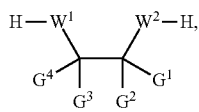

wherein W$^1$ is —NG$^5$, W$^2$ is O, each of G$^1$ and G$^3$ is independently hydrogen or an optionally substituted group selected from C$_{1-10}$ aliphatic, heterocyclyl, heteroaryl and aryl, G$^2$ is —C(R)$_2$Si(R)$_3$, and G$^4$ and G$^5$ are taken together to form an optionally substituted saturated, partially unsaturated or unsaturated heteroatom-containing ring of up to about 20 ring atoms which is monocyclic or polycyclic, fused or unfused, wherein each R is independently hydrogen, or an optionally substituted group selected from $C_1$-$C_6$ aliphatic, carbocyclyl, aryl, heteroaryl, and heterocyclyl. In some embodiments, a provided chiral reagent has the structure of

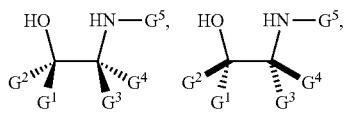

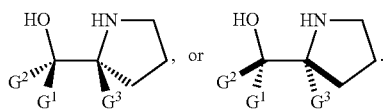

In some embodiments, a provided methods comprises providing a phosphoramidite comprising a moiety from a chiral reagent having the structure of

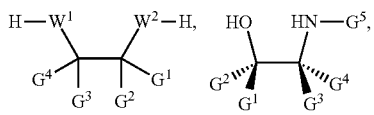

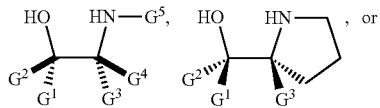

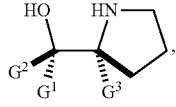

wherein —$W^1$H and —$W^2$H, or the hydroxyl and amino groups, form bonds with the phosphorus atom of the phosphoramidite. In some embodiments, —$W^1$H and —$W^2$H, or the hydroxyl and amino groups, form bonds with the phosphorus atom of the phosphoramidite, e.g., in

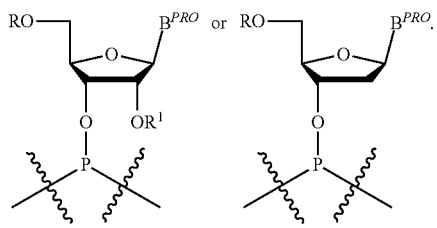

In some embodiments, a phosphoramidite has the structure of

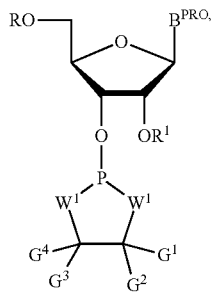 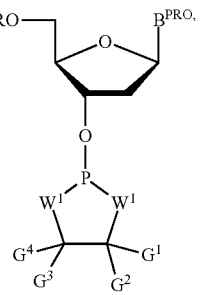

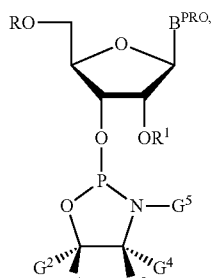 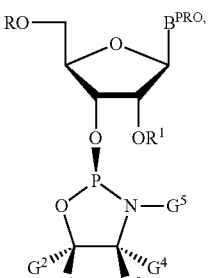

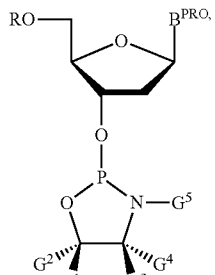 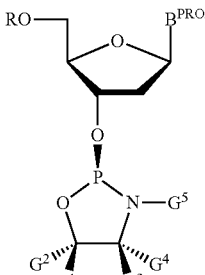

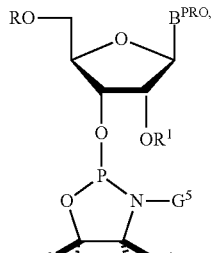 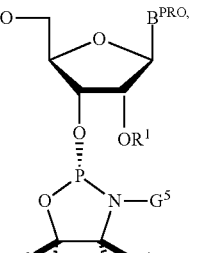

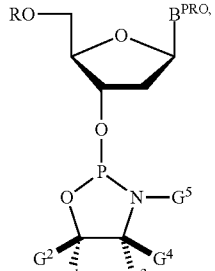 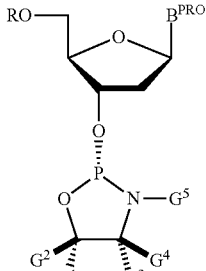

781
-continued
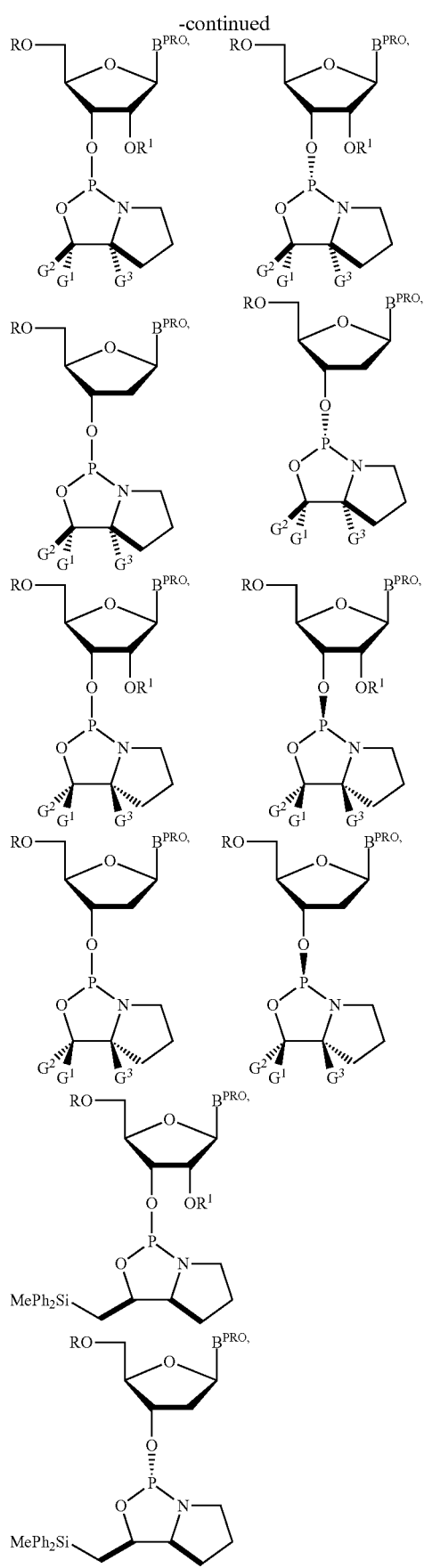
782
-continued
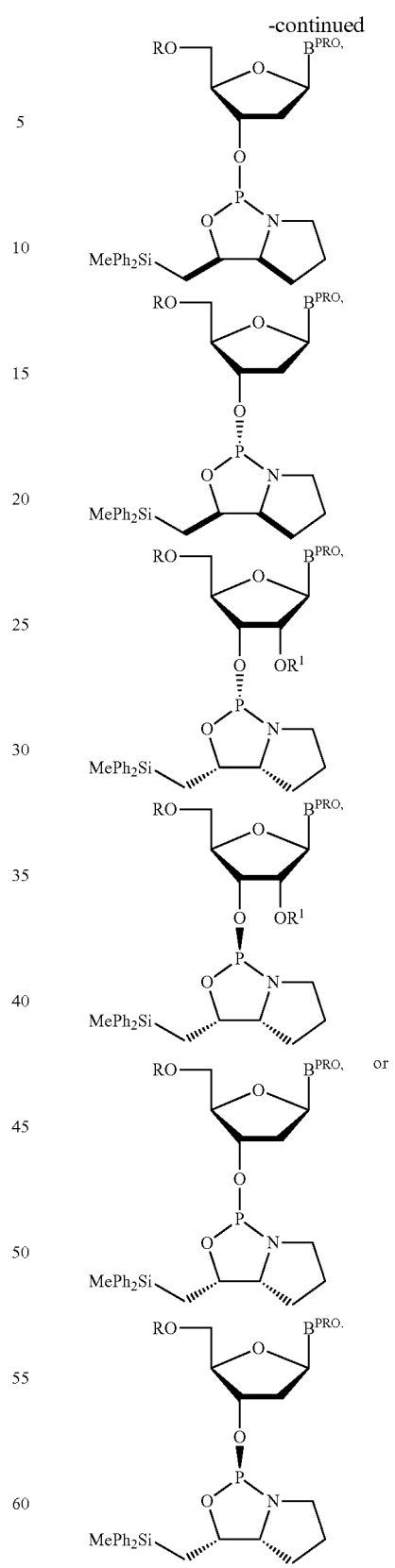
In some embodiments, R is a protection group. In some embodiments, R is DMTr. In some embodiments, $G^2$ is —$C(R)_2Si(R)_3$, wherein —$C(R)_2$— is optionally substituted —CH$_2$—, and each R of —Si(R)$_3$ is independently an optionally substituted group selected from C$_{1-10}$ aliphatic, heterocyclyl, heteroaryl and aryl. In some embodiments, at least one R of —Si(R)$_3$ is independently optionally substituted C$_{1-10}$ alkyl. In some embodiments, at least one R of —Si(R)$_3$ is independently optionally substituted phenyl. In some embodiments, one R of —Si(R)$_3$ is independently optionally substituted phenyl, and each of the other two R is independently optionally substituted C$_{1-10}$ alkyl. In some embodiments, one R of —Si(R)$_3$ is independently optionally substituted C$_{1-10}$ alkyl, and each of the other two R is independently optionally substituted phenyl. In some embodiments, G$^2$ is optionally substituted —CH$_2$Si(Ph)(Me)$_2$. In some embodiments, G$^2$ is optionally substituted —CH$_2$Si(Me)(Ph)$_2$. In some embodiments, G$^2$ is —CH$_2$Si(Me)(Ph)$_2$. In some embodiments, G$^4$ and G$^5$ are taken together to form an optionally substituted saturated 5-6 membered ring containing one nitrogen atom (to which G$^5$ is attached). In some embodiments, G$^4$ and G$^5$ are taken together to form an optionally substituted saturated 5-membered ring containing one nitrogen atom. In some embodiments, G$^1$ is hydrogen. In some embodiments, G$^3$ is hydrogen. In some embodiments, both G$^1$ and G$^3$ are hydrogen. In some embodiments, both G$^1$ and G$^3$ are hydrogen, G$^2$ is —C(R)$_2$Si(R)$_3$, wherein —C(R)$_2$— is optionally substituted —CH$_2$—, and each R of —Si(R)$_3$ is independently an optionally substituted group selected from C$_{1-10}$ aliphatic, heterocyclyl, heteroaryl and aryl, and G$^4$ and G$^5$ are taken together to form an optionally substituted saturated 5-membered ring containing one nitrogen atom. In some embodiments, a provided method further comprises providing a fluoro-containing reagent. In some embodiments, a provided fluoro-containing reagent removes a chiral reagent, or a product formed from a chiral reagent, from oligonucleotides after synthesis. Various known fluoro-containing reagents, including those F$^-$ sources for removing —SiR$_3$ groups, can be utilized in accordance with the present disclosure, for example, TBAF, HF$_3$-Et$_3$N etc. In some embodiments, a fluoro-containing reagent provides better results, for example, shorter treatment time, lower temperature, less de-sulfurization, etc, compared to traditional methods, such as concentrated ammonia. In some embodiments, for certain fluoro-containing reagent, the present disclosure provides linkers for improved results, for example, less cleavage of oligonucleotides from support during removal of chiral reagent (or product formed therefrom during oligonucleotide synthesis). In some embodiments, a provided linker is an SP linker. In some embodiments, the present disclosure demonstrated that a HF-base complex can be utilized, such as HF—NR3, to control cleavage during removal of chiral reagent (or product formed therefrom during oligonucleotide synthesis). In some embodiments, HF—NR$_3$ is HF-NEt$_3$. In some embodiments, HF—NR$_3$ enables use of traditional linkers, e.g., succinyl linker.

In some embodiments, a method for production of an oligonucleotide comprises at least one cycle using a DPSE-type chiral auxiliary, such as that shown in the following non-limiting example:

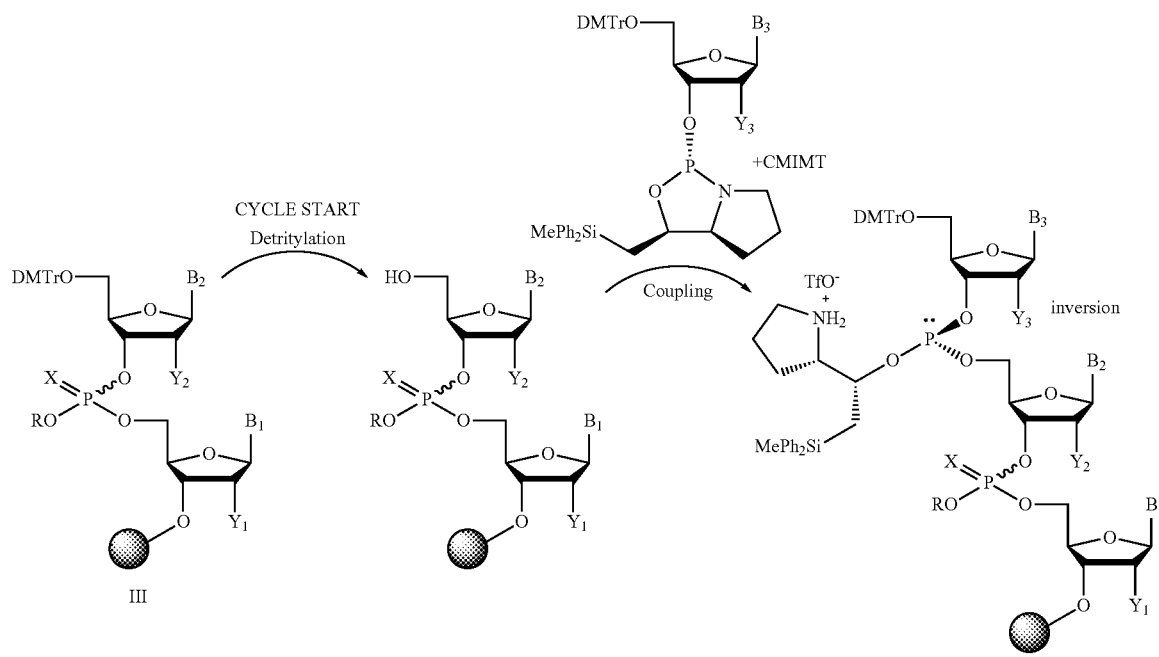

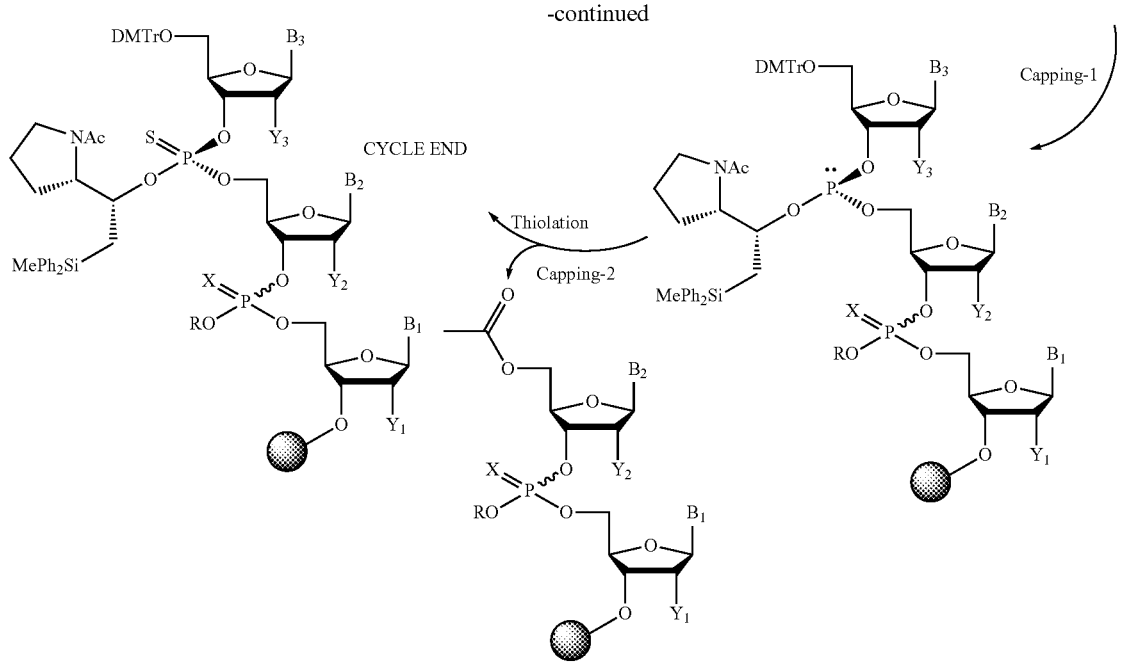

Detritylation:

The synthesis of an oligonucleotide started with 2'-F-U-DMTr loaded CPG solid support (3% dichloroacetic acid (DCA) in toluene was used for the removal of dimethoxy trityl group (DMTr) from the initial nucleobase attached on the solid support followed by an UV watch command mode at the wavelength of 436 nm. Linear flowrate, 424 cm/hr, used for detritylation.

Coupling:

For the coupling step, all amidites were dissolved either in acetonitrile (ACN) or in 20% isobutyronitrile (IBN)/ACN at a concentration of 0.2M; the solutions were dried over molecular sieves (3A) NLT 4 h before use (10%, v/v). Dual activators (CMIMT and ETT) coupling approach were utilized for the manufacture of an oligonucleotide. Both activators were dissolved in ACN at a concentration of 0.6M. CMIMT has been used for the efficient coupling of stereo defined nucleotides and ETT is an activator used for the coupling of random/standard amidites/nucleotides. 2.5 equivalent of amidites used for coupling of stereo defined nucleotide over 10 min recycle time (linear recycle mode, 212 cm/hr). The molar ratio of CMIMT activator to stereo defined amidite was maintained at 6.1:1 (CMIMT/Amidite=6.1/1) in the coupling step. All random amidites were coupled for 8 min with ETT activator. The molar ratio of ETT to random/standard amidites was 4.5:1.

Cap 1:

Cap 1 is a step that is performed before thiolation. 1-1.5 CV Cap B solution is used over 4 min contact time for capping of the auxiliary amine on DPSE. Capping of DPSE chiral auxiliary with Cap B solution helps to reduce the content of early failure and post FLP impurities.

Thiolation:

Following the Cap 1 step, the phosphorous triester linkages, P(III), were stabilized with thiolating reagent, 0.2M xanthane hydride (XH) in pyridine, (0.6 CV) over 6 min contact time to form a stable P(V) bond.

Oxidation:

It is noted here that the Cap 1 step is not necessary for standard nucleotide cycle. So, after coupling of standard nucleotides onto the solid support, the phosphorous triester linkages, P(III), were oxidized with 0.05M of iodine/water/pyridine solution (3.5 eq.) over 2 min contact time to form a stable P(V) bond.

Cap 2 (Post-Thio/Ox-Capping):

In general, 97-100% coupling efficiency was observed in the coupling step based on DMTr release cation. Residual uncoupled hydroxyl groups, typically 1-3% by detrit monitor, on the solid support were blocked with Cap A and Cap B solution using 0.4 CV over 0.8 min to prevent formation of deletion sequences. In case, any auxiliary amine remained un-capped in the pre-capping step will also be capped in this step.

Cycle Repeated

The synthetic cycle (DPSE cycle=Detritylation->Coupling->Cap 1->Thiolation->Cap2 and Standard cycle=Detritylation->Coupling->Oxidation->Cap2) was repeated until the desired length of oligonucleotide synthesized on the solid support.

In some embodiments, the present disclosure comprises a method for manufacturing an oligonucleotide composition directed to a selected target sequence, the method comprising manufacturing a provided oligonucleotide composition capable of directing single-stranded RNA interference and comprising a first plurality of oligonucleotides, each of which has a base sequence complementary to the target sequence. In some embodiments, a provided method further comprises providing a pharmaceutically acceptable carrier.

As appreciated by a person having ordinary skill in the art, provided oligonucleotides can also be prepared through known solution phase synthesis using provided reagents and methods in accordance with the present disclosure.

As non-limiting examples, provided oligonucleotides can also be prepared through any process known in the art, including but not limited to, those described in: JP 4348044; WO2005092909; U.S. Pat. No. 9,394,333; WO2011005761; U.S. Pat. Nos. 8,470,987; 8,859,755; 8,822,671;

WO2013012758; EP 13817386; WO2014012081; WO2015107425; WO2017015555; and WO2017062862.

Double-Stranded Oligonucleotides Comprising a Single-Stranded Oligonucleotide Disclosed Herein In some embodiments, an oligonucleotide is a single-stranded or double-stranded oligonucleotide. In some embodiments, the disclosure encompasses a double-stranded oligonucleotide or molecule comprising a single-stranded oligonucleotide as disclosed herein, and another oligonucleotide which is at least partially complementary to it. In some embodiments, the present disclosure pertains to compositions comprising such a double-stranded oligonucleotide.

In some embodiments, the disclosure encompasses a double-stranded molecule comprising a single-stranded oligonucleotide as disclosed herein, and another oligonucleotide which is at least partially complementary to it, e.g., one or both ends of the molecule has a 3' or 5' overhang.

In some embodiments, the disclosure encompasses a double-stranded molecule comprising a single-stranded oligonucleotide as disclosed herein, and another oligonucleotide which is fully complementary to it.

In some embodiments, the disclosure encompasses a double-stranded molecule capable of directing RNA interference comprising a single-stranded oligonucleotide as disclosed herein, and another oligonucleotide which is at least partially complementary to it.

In some embodiments, the disclosure encompasses a double-stranded molecule capable of directing RNA interference comprising a single-stranded oligonucleotide as disclosed herein, and another oligonucleotide which is at least partially complementary to it, e.g., one or both ends of the molecule capable of directing RNA interference has a 3' or 5' overhang.

In some embodiments, the disclosure encompasses a double-stranded molecule capable of directing RNA interference comprising a single-stranded oligonucleotide as disclosed herein, and another oligonucleotide which is fully complementary to it.

In some embodiments, the disclosure encompasses a double-stranded molecule capable of directing RNA interference and RNase H-mediated knockdown comprising a single-stranded oligonucleotide as disclosed herein, and another oligonucleotide which is at least partially complementary to it.

In some embodiments, the disclosure encompasses a double-stranded molecule capable of directing RNA interference and RNase H-mediated knockdown comprising a single-stranded oligonucleotide as disclosed herein, and another oligonucleotide which is at least partially complementary to it, e.g., one or both ends of the molecule capable of directing RNA interference and RNase H-mediated knockdown has a 3' or 5' overhang.

In some embodiments, the disclosure encompasses a double-stranded molecule capable of directing RNA interference and RNase H-mediated knockdown comprising a single-stranded oligonucleotide as disclosed herein, and another oligonucleotide which is fully complementary to it.

Provided first oligonucleotides and oligonucleotide compositions can have any format, structural element or base sequence of any oligonucleotide disclosed herein, and further comprise a second oligonucleotide or oligonucleotide strand at least partially complementary to the first oligonucleotide. In some embodiments, the first and/or second oligonucleotide can comprise any format, structural element or base sequence of (or a base sequence at least partially complementary to a base sequence of) any oligonucleotide disclosed herein. In some embodiments, a structural element is a 5'-end structure, 5'-end region, 5'-nucleotide, seed region, post-seed region, 3'-end region, 3'-terminal dinucleotide, 3'-end cap, or any portion of any of these structures, GC content, long GC stretch, and/or any modification, chemistry, stereochemistry, pattern of modification, chemistry or stereochemistry, or additional chemical moiety (e.g., including but not limited to, a targeting moiety, a lipid moiety, a GalNAc moiety, a carbohydrate moiety, etc.), any component, or any combination of any of the above.

Biological Applications

As described herein, provided compositions and methods are capable of improving knockdown, including, single-stranded RNA interference of transcripts. In some embodiments, provided compositions and methods provide improved single-stranded RNA interference of transcripts compared to a reference pattern, which is a pattern from a reference condition selected from the group consisting of absence of the composition, presence of a reference composition, and combinations thereof. An improvement can be an improvement of any desired biological functions.

In some embodiments, the present disclosure provides a method for improving single-stranded RNA interference of a target transcript, comprising administering a composition comprising a first plurality of oligonucleotides, wherein the single-stranded RNA interference of the target transcript is improved relative to reference conditions selected from the group consisting of absence of the composition, presence of a reference composition, and combinations thereof.

In some embodiments, the present disclosure provides a method of mediating single-stranded RNA interference of a target, the method comprising steps of:

contacting a single-stranded RNA interference system containing the target transcript with an oligonucleotide composition comprising a first plurality of oligonucleotides, in an amount, for a time, and under conditions sufficient for a set of single-stranded RNA interference products to be generated that is different from a set generated under reference conditions selected from the group consisting of absence of the composition, presence of a reference composition, and combinations thereof.

In some embodiments, the present disclosure provides compositions and methods for treating or preventing diseases, including but not limited to those described in references cited in this disclosure.

In some embodiments, the present disclosure provides a method for treating or preventing a disease, comprising administering to a subject an oligonucleotide composition described herein.

In some embodiments, the present disclosure provides a method for treating or preventing a disease, comprising administering to a subject an oligonucleotide composition comprising a first plurality of oligonucleotides, which:

1) have a common base sequence complementary to a target sequence in a transcript; and 2) comprise one or more modified sugar moieties and modified internucleotidic linkages, the oligonucleotide composition being characterized in that, when it is contacted with the transcript in a single-stranded RNA interference system, RNAi-mediated knockdown of the transcript is improved relative to that observed under reference conditions selected from the group consisting of absence of the composition, presence of a reference composition, and combinations thereof.

In some embodiments, the present disclosure provides a method for treating or preventing a disease, comprising administering to a subject an oligonucleotide composition comprising a first plurality of oligonucleotides capable of directing single-stranded RNA interference, wherein oligonucleotides are of a particular oligonucleotide type defined by:
1) base sequence;
2) pattern of backbone linkages;
3) pattern of backbone chiral centers; and
4) pattern of backbone phosphorus modifications,
which composition is chirally controlled in that it is enriched, relative to a substantially racemic preparation of oligonucleotides having the same base sequence, for oligonucleotides of the particular oligonucleotide type, wherein:
the oligonucleotide composition being characterized in that, when it is contacted with the transcript in a single-stranded RNA interference system, RNAi-mediated knockdown of the transcript is improved relative to that observed under reference conditions selected from the group consisting of absence of the composition, presence of a reference composition, and combinations thereof.

In some embodiments, a disease is one in which administering a provided composition capable of directing single-stranded RNA interference can repair, restore or introduce a new beneficial function.

In some embodiments, a disease is one in which, after administering a provided composition, a gene is effectively knocked down by improving single-stranded RNA interference system of the gene transcript.

In some embodiments, a disease is cancer.

In some embodiments, the present disclosure provides a method of treating a disease by administering a composition comprising a first plurality of oligonucleotides sharing a common base sequence comprising a common base sequence, which nucleotide sequence is complementary to a target sequence in the target transcript,
the improvement that comprises using as the oligonucleotide composition a stereocontrolled oligonucleotide composition characterized in that, when it is contacted with the transcript in an oligonucleotide or a single-stranded RNA interference system, RNAi-mediated knockdown of the transcript is improved relative to that observed under reference conditions selected from the group consisting of absence of the composition, presence of a reference composition, and combinations thereof.

In some embodiments, a disease is cancer.

In some embodiments, a disease treatment comprises knockdown of a gene function by improving single-stranded RNA interference system.

In some embodiments, an oligonucleotide or a single-stranded RNAi agent targets a target mRNA transcript.

In some embodiments, the common base sequence is capable of hybridizing with a transcript in a cell. In some embodiments, a common base sequence hybridizes with a transcript of any gene described herein or known in the art.

Treatment of Disorders

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion.

In some embodiments, provided oligonucleotides target ACVR2B or MSTN-R. In some embodiments, provided oligonucleotides target APOB. In some embodiments, provided oligonucleotides target APOC3. In some embodiments, provided oligonucleotides target FXI (Factor XI). In some embodiments, provided oligonucleotides target KRT14. In some embodiments, provided oligonucleotides target MSTN. In some embodiments, provided oligonucleotides target PCSK9. In some embodiments, provided oligonucleotides target PNPLA3.

In some embodiments, ACVR2B is a gene, or a gene product thereof (including, but not limited to, a transcript or protein), also known as also known as: ACVR2B, ACTRIIB, ActR-IIB, HTX4, activin A receptor type 2B, MSTN-R, myostatin receptor, and MSTN receptor; External IDs: OMIM: 602730 MGI: 87912 HomoloGene: 863 GeneCards: ACVR2B; Species: Human; Entrez: 93; Ensembl: ENSG00000114739; UniProt: Q13705; RefSeq (mRNA): NM_001106; RefSeq (protein): NP_001097; Location (UCSC): Chr 3: 38.45-38.49 Mb; Species: Mouse; Entrez: 11481; Ensembl: ENSMUSG00000061393; UniProt: P27040; RefSeq (mRNA): NM_007397 NM_001313757; RefSeq (protein): NP_031423.1 NP_001300686.1 NP_001300686 NP_031423; Location (UCSC): Chr 9: 119.4-119.43 Mb. ACVR2B is a reportedly receptor for myostatin. The interaction between myostatin and this receptor reportedly regulates the inhibition of skeletal muscle differentiation via the Smad-dependent pathway. Thus, inhibition or prevention of myostatin binding to ActRIIB can reportedly induce the formation of skeletal muscle. Compositions which inhibit, reduce or antagonize a function of ActRIIB in order to inhibit Smad activation can reportedly induce skeletal muscle differentiation, for example, making them potentially useful in the treatment of a pathological disorder such as a ACVR2B-related disorder. Hilden et al. 1994 Blood. 83 (8): 2163-70; Ishikawa et al. 1998 J. Hum. Genet. 43 (2): 132-4; Attisano et al. 1996 Mol. Cell. Biol. 16 (3): 1066-73; De Winter et al. 1996 Exp. Cell Res. 224 (2): 323-34; Matsuzaki et al. 2002 J. Biol. Chem. 277 (21): 19008-18.

In some embodiments, an ACVR2B-related disorder is a disorder related to, caused and/or associated with abnormal or excessive activity, level and/or expression of, a deleterious mutation in, or abnormal tissue or inter- or intracellular distribution of an ACVR2B gene or a gene product thereof. Non-limiting examples of an ACVR2B-related disorder include: musculoskeletal disease or disorder; muscle atrophy or dystrophy; muscle atrophy as a result of or associated with any of: treatment with a glucocorticoid such as cortisol, dexamethasone, betamethasone, prednisone, methylprednisolone, or prednisolone, denervation due to nerve trauma or a result of degenerative, metabolic, or inflammatory neuropathy (e.g., Guillian-Barre syndrome, peripheral neuropathy, or exposure to environmental toxins or drugs), or myopathy, such as myotonia; a congenital myopathy, including nemalene myopathy, multi/minicore myopathy and myotubular (centronuclear) myopathy; mitochondrial myopathy; familial periodic paralysis; inflammatory myopathy; metabolic myopathy, such as caused by a glycogen or lipid storage disease; dermatomyositisis; polymyositis; inclusion body myositis; myositis ossificans; rhabdomyolysis and myoglobinurias; a muscular dystrophy syndrome, such as Duchenne, Becker, myotonic, fascioscapulohumeral, Emery-Dreifuss, oculopharyngeal, scapulohumeral, limb girdle, Fukuyama, a congenital muscular dystrophy, or hereditary distal myopathy; osteoporosis, a bone fracture, short stature, or dwarfism; muscle atrophy as a result of or associated with an adult motor neuron disease, infantile spinal muscular atrophy, amyotrophic lateral sclerosis, juvenile spinal muscular atrophy, autoimmune motor neuropathy with multifocal conductor block, paralysis due to stroke or spinal cord injury, skeletal immobilization due to trauma, prolonged bed rest, voluntary inactivity, involuntary inactivity, metabolic stress or nutritional insufficiency, cancer, AIDS, fasting, a thyroid gland disorder, diabetes, benign congenital hypotonia, central core disease, burn injury, chronic obstructive pulmonary disease, liver diseases (examples such as fibrosis, cirrhosis), sepsis, renal failure, congestive heart failure, ageing, space travel or time spent in a zero gravity environment; sarcopenia, skin atrophy, muscle wasting, brain atrophy, atherosclerosis, arteriosclerosis, pulmonary emphysema, osteoporosis, osteoarthritis, immunologic incompetence, high blood pressure, dementia, Huntington's disease, Alzheimer's disease, cataracts, age-related macular degeneration, prostate cancer, stroke, diminished life expectancy, frailty, memory loss, wrinkles, impaired kidney function, and age-related hearing loss; metabolic disorders, including Type II Diabetes, Metabolic Syndrome, hyperglycemia, and obesity; or acute and/or chronic renal disease or failure, liver fibrosis or cirrhosis, cancer such as breast cancer, Parkinson's Disease; cachexia, cachexia associated with a rheumatoid arthritis and cachexia associated with cancer; conditions associated with neuronal death, such as ALS, brain atrophy, or dementia and anemia; or a disorder which causes or is associated with muscle atrophy.

In some embodiments, APOB is a gene, or a gene product thereof (including, but not limited to, a transcript or protein), also known as APOB, ApoB, FLDB, LDLCQ4, apoB-100, apoB-48, or apolipoprotein B; OMIM: 107730; MGI: 88052; HomoloGene: 328; GeneCards: 338; or Human APOB: Entrez 338; Ensembl ENSG00000084674; UniProt P04114; RefSeq (mRNA): NM_000384; RefSeq (protein): NP_000375.2; Location (UCSC): Chr 2: 21-21.04 Mb; Mouse: Entrez 238055; Ensembl ENSMUSG00000020609; UniProt E9Q414; RefSeq (mRNA): NM_009693; RefSeq (protein): NP 033823.2; Location (UCSC): Chr 12: 7.98-8.02 Mb. In some embodiments, Apolipoprotein B is reportedly the primary apolipoprotein of chylomicrons, VLDL (very low density lipoproteins), IDL (intermediate density lipoproteins), and LDL (low density lipiproteins) particles. APOB is reportedly responsible for carrying lipids, including cholesterol, around the body to all cells within all tissues. APOB is reportedly the primary organizing protein component of the particles and is required for the formation of these particles. APOB on the LDL particle reportedly acts as a ligand for LDL receptors in various cells. Lim et al. 2011 Journal of Clinical Lipidology. 5 (4): 264-272; Jacobson 2011 Mayo Clinic Proceedings. 86 (8): 762-780; Carmena et al. 2004 Circulation. 109 (23): 111-2; McCormick et al. 1996 The Journal of Biological Chemistry. 271 (20): 11963-70; Farese et al. 1995 Proceedings of the National Academy of Sciences of the United States of America. 92 (5): 1774-8; Chen et al. 1986 Journal of Biological Chemistry. 261 (28): 12918-12921; Peterson et al. 2008 Cell Host & Microbe. 4 (6): 507-9; Su et al. 2009 Hepatology. 50 (1): 77-84; McQueen et al. 2008 Lancet. 372 (9634): 224-33; Benn et al. 2007 Arterioscler. Thromb. Vasc. Biol. 27 (3): 661-70; Valdivielso et al. 2009 Cardiovasc Diabetol. 8:1; Malaguarnera et al. 2013 Biomed Research International. 2013 (650989): 650989; Zhang et al. 2003 J. Biol. Chem. 278 (9): 7459-68; Linnik et al. 1998 J. Biol. Chem. 273 (33): 21368-73; Khalil et al. 2004 Arteriosclerosis, Thrombosis, and Vascular Biology. 24 (12): 2211-2218; Tabas et al. 2007 Circulation. 116 (16): 1832-1844; Pontrelli et al. 2004 Biochemistry. 43 (21): 6734-6744; Powell et al. 1987 Cell. 50 (6): 831-40; Fujino et al. 1999 Nucleic Acids Res. 27 (13): 2662-71; and Lau et al. 1991 J. Biol. Chem. 266 (30): 20550-4.

In some embodiments, an APOB-related disorder is a disorder related to, caused and/or associated with abnormal or excessive activity, level and/or expression of, a deleterious mutation in, or abnormal tissue or inter- or intracellular distribution of an APOB gene or a gene product thereof. Non-limiting examples of an APOB-related disorder include: atherosclerosis; heart disease; Abetalipoproteinaemia; familial hypercholesterolemia; metabolic disorder; cardiovascular disease; stroke; coronary artery disease (CAD); coronary heart disease (CHD); dyslipidemia; HDL/LDL cholesterol imbalance; hyperlipidemia; familial hyperlipidemia (FCHL); acquired hyperlipidemia; statin-resistant hypercholesterolemia; hypobetalipoproteinemia; hypercholesterolemia; lipid-induced endoplasmic reticulum stress; diabetes and insulin resistance. High levels of APOB reportedly are the primary driver of plaques that cause vascular disease (e.g., atherosclerosis), which are symptomatic of heart disease, stroke and many other dysfunctions. High levels of APOB are reportedly related to heart disease. Hypobetalipoproteinemia reportedly is a genetic disorder that can be caused by a mutation in the APOB gene. Abetalipoproteinaemia is reportedly usually caused by a mutation in the MTP gene, MTP. Mutations in the gene can reportedly also cause familial hypercholesterolemia, a hereditary (autosomal dominant) form of metabolic disorder Hypercholesterolemia. Overproduction of APOB can reportedly result in lipid-induced endoplasmic reticulum stress and insulin resistance in the liver.

In some embodiments, APOC3 is a gene, or a gene product thereof (including, but not limited to, a transcript or protein), also known as APOCIII, ApocIII, HALP2, apolipoprotein C3; OMIM: 107720; MGI: 88055; HomoloGene: 81615; or GeneCards: 345; or Human APOC3: Entrez 345; Ensembl: ENSG00000110245; UniProt: P02656; RefSeq (mRNA): NM_000040; RefSeq (protein): NP 000031.1; Location (UCSC): Chr 11: 116.83-116.83 Mb; Mouse Entrez 11814; Ensembl: ENSMUSG00000032081; UniProt: P33622; RefSeq (mRNA): NM_023114 NM_001289755 NM 001289756 NM 001289833; RefSeq (protein): NP 001276685.1 NP 075603.1; Location (UCSC): Chr 9: 46.23-46.24 Mb. APOC3 reportedly inhibits lipoprotein lipase and hepatic lipase; it is reported to inhibit hepatic uptake of triglyceride-rich particles. An increase in APOC3 levels reportedly induces the development of hypertriglyceridemia. Scientific papers reportedly suggest an intracellular role for APOC3 in promoting the assembly and secretion of triglyceride-rich VLDL particles from hepatic cells under lipid-rich conditions. However, two naturally-occurring point mutations in human APOC3 coding sequence, namely Ala23Thr and Lys58Glu, reportedly abolish the intracellular assembly and secretion of triglyceride-rich VLDL particles from hepatic cells. Two novel susceptibility haplotypes (specifically, P2-52-X1 and P1-S2-X1) have been reportedly discovered in ApoAI-CIII-AIV gene cluster on chromosome 11q23; these reportedly confer approximately threefold higher risk of coronary heart disease in normal as well as non-insulin diabetes mellitus. APOC3 delays the catabolism of triglyceride rich particles. Elevations of APOC3 found in genetic variation studies may predispose patients to non-alcoholic fatty liver disease. APOC3 expression has reportedly been implicated in various disorders, including but not limited to: atherosclerosis or dyslipidemia, elevated triglyceride levels, elevated cholesterol levels, elevated free fatty acids, and diabetes. Vaith et al. 1978 Biochimica et Biophysica Acta. 541 (2): 234-40; Nicolardi et al. 2013 Journal of Proteome Research. 12 (5): 2260-8; Mendivil et al. 2010 Arteriosclerosis, Thrombosis, and Vascular Biology. 30 (2): 239-45; Sundaram et al. 2010 Journal of Lipid Research. 51 (1): 150-161; Sundaram et al. 2010 Journal of Lipid Research. 51 (6): 1524-1534; Qin et al. August 2011 The Journal of Biological Chemistry. 286 (31): 27769-27780; Singh et al. November 2008 International Journal of Cardiology. 130 (3): e93-5; Singh et al. June 2007 Diabetes & Vascular Disease Research. 4 (2): 124-29.

In some embodiments, an APOC3-related disorder is a disorder related to, caused and/or associated with abnormal or excessive activity, level and/or expression of, a deleterious mutation in, or abnormal tissue or inter- or intracellular distribution of an APOC3 gene or a gene product thereof. In some embodiments, non-limiting examples of an APOC3-related disorder include: heart disease, atherosclerosis, dyslipidemia, elevated triglyceride levels (hypertriglyceridemia), elevated cholesterol levels (hypercholesterolemia), cardiovascular disease, metabolic syndrome, obesity and diabetes, premature chronic heart disease (CHD), eruptive xanthoma, hepatosplenomegaly, pancreatitis, aneurysm, angina, arrhythmia, atherosclerosis, cerebrovascular disease (stroke), hypertension, and hyperlipidemia. In some embodiments, non-limiting examples of an APOC3-related disorder include: hyperlipidemia, Type I diabetes, Type II diabetes mellitus, idiopathic Type I diabetes (Type Ib), latent autoimmune diabetes in adults (LADA), early-onset Type 2 diabetes (EOD), youth-onset atypical diabetes (YOAD), maturity onset diabetes of the young (MODY), malnutrition-related diabetes, gestational diabetes, coronary heart disease, ischemic stroke, restenosis after angioplasty, peripheral vascular disease, intermittent claudication, myocardial infarction, dyslipidemia, post-prandial lipemia, conditions of impaired glucose tolerance (IGT), conditions of impaired fasting plasma glucose, metabolic acidosis, ketosis, arthritis, obesity, osteoporosis, hypertension, congestive heart failure, left ventricular hypertrophy, peripheral arterial disease, diabetic retinopathy, macular degeneration, cataract, diabetic nephropathy, glomerulosclerosis, chronic renal failure, diabetic neuropathy, metabolic syndrome, syndrome X, premenstrual syndrome, angina pectoris, thrombosis, atherosclerosis, transient ischemic attacks, stroke, vascular restenosis, hyperglycemia, hyperinsulinemia, hypertrygliceridemia, insulin resistance, impaired glucose metabolism, erectile dysfunction, skin and connective tissue disorders, foot ulcerations and ulcerative colitis, endothelial dysfunction and impaired vascular compliance, hyper apo B lipoproteinemia, Alzheimer's, schizophrenia, impaired cognition, inflammatory bowel disease, ulcerative colitis, Crohn's disease, and irritable bowel syndrome, non-alcoholic steatohepatitis (NASH), or non-alcoholic fatty liver disease (NAFLD). portal hypertension, hepatic protein synthetic capability, hyperbilirubinemia, or encephalopathy. fatty liver, nonalcoholic fatty liver disease, nonalcoholic steatohepatitis, nonalcoholic steatohepatitis with liver fibrosis, nonalcoholic steatohepotitis with cirrhosis, or nonalcoholic steatohepatitis with cirrhosis and hepatocellular carcinoma.

In some embodiments, non-limiting examples of an APOC3-related disorder include: hyperlipidemia, Type I diabetes, Type II diabetes mellitus, idiopathic Type I diabetes (Type Ib), latent autoimmune diabetes in adults (LADA), early-onset Type 2 diabetes (EOD), youth-onset atypical diabetes (YOAD), maturity onset diabetes of the young (MODY), malnutrition-related diabetes, gestational diabetes, coronary heart disease, ischemic stroke, restenosis after angioplasty, peripheral vascular disease, intermittent claudication, myocardial infarction, dyslipidemia, post-prandial lipemia, conditions of impaired glucose tolerance (IGT), conditions of impaired fasting plasma glucose, metabolic acidosis, ketosis, arthritis, obesity, osteoporosis, hypertension, congestive heart failure, left ventricular hypertrophy, peripheral arterial disease, diabetic retinopathy, macular degeneration, cataract, diabetic nephropathy, glomerulosclerosis, chronic renal failure, diabetic neuropathy, metabolic syndrome, syndrome X, premenstrual syndrome, angina pectoris, thrombosis, atherosclerosis, transient ischemic attacks, stroke, vascular restenosis, hyperglycemia, hyperinsulinemia, hypertrygliceridemia, insulin resistance, impaired glucose metabolism, erectile dysfunction, skin and connective tissue disorders, foot ulcerations and ulcerative colitis, endothelial dysfunction and impaired vascular compliance, hyper apo B lipoproteinemia, Alzheimer's, schizophrenia, impaired cognition, inflammatory bowel disease, ulcerative colitis, Crohn's disease, and irritable bowel syndrome, non-alcoholic steatohepatitis (NASH), or non-alcoholic fatty liver disease (NAFLD).

In some embodiments, non-limiting examples of an APOC3-related disorder include: fatty liver, nonalcoholic fatty liver disease, nonalcoholic steatohepatitis, nonalcoholic steatohepatitis with liver fibrosis, nonalcoholic steatohepotitis with cirrhosis, or nonalcoholic steatohepatitis with cirrhosis and hepatocellular carcinoma.

In some embodiments, Factor XI is a gene, or a gene product thereof (including, but not limited to, a transcript or protein), also known as: F11, FXI, coagulation factor XI; External IDs: OMIM: 264900 MGI: 99481; HomoloGene: 86654; GeneCards: F11; Species: Human; Entrez: 2160; Ensembl: ENSG00000088926; UniProt: P03951; RefSeq (mRNA): NM_000128 NM_019559; RefSeq (protein): NP 000119; Location (UCSC): Chr 4: 186.27-186.29 Mb; Species: Mouse; Entrez: 109821; Ensembl: ENSMUSG00000031645; UniProt: Q91Y47; RefSeq (mRNA): NM_028066; RefSeq (protein): NP 082342.1 NP 082342; Location (UCSC): Chr 8: 45.24-45.26 Mb. Factor XI or plasma thromboplastin antecedent is reportedly the zymogen form of factor XIa, one of the enzymes of the coagulation cascade. Like many other coagulation factors, it is reportedly a serine protease. Deficiency of factor XI reportedly causes the rare hemophilia C; this mainly occurs in Ashkenazi Jews and is believed to affect approximately 8% of that population. Less commonly, hemophilia C can be reportedly found in Jews of Iraqi ancestry and in Israeli Arabs. The condition has been reportedly described in other populations at around 1% of cases. It is reportedly an autosomal recessive disorder. There is reportedly little spontaneous bleeding, but surgical procedures may cause excessive blood loss, and prophylaxis is required. Low levels of factor XI also reportedly occur in many other disease states, including Noonan syndrome. High levels of factor XI have reportedly been implicated in thrombosis. Asakai et al. 1987 Biochemistry. 26 (23): 7221-8; Kato et al. 1989 Cytogenetics and Cell Genetics. 52 (1-2): 77-8; Fujikawa et al. 1986 Biochemistry. 25 (9): 2417-24; Bolton-Maggs 1996 Bailliere's Clinical Haematology. 9 (2): 355-68; Buetow et al.

1991 American Journal of Human Genetics. 48 (5): 911-25; Emsley et al. 2010 Blood. 115 (13): 2569-77; Walsh 2001 Thrombosis and Haemostasis. 86 (1): 75-82; and Wu et al. 2008 The Journal of Biological Chemistry. 283 (27): 18655-64.

In some embodiments, a Factor XI-related disorder is a disorder related to, caused and/or associated with abnormal or excessive activity, level and/or expression of, a deleterious mutation in, or abnormal tissue or inter- or intracellular distribution of an Factor XI gene or a gene product thereof. Non-limiting examples of an Factor XI-related disorder, wherein the disorder is associated with an excessive activity, level and/or expression or abnormal distribution of Factor XI, include: thrombosis, myocardial infarction, ischemic stroke, cardio-embolism due to atrial fibrillation, vascular access thrombosis, deep venous thrombosis, arterial thrombosis, coronary artery thrombosis, atherosclerosis, arthritis, vasculitis, respiratory distress syndrome, ischemic heart disease, ischemic cerebral disease, pulmonary embolism, venous thrombo-embolism resulting from surgery or immobilization, thrombosis and occlusion of a synthetic graft, stent or AV-fistula, prosthetic heart valve, diffuse intravascular coagulation, hemodialysis, atrial fibrillation, sepsis, septic shock, organ failure, kidney failure, toxicity induced by the in vivo administration of a therapeutic protein, multiple trauma, ischemia-reperfusion injury, local undesired fibrin deposition or fibrin deposition in lung alveoli during adult respiratory distress; atrial fibrillation, unstable angina pectoris, venous thrombo-embolism, prosthetic heart valve, ischemic heart disease, ischemic cerebral disease, a vascular graft, diffuse intravascular coagulation, sepsis, prostate or orthopaedic surgery.

In some embodiments, Keratin 14 is a gene, or a gene product thereof (including, but not limited to, a transcript or protein), also known as: KRT, KRT14, CK14, EBS3, EBS4, K14, NFJ, keratin 14, cytokeratin-14 (CK-14) or keratin-14 (KRT14); External IDs: OMIM: 148066; MGI: 96688; HomoloGene: 110439; GeneCards: KRT14; Species: Human; Entrez: 3861; Ensembl: ENSG00000186847; UniProt: P02533; RefSeq (mRNA): NM_000526; RefSeq (protein): NP_000517; Location (UCSC): Chr 17: 41.58-41.59 Mb; Species: Mouse; Entrez: 16664; Ensembl: ENSMUSG00000045545; UniProt: Q61781; RefSeq (mRNA): NM_016958 NM_001313956 NM 001313957; RefSeq (protein): NP 001300886.1 NP 058654.1 NP 001300885 NP 001300886 NP 058654; Location (UCSC): Chr 11: 100.2-100.21 Mb. Keratin 14 is reportedly a member of the type I keratin family of intermediate filament proteins. Keratin 14 was the first type I keratin sequence determined. Keratin 14 is reportedly usually found as a heterodimer with type II keratin 5 and form the cytoskeleton of epithelial cells. Mutations in the genes for these keratins are reportedly associated with epidermolysis bullosa simplex and Dermatopathia pigmentosa reticularis, both of which are autosomal dominant mutations. Coulombe et al. 1991 Cell. 66 (6): 1301-11; Hanukoglu et al. 1982 Cell. 31 (1): 243-52; Lugassy et al. 2006 American Journal of Human Genetics. 79 (4): 724-30; Schweizer et al. 2006 The Journal of Cell Biology. 174 (2): 169-74.

In some embodiments, a Keratin 14-related disorder is a disorder related to, caused and/or associated with abnormal or excessive activity, level and/or expression or abnormal tissue or inter- or intracellular distribution of an Keratin 14 gene or a gene product thereof. Non-limiting examples of an Keratin 14-related disorder include: epidermolysis bullosa simplex and Dermatopathia pigmentosa reticularis.

In some embodiments, Myostatin or MSTN is a gene or a gene product thereof (including, but not limited to, a transcript or protein), also known as MSTN, growth differentiation factor 8, GDF8, MSLHP, myostatin; External IDs OMIM: 601788 MGI: 95691 HomoloGene: 3850 GeneCards: MSTN. Species: Human; Entrez: 2660; Ensembl: ENSG00000138379; UniProt: 014793; RefSeq (mRNA): NM_005259; RefSeq (protein): NP_005250; Location (UCSC): Chr 2: 190.06-190.06 Mb; Species: Mouse; Entrez: 17700; Ensembl: ENSMUSG00000026100; UniProt: 008689; RefSeq (mRNA): NM 010834; RefSeq (protein): NP_034964.1 NP_034964; Location (UCSC): Chr 1: 53.06-53.07 Mb. Myostatin is is reportedly a myokine, a protein produced and released by myocytes that acts on muscle cells' autocrine function to inhibit myogenesis or muscle cell growth and differentiation. Myostatin is reportedly a secreted growth differentiation factor that is a member of the TGF beta protein family. Animals either lacking myostatin or treated with substances that block the activity of myostatin reportedly have significantly more muscle mass. Furthermore, individuals who have mutations in both copies of the myostatin gene reportedly have significantly more muscle mass and are stronger than normal. Compositions such as oligonucleotides which decrease or inhibit myostatin reportedly may have therapeutic application in treating myostatin-related disorders, including, but not limited to, muscle wasting diseases such as muscular dystrophy or muscular atrophy. Gonzalez-Cadavid et al. 1998 Proceedings of the National Academy of Sciences of the United States of America. 95 (25): 14938-43; Carnac et al. 2006 Mini Reviews in Medicinal Chemistry. 6 (7): 765-70; Joulia-Ekaza et al. 2007 Current Opinion in Pharmacology. 7 (3): 310-5; Tsuchida 2008 Current Opinion in Drug Discovery & Development. 11 (4): 487-94; McPherron et al. 1997 Nature. 387 (6628): 83-90; Kambadur et al. 1997 Genome Research. 7 (9): 910-16; Clop et al. 2006 Nature Genetics. 38 (7): 813-18; Mosher et al. 2007 PLoS Genetics. 3 (5): e79.

In some embodiments, a Myostatin-related disorder or Myostatin (MSTN)-related disorder is a disorder related to, caused and/or associated with abnormal or excessive activity, level and/or expression of, a deleterious mutation in, or abnormal tissue or inter- or intracellular distribution of an ACVR2B gene or a gene product thereof. Non-limiting examples of an ACVR2B-related disorder include: musculoskeletal disease or disorder; muscle atrophy or dystrophy; muscle atrophy as a result of or associated with any of: treatment with a glucocorticoid such as cortisol, dexamethasone, betamethasone, prednisone, methylprednisolone, or prednisolone, denervation due to nerve trauma or a result of degenerative, metabolic, or inflammatory neuropathy (e.g., Guillian-Barre syndrome, peripheral neuropathy, or exposure to environmental toxins or drugs), or myopathy, such as myotonia; a congenital myopathy, including nemalene myopathy, multi/minicore myopathy and myotubular (centronuclear) myopathy; mitochondrial myopathy; familial periodic paralysis; inflammatory myopathy; metabolic myopathy, such as caused by a glycogen or lipid storage disease; dermatomyositisis; polymyositis; inclusion body myositis; myositis ossificans; rhabdomyolysis and myoglobinurias; a muscular dystrophy syndrome, such as Duchenne, Becker, myotonic, fascioscapulohumeral, Emery-Dreifuss, oculopharyngeal, scapulohumeral, limb girdle, Fukuyama, a congenital muscular dystrophy, or hereditary distal myopathy; osteoporosis, a bone fracture, short stature, or dwarfism; muscle atrophy as a result of or associated with an adult motor neuron disease, infantile spinal muscular atrophy, amyotrophic lateral sclerosis, juvenile spinal muscular atrophy, autoimmune motor neuropathy with multifocal conductor block, paralysis due to stroke or spinal cord injury, skeletal immobilization due to trauma, prolonged bed rest, voluntary inactivity, involuntary inactivity, metabolic stress or nutritional insufficiency, cancer, AIDS, fasting, a thyroid gland disorder, diabetes, benign congenital hypotonia, central core disease, burn injury, chronic obstructive pulmonary disease, liver diseases (examples such as fibrosis, cirrhosis), sepsis, renal failure, congestive heart failure, ageing, space travel or time spent in a zero gravity environment; sarcopenia, skin atrophy, muscle wasting, brain atrophy, atherosclerosis, arteriosclerosis, pulmonary emphysema, osteoporosis, osteoarthritis, immunologic incompetence, high blood pressure, dementia, Huntington's disease, Alzheimer's disease, cataracts, age-related macular degeneration, prostate cancer, stroke, diminished life expectancy, frailty, memory loss, wrinkles, impaired kidney function, and age-related hearing loss; metabolic disorders, including Type II Diabetes, Metabolic Syndrome, hyperglycemia, and obesity; or acute and/or chronic renal disease or failure, liver fibrosis or cirrhosis, cancer such as breast cancer, Parkinson's Disease; cachexia, cachexia associated with a rheumatoid arthritis and cachexia associated with cancer; conditions associated with neuronal death, such as ALS, brain atrophy, or dementia and anemia; or a disorder which causes or is associated with muscle atrophy.

In some embodiments, PCSK9 is a gene, or a gene product thereof (including, but not limited to, a transcript or protein), also known as: PCSK9, proprotein convertase subtilisin/kexin type 9, FH3, HCHOLA3, LDLCQ1, NARC-1, NARC1, PC9; External IDs: MGI: 2140260; HomoloGene: 17790; GeneCards: PCSK9; Species: Human; Entrez: 255738; Ensembl: ENSG00000169174; UniProt: Q8NBP7; RefSeq (mRNA): NM_174936; RefSeq (protein): NP_777596; Location (UCSC): Chr 1: 55.04-55.06 Mb; Species: Mouse; Entrez: 100102; Ensembl: ENSMUSG00000044254; UniProt: Q80W65; RefSeq (mRNA): NM_153565; RefSeq (protein): NP_705793.1 NP_705793; Location (UCSC): Chr 4: 106.44-106.46 Mb. Proprotein convertase subtilisin/kexin type 9 (PCSK9) is reportedly an enzyme encoded by the PCSK9 gene in humans on chromosome 1. It is ubiquitously expressed in many tissues and cell types. PCSK9 reportedly binds to the receptor for low-density lipoprotein particles (LDL), which typically transport 3,000 to 6,000 fat molecules (including cholesterol) per particle, within extracellular fluid. The LDL receptor (LDLR), on liver and other cell membranes, reportedly binds and initiates ingestion of LDL-particles from extracellular fluid into cells, thus reducing LDL particle concentrations. However, reportedly when PCSK9 is bound to the LDLR, after the LDLR and LDL particle combination has been ingested, the receptor is degraded and is no longer recycled back to the cell membrane surface to bind and ingest more LDL-particles. If PCSK9 is blocked, more LDLRs are reportedly recycled and are present on the surface of cells to remove LDL-particles from the extracellular fluid. Therefore, blocking PCSK9 can lower blood LDL-particle concentrations. PCSK9 is reportedly inactive when first synthesized, because a section of peptide chains blocks their activity; proprotein convertases remove that section to activate the enzyme. PCSK9 has reportedly medical importance because it acts in lipoprotein homeostasis. Agents which block PCSK9 reportedly have the potential to lower LDL particle concentrations. Kazi et al. 2016 JAMA. 316 (7): 743-753; Mega et al. 2015 Lancet. 385 (9984): 2264-71; Bottomley et al. 2009 The Journal of Biological Chemistry. 284 (2): 1313-23; Doggrell et al. 2015 Expert Opinion on Biological Therapy. 15 (12): 1671-5; Everett et al. 2015 The New England Journal of Medicine. 373 (17): 1588-91; Gustafsen et al. 2014 Cell Metabolism. 19 (2): 310-8; Joseph et al. 2015 Progress in Cardiovascular Diseases. 58 (1): 19-31; Kwon et al. 2008 Proceedings of the National Academy of Sciences of the United States of America. 105 (6): 1820-5; Le May et al. 2009 Arteriosclerosis, Thrombosis, and Vascular Biology. 29 (5): 684-90; Lo Surdo et al. 2011 EMBO Reports. 12 (12): 1300-5; Piper et al. 2007 Structure. 15 (5): 545-52; Rashid et al. 2014 Circulation. 130 (5): 431-41; Weinreich et al. 2014 Cardiology in Review. 22 (3): 140-6; Seidah et al. 2003 Proc. Natl. Acad. Sci. U.S.A. 100 (3): 928-33; Zhang et al. 2007 J Biol. Chem. 282: 18602-18612; Du et al. 2011 The Journal of Biological Chemistry. 286 (50): 43054-61; Norata et al. 2014 Annual Review of Pharmacology and Toxicology. 54: 273-93; Lagace 2014 Current Opinion in Lipidology. 25 (5): 387-93; Bergeron et al. 2015 Circulation. 132 (17): 1648-66.

In some embodiments, a PCSK9-related disorder is a disorder related to, caused and/or associated with abnormal or excessive activity, level and/or expression or abnormal tissue or inter- or intracellular distribution of an PCSK9 gene or a gene product thereof. Non-limiting examples of an PCSK9-related disorder include: atherosclerosis; hyperlipoproteinemia; hypercholesterolemia; cardiovascular disease; obesity; hypertension; elevated total cholesterol levels; elevated non-high-density lipoprotein (HDL) cholesterol levels; elevated low-density lipoprotein (LDL-C) levels; elevated apolipoprotein B100 (APOB100) levels; hyperlipidemia; dyslipidemia; atherosclerosis; cardiovascular diseases; coronary heart disease (CHD); primary hypercholesterolemia; familial non-familial hypercholesterolemia; heterozygous familial hypercholesterolemia (heFH); hypercholesteremia that is uncontrolled by statins; and hypercholesterolemia that is resistant to statins.

In some embodiments, PNPLA3 is a gene, or a gene product thereof (including, but not limited to, a transcript or protein), also known as: PNPLA3, adiponutrin, ADPN, C22orf20, acylglycerol O-acyltransferase or calcium-independent phospholipase A2-epsilon, iPLA(2)epsilon, patatin-like phospholipase domain-containing 3; External IDs: MGI: 2151796; HomoloGene: 11883; GeneCards: PNPLA3; Species; Human: Entrez; 80339; Ensembl; ENSG00000100344; UniProt; Q9NST1; RefSeq (mRNA); NM_025225; RefSeq (protein); NP_079501; Location (UCSC); Chr 22: 43.92-43.96 Mb; Species; Mouse: Entrez; 116939; Ensembl; ENSMUSG00000041653; UniProt; Q91WW7; RefSeq (mRNA); NM_054088; RefSeq (protein); NP_473429.2 NP_473429; Location (UCSC); Chr 15: 84.17-84.19 Mb. Patatin-like phospholipase domain-containing protein 3 (PNPLA3) also known as adiponutrin (ADPN), acylglycerol O-acyltransferase or calcium-independent phospholipase A2-epsilon (iPLA2-epsilon) is reportedly an enzyme that in humans is encoded by the PNPLA3 gene. PNPLA3 encodes a 481 amino acid protein that belongs to the patatin-like phospholipase family. The progenitor of this family, patatin, is reportedly a major protein of potato tubers and has nonspecific lipid acyl hydrolase activity. A variant (I148M) in PNPLA3 (Patatin-like phospholipase domain containing 3) was reportedly strongly associated with increased hepatic fat levels and with hepatic inflammation. A marker of PNPLA3-I148M is reportedly SNP rs738409. The association between PNPLA3-I148M and hepatic fat content reportedly remained highly significant after adjusting for BMI, diabetes status, ethanol use, as well as global and local ancestry, and was associated with a significant increase in liver TG content in all three ethnic groups. The frequencies of the PNPLA3-I148M allele reportedly mirrored the relative prevalence of NAFLD in the three ethnic groups; the highest frequency was in Hispanics (0.49), with lower frequencies observed in European Americans (0.23) and African-Americans (0.17). Collins et al. 2003 Genome Res. 13 (1): 27-36; Collins et al. 2005 Genome Biol. 5 (10): R84; Dunham et al. 1999 Nature. 402 (6761): 489-95; Gerhard et al. 2004 Genome Res. 14 (10B): 2121-7; Jenkins et al. 2005 J. Biol. Chem. 279 (47): 48968-75; Kienesberger et al. 2009 J. Lipid Res. 50 Suppl.: S63-8; Lake et al. 2006 J. Lipid Res. 46 (11): 2477-87; Liu et al. 2004 J. Clin. Endocrinol. Metab. 89 (6): 2684-9; Strausberg et al. 2003 Proc. Natl. Acad. Sci. U.S.A. 99 (26): 16899-903; Wilson et al. 2006 J Lipid Res. 47 (9): 1940-9.

In some embodiments, a PNPLA3-related disorder is a disorder related to, caused and/or associated with abnormal or excessive activity, level and/or expression or abnormal tissue or inter- or intracellular distribution of an PNPLA3 gene or a gene product thereof. Non-limiting examples of an PNPLA3-related disorder include: liver disease, fatty liver (e.g., accumulation of fat in the liver, or an increase in or supra-normal hepatic fat), hepatic steatosis (e.g., simple fatty liver), steatohepatitis, hepatitis, nonalcoholic fatty liver disease (e.g., NAFLD), and/or one or more disease and/or one or more symptom or condition associated with or secondary to a liver disease, including but not limited to: inflammation, destruction of liver cells (e.g., hepatocellular necrosis), scarring of the liver (e.g., fibrosis), irreversible, advanced scarring of the liver (e.g., cirrhosis), insulin resistance, diabetes, dyslipidemia, increased protein activity in the hedgehog (Hh) signaling pathway, fatigue, weakness, nausea, abdominal pain, spider-like blood vessels, jaundice, itching, edema, ascites, mental confusion, obesity, hepatocellular carcinoma.

In some embodiments, non-limiting examples of a PNPLA3-related disorder include: hyperlipidemia, Type I diabetes, Type II diabetes mellitus, idiopathic Type I diabetes (Type Ib), latent autoimmune diabetes in adults (LADA), early-onset Type 2 diabetes (EOD), youth-onset atypical diabetes (YOAD), maturity onset diabetes of the young (MODY), malnutrition-related diabetes, gestational diabetes, coronary heart disease, ischemic stroke, restenosis after angioplasty, peripheral vascular disease, intermittent claudication, myocardial infarction, dyslipidemia, post-prandial lipemia, conditions of impaired glucose tolerance (IGT), conditions of impaired fasting plasma glucose, metabolic acidosis, ketosis, arthritis, obesity, osteoporosis, hypertension, congestive heart failure, left ventricular hypertrophy, peripheral arterial disease, diabetic retinopathy, macular degeneration, cataract, diabetic nephropathy, glomerulosclerosis, chronic renal failure, diabetic neuropathy, metabolic syndrome, syndrome X, premenstrual syndrome, angina pectoris, thrombosis, atherosclerosis, transient ischemic attacks, stroke, vascular restenosis, hyperglycemia, hyperinsulinemia, hypertrygliceridemia, insulin resistance, impaired glucose metabolism, erectile dysfunction, skin and connective tissue disorders, foot ulcerations and ulcerative colitis, endothelial dysfunction and impaired vascular compliance, hyper apo B lipoproteinemia, Alzheimer's, schizophrenia, impaired cognition, inflammatory bowel disease, ulcerative colitis, Crohn's disease, and irritable bowel syndrome, non-alcoholic steatohepatitis (NASH), or non-alcoholic fatty liver disease (NAFLD).

In some embodiments, non-limiting examples of a PNPLA3-related disorder include: fatty liver, nonalcoholic fatty liver disease, nonalcoholic steatohepatitis, nonalcoholic steatohepatitis with liver fibrosis, nonalcoholic steatohepotitis with cirrhosis, or nonalcoholic steatohepatitis with cirrhosis and hepatocellular carcinoma.

In some embodiments, provided oligonucleotides can be used to treat or used to manufacture a medicament for treatment of a disorder related to a specific gene or gene product. The present disclosure pertains to methods of using oligonucleotides disclosed herein which are capable of targeting ACVR2B and useful for treating and/or manufacturing a treatment for a ACVR2B-related disorder. The present disclosure pertains to methods of using oligonucleotides disclosed herein which are capable of targeting APOB and useful for treating and/or manufacturing a treatment for a APOB-related disorder. The present disclosure pertains to methods of using oligonucleotides disclosed herein which are capable of targeting APOC3 and useful for treating and/or manufacturing a treatment for a APOC3-related disorder. The present disclosure pertains to methods of using oligonucleotides disclosed herein which are capable of targeting FXI (Factor XI) and useful for treating and/or manufacturing a treatment for a FXI (Factor XI)-related disorder. The present disclosure pertains to methods of using oligonucleotides disclosed herein which are capable of targeting KRT or KRT14 and useful for treating and/or manufacturing a treatment for a KRT or KRT14-related disorder. The present disclosure pertains to methods of using oligonucleotides disclosed herein which are capable of targeting myostatin (MSTN) and useful for treating and/or manufacturing a treatment for a myostatin (MSTN)-related disorder. The present disclosure pertains to methods of using oligonucleotides disclosed herein which are capable of targeting PCSK9 and useful for treating and/or manufacturing a treatment for a PCSK9-related disorder. The present disclosure pertains to methods of using oligonucleotides disclosed herein which are capable of targeting PNPLA3 and useful for treating and/or manufacturing a treatment for a PNPLA3-related disorder. In some embodiments, a base sequence of an oligonucleotide or a single-stranded RNAi agent can comprise or consist of a base sequence which has a specified maximum number of mismatches from a specified base sequence.

Treatment of a ACVR2B-Related Disorder

In some embodiments, the present disclosure pertains to an oligonucleotide which targets ACVR2B (e.g., an oligonucleotide comprising a ACVR2B target sequence or a sequence complementary to a ACVR2B target sequence). In some embodiments, the present disclosure pertains to an oligonucleotide which directs target-specific knockdown of ACVR2B. In some embodiments, the present disclosure pertains to an oligonucleotide which directs target-specific knockdown of ACVR2B mediated by RNase H and/or RNA interference. Various such oligonucleotides capable of targeting ACVR2B are disclosed herein.

In some embodiments, non-limiting examples of an ACVR2B-related disorder include: musculoskeletal disease or disorder; muscle atrophy or dystrophy; muscle atrophy as a result of or associated with any of: treatment with a glucocorticoid such as cortisol, dexamethasone, betamethasone, prednisone, methylprednisolone, or prednisolone, denervation due to nerve trauma or a result of degenerative, metabolic, or inflammatory neuropathy (e.g., Guillian-Barre syndrome, peripheral neuropathy, or exposure to environmental toxins or drugs), or myopathy, such as myotonia; a congenital myopathy, including nemalene myopathy, multi/minicore myopathy and myotubular (centronuclear) myopathy; mitochondrial myopathy; familial periodic paralysis; inflammatory myopathy; metabolic myopathy, such as caused by a glycogen or lipid storage disease; dermatomyositisis; polymyositis; inclusion body myositis; myositis ossificans; rhabdomyolysis and myoglobinurias; a muscular dystrophy syndrome, such as Duchenne, Becker, myotonic, fascioscapulohumeral, Emery-Dreifuss, oculopharyngeal, scapulohumeral, limb girdle, Fukuyama, a congenital muscular dystrophy, or hereditary distal myopathy; osteoporosis, a bone fracture, short stature, or dwarfism; muscle atrophy as a result of or associated with an adult motor neuron disease, infantile spinal muscular atrophy, amyotrophic lateral sclerosis, juvenile spinal muscular atrophy, autoimmune motor neuropathy with multifocal conductor block, paralysis due to stroke or spinal cord injury, skeletal immobilization due to trauma, prolonged bed rest, voluntary inactivity, involuntary inactivity, metabolic stress or nutritional insufficiency, cancer, AIDS, fasting, a thyroid gland disorder, diabetes, benign congenital hypotonia, central core disease, burn injury, chronic obstructive pulmonary disease, liver diseases (examples such as fibrosis, cirrhosis), sepsis, renal failure, congestive heart failure, ageing, space travel or time spent in a zero gravity environment; sarcopenia, skin atrophy, muscle wasting, brain atrophy, atherosclerosis, arteriosclerosis, pulmonary emphysema, osteoporosis, osteoarthritis, immunologic incompetence, high blood pressure, dementia, Huntington's disease, Alzheimer's disease, cataracts, age-related macular degeneration, prostate cancer, stroke, diminished life expectancy, frailty, memory loss, wrinkles, impaired kidney function, and age-related hearing loss; metabolic disorders, including Type II Diabetes, Metabolic Syndrome, hyperglycemia, and obesity; or acute and/or chronic renal disease or failure, liver fibrosis or cirrhosis, cancer such as breast cancer, Parkinson's Disease; cachexia, cachexia associated with a rheumatoid arthritis and cachexia associated with cancer; conditions associated with neuronal death, such as ALS, brain atrophy, or dementia and anemia; or a disorder which causes or is associated with muscle atrophy.

In some embodiments, the present disclosure pertains to a method of treating or ameliorating an ACVR2B-related disorder in a patient thereof, the method comprising the step of administering to the patient a therapeutically effective amount of an oligonucleotide which targets ACVR2B.

In some embodiments, the present disclosure pertains to a method of treating or ameliorating an ACVR2B-related disorder in a patient thereof, the method comprising the step of administering to the patient a therapeutically effective amount of an oligonucleotide which targets ACVR2B.

In some embodiments, the present disclosure pertains to a method for introducing an oligonucleotide that decreases ACVR2B gene expression into a cell, the method comprising: contacting the cell with an oligonucleotide. In some embodiments, the oligonucleotide is an antisense oligonucleotide or single-stranded RNAi agent.

In some embodiments, the present disclosure pertains to a method for decreasing ACVR2B gene expression in a mammal in need thereof, the method comprising: administering to the mammal a nucleic acid-lipid particle comprising an oligonucleotide which targets ACVR2B. In some embodiments, the oligonucleotide is an antisense oligonucleotide or single-stranded RNAi agent.

In some embodiments, the present disclosure pertains to a method for the in vivo delivery of an oligonucleotide that targets ACVR2B gene expression, the method comprising: administering to a mammal an oligonucleotide which targets ACVR2B. In some embodiments, the oligonucleotide is an antisense oligonucleotide or single-stranded RNAi agent. In some embodiments, the mammal is a human. In some embodiments, the mammal is afflicted with and/or suffering from a ACVR2B-related disorder.

In some embodiments, the present disclosure pertains to a method for treating and/or ameliorating one or more symptoms associated with a ACVR2B-related disorder in a mammal in need thereof, the method comprising: administering to the mammal a therapeutically effective amount of an oligonucleotide which targets ACVR2B. In some embodiments, the present disclosure pertains to a method for reducing susceptibility to a ACVR2B-related disorder in a mammal in need thereof, the method comprising: administering to the mammal a therapeutically effective amount of an oligonucleotide which targets ACVR2B. In some embodiments, the present disclosure pertains to a method for preventing or delaying the onset of a ACVR2B-related disorder in a mammal in need thereof, the method comprising: administering to the mammal a therapeutically effective amount of an oligonucleotide which targets ACVR2B. In some embodiments, the present disclosure pertains to a method for treating and/or ameliorating one or more symptoms associated with a ACVR2B-related disorder in a mammal in need thereof, the method comprising: administering to the mammal a therapeutically effective amount of a nucleic acid-lipid particle comprising an oligonucleotide which targets ACVR2B. In some embodiments, the present disclosure pertains to a method for reducing susceptibility to a ACVR2B-related disorder in a mammal in need thereof, the method comprising: administering to the mammal a therapeutically effective amount of a nucleic acid-lipid particle comprising an oligonucleotide which targets ACVR2B. In some embodiments, the present disclosure pertains to a method for preventing or delaying the onset of a ACVR2B-related disorder in a mammal in need thereof, the method comprising: administering to the mammal a therapeutically effective amount of a nucleic acid-lipid particle comprising an oligonucleotide which targets ACVR2B. In some embodiments, the oligonucleotide is an antisense oligonucleotide or single-stranded RNAi agent. In some embodiments, the mammal is a human. In some embodiments, the mammal is afflicted with and/or suffering from a ACVR2B-related disorder.

In some embodiments, the present disclosure pertains to a method of inhibiting ACVR2B expression in a cell, the method comprising: (a) contacting the cell with an oligonucleotide which targets ACVR2B; and (b) maintaining the cell produced in step (a) for a time sufficient to obtain degradation of the mRNA transcript of an ACVR2B gene, thereby inhibiting expression of the ACVR2B gene in the cell. In some embodiments, ACVR2B expression is inhibited by at least 30%. In some embodiments, the oligonucleotide is an antisense oligonucleotide or single-stranded RNAi agent.

In some embodiments, the present disclosure pertains to a method of treating a disorder mediated by ACVR2B expression comprising administering to a human in need of such treatment a therapeutically effective amount of an oligonucleotide which targets ACVR2B. In some embodiments, the oligonucleotide is an antisense oligonucleotide or single-stranded RNAi agent.

In some embodiments, the present disclosure pertains to a compound comprising an oligonucleotide which targets ACVR2B for use in a subject to treat a ACVR2B-related disorder.

In some embodiments, a subject is administered a second agent. In some embodiments, the second agent is an oligonucleotide. In some embodiments, the oligonucleotide targets ACVR2B. In some embodiments, the oligonucleotide is an antisense oligonucleotide or single-stranded RNAi agent.

Treatment of an APOB-Related Disorder

In some embodiments, the present disclosure pertains to an oligonucleotide or a single-stranded RNAi agent to APOB. Various single-stranded RNAi agents to APOB are disclosed herein.

In some embodiments, the present disclosure pertains to treatment of an APOB-related disorder. In some embodiments, an APOB-related disorder is selected from: a metabolic disorder, cardiovascular disease, atherosclerosis, stroke, heart disease, coronary artery disease (CAD), coronary heart disease (CHD), dyslipidemia, HDL/LDL cholesterol imbalance, hyperlipidemia, familial hyperlipidemia (FCHL), acquired hyperlipidemia, statin-resistant hypercholesterolemia, hypobetalipoproteinemia, hypercholesterolemia, lipid-induced endoplasmic reticulum stress, diabetes and insulin resistance.

In some embodiments, the present disclosure pertains to a method for introducing an oligonucleotide or a single-stranded RNAi agent that decreases APOB gene expression into a cell, the method comprising: contacting the cell with an oligonucleotide or a single-stranded RNAi agent.

In some embodiments, the present disclosure pertains to a method for decreasing APOB gene expression in a mammal in need thereof, the method comprising: administering to the mammal a nucleic acid-lipid particle comprising an oligonucleotide or a single-stranded RNAi agent to APOB.

In some embodiments, the present disclosure pertains to a method for the in vivo delivery of an oligonucleotide or a single-stranded RNAi agent that targets APOB gene expression, the method comprising: administering to a mammal an oligonucleotide or a single-stranded RNAi agent to APOB.

In some embodiments, the present disclosure pertains to a method for treating and/or ameliorating one or more symptoms associated with atherosclerosis or dyslipidemia in a mammal in need thereof, the method comprising: administering to the mammal a therapeutically effective amount of an oligonucleotide or a single-stranded RNAi agent to APOB.

In some embodiments, the present disclosure pertains to a method for reducing susceptibility to atherosclerosis or dyslipidemia in a mammal in need thereof, the method comprising: administering to the mammal a therapeutically effective amount of an oligonucleotide or a single-stranded RNAi agent to APOB.

In some embodiments, the present disclosure pertains to a method for preventing or delaying the onset of atherosclerosis or dyslipidemia in a mammal in need thereof, the method comprising: administering to the mammal a therapeutically effective amount of an oligonucleotide or a single-stranded RNAi agent to APOB.

In some embodiments, the present disclosure pertains to a method for lowering triglyceride levels in a mammal in need thereof, the method comprising: administering to the mammal a therapeutically effective amount of an oligonucleotide or a single-stranded RNAi agent to APOB.

In some embodiments, the present disclosure pertains to a method for treating and/or ameliorating one or more symptoms associated with atherosclerosis or dyslipidemia in a mammal in need thereof, the method comprising: administering to the mammal a therapeutically effective amount of a nucleic acid-lipid particle comprising an oligonucleotide or a single-stranded RNAi agent to APOB.

In some embodiments, the present disclosure pertains to a method for reducing susceptibility to atherosclerosis or dyslipidemia in a mammal in need thereof, the method comprising: administering to the mammal a therapeutically effective amount of a nucleic acid-lipid particle comprising an oligonucleotide or a single-stranded RNAi agent to APOB.

In some embodiments, the present disclosure pertains to a method for preventing or delaying the onset of atherosclerosis or dyslipidemia in a mammal in need thereof, the method comprising: administering to the mammal a therapeutically effective amount of a nucleic acid-lipid particle comprising an oligonucleotide or a single-stranded RNAi agent to APOB.

In some embodiments, the present disclosure pertains to a method for lowering triglyceride levels in a mammal in need thereof, the method comprising: administering to the mammal a therapeutically effective amount of a nucleic acid-lipid particle comprising an oligonucleotide or a single-stranded RNAi agent to APOB.

In some embodiments, the present disclosure pertains to a method for lowering cholesterol levels in a mammal in need thereof, the method comprising: administering to the mammal a therapeutically effective amount of an oligonucleotide or a single-stranded RNAi agent to APOB.

In some embodiments, the present disclosure pertains to a method for lowering cholesterol levels in a mammal in need thereof, the method comprising: administering to the mammal a therapeutically effective amount of a nucleic acid-lipid particle comprising an oligonucleotide or a single-stranded RNAi agent to APOB.

In some embodiments, the present disclosure pertains to a method of inhibiting APOB expression in a cell, the method comprising: (a) contacting the cell with an oligonucleotide or a single-stranded RNAi agent to APOB; and (b) maintaining the cell produced in step (a) for a time sufficient to obtain degradation of the mRNA transcript of an APOB gene, thereby inhibiting expression of the APOB gene in the cell.

In some embodiments, APOB expression is inhibited by at least 30%.

In some embodiments, the present disclosure pertains to a method of treating a disorder mediated by APOB expression comprising administering to a human in need of such treatment a therapeutically effective amount of an oligonucleotide or a single-stranded RNAi agent to APOB.

In some embodiments, the disorder is elevated triglyceride levels.

In some embodiments, the disorder is triglyceride levels >150 mg/dL or >500 mg/dL.

In some embodiments, administration causes an increase in lipoprotein lipase and/or hepatic lipase activity.

In some embodiments, the present disclosure pertains to a method of improving peripheral insulin sensitivity comprising administering to a subject with diabetes an oligonucleotide or a single-stranded RNAi agent to APOB thereby improving peripheral insulin sensitivity.

In some embodiments, the present disclosure pertains to a method of improving peripheral insulin sensitivity comprising administering to a subject with moderately controlled type II diabetes and administering an oligonucleotide or a single-stranded RNAi agent to APOB thereby improving peripheral insulin sensitivity.

In some embodiments, the present disclosure pertains to a method of lowering free fatty acids comprising administering to a subject with diabetes and administering an oligonucleotide or a single-stranded RNAi agent APOB, thereby lowering free fatty acids.

In some embodiments, the present disclosure pertains to a method of lowering free fatty acids comprising administering to a subject with moderately controlled type II diabetes and administering an oligonucleotide or a single-stranded RNAi agent to APOB, thereby lowering free fatty acids.

In some embodiments, the present disclosure pertains to a method of reducing intramyocellular triglyceride deposition comprising administering to a subject with diabetes and administering an oligonucleotide or a single-stranded RNAi agent to APOB, thereby reducing intramyocellular triglyceride deposition.

In some embodiments, the present disclosure pertains to a method of reducing intramyocellular triglyceride deposition comprising administering to a subject with moderately controlled type II diabetes and administering an oligonucleotide or a single-stranded RNAi agent to APOB, thereby reducing intramyocellular triglyceride deposition.

In some embodiments, the present disclosure pertains to a method of improving a lipid profile of a subject comprising administering to the subject an oligonucleotide or a single-stranded RNAi agent to APOB, wherein free fatty acids, triglycerides, non-HDL-C, VLDL-C, VLDL, LDL, IDL and LDL-C and/or HDL-C levels are disturbed, thereby improving the lipid profile of the subject.

In some embodiments, the subject is on a stable dose of metformin.

In some embodiments, the present disclosure pertains to a compound comprising an oligonucleotide or a single-stranded RNAi agent to APOB for use in a subject to: improve peripheral insulin sensitivity; lower free fatty acids; reduce intramyocellular triglyceride deposition; improve a lipid profile; and/or improve a diabetic profile.

In some embodiments, a subject is administered a second agent.

In some embodiments, the second agent is selected from an APOB lowering agent, cholesterol lowering agent, non-HDL lipid lowering agent, LDL lowering agent, TG lowering agent, cholesterol lowering agent, HDL raising agent, fish oil, niacin, fibrate, statin, DCCR (salt of diazoxide), glucose-lowering agent or anti-diabetic agents.

Treatment of an APOC3-Related Disorder

In some embodiments, the present disclosure pertains to an oligonucleotide or a single-stranded RNAi agent to APOC3. Various single-stranded RNAi agents to APOC3 are disclosed herein.

APOC3 expression has reportedly been implicated in various disorders, including but not limited to: atherosclerosis or dyslipidemia, elevated triglyceride levels, elevated cholesterol levels, elevated free fatty acids, and diabetes. In some embodiments, the present disclosure pertains to a method of treating or ameliorating an APOC3-related disorder in a patient thereof, the method comprising the step of administering to the patient a therapeutically effective amount of an oligonucleotide or a single-stranded RNAi agent to APOC3.

In some embodiments, the present disclosure pertains to a method for introducing an oligonucleotide or a single-stranded RNAi agent that decreases APOC3 gene expression into a cell, the method comprising: contacting the cell with an oligonucleotide or a single-stranded RNAi agent.

In some embodiments, the present disclosure pertains to a method for decreasing APOC3 gene expression in a mammal in need thereof, the method comprising: administering to the mammal a nucleic acid-lipid particle comprising an oligonucleotide or a single-stranded RNAi agent to APOC3.

In some embodiments, the present disclosure pertains to a method for the in vivo delivery of an oligonucleotide or a single-stranded RNAi agent that targets APOC3 gene expression, the method comprising: administering to a mammal an oligonucleotide or a single-stranded RNAi agent to APOC3.

In some embodiments, the present disclosure pertains to a method for treating and/or ameliorating one or more symptoms associated with atherosclerosis or dyslipidemia in a mammal in need thereof, the method comprising: administering to the mammal a therapeutically effective amount of an oligonucleotide or a single-stranded RNAi agent to APOC3.

In some embodiments, the present disclosure pertains to a method for reducing susceptibility to atherosclerosis or dyslipidemia in a mammal in need thereof, the method comprising: administering to the mammal a therapeutically effective amount of an oligonucleotide or a single-stranded RNAi agent to APOC3.

In some embodiments, the present disclosure pertains to a method for preventing or delaying the onset of atherosclerosis or dyslipidemia in a mammal in need thereof, the method comprising: administering to the mammal a therapeutically effective amount of an oligonucleotide or a single-stranded RNAi agent to APOC3.

In some embodiments, the present disclosure pertains to a method for lowering triglyceride levels in a mammal in need thereof, the method comprising: administering to the mammal a therapeutically effective amount of an oligonucleotide or a single-stranded RNAi agent to APOC3.

In some embodiments, the method of the present disclosure is for the treatment of hyperlipidemia, Type I diabetes, Type II diabetes mellitus, idiopathic Type I diabetes (Type Ib), latent autoimmune diabetes in adults (LADA), early-onset Type 2 diabetes (EOD), youth-onset atypical diabetes (YOAD), maturity onset diabetes of the young (MODY), malnutrition-related diabetes, gestational diabetes, coronary heart disease, ischemic stroke, restenosis after angioplasty, peripheral vascular disease, intermittent claudication, myocardial infarction, dyslipidemia, post-prandial lipemia, conditions of impaired glucose tolerance (IGT), conditions of impaired fasting plasma glucose, metabolic acidosis, ketosis, arthritis, obesity, osteoporosis, hypertension, congestive heart failure, left ventricular hypertrophy, peripheral arterial disease, diabetic retinopathy, macular degeneration, cataract, diabetic nephropathy, glomerulosclerosis, chronic renal failure, diabetic neuropathy, metabolic syndrome, syndrome X, premenstrual syndrome, angina pectoris, thrombosis, atherosclerosis, transient ischemic attacks, stroke, vascular restenosis, hyperglycemia, hyperinsulinemia, hypertryglicerideemia, elevated low density lipoprotein (LDL) cholesterol levels (hypercholesterolemia), insulin resistance, impaired glucose metabolism, erectile dysfunction, skin and connective tissue disorders, foot ulcerations and ulcerative colitis, endothelial dysfunction and impaired vascular compliance, hyper apo B lipoproteinemia, Alzheimer's, schizophrenia, impaired cognition, inflammatory bowel disease, ulcerative colitis, Crohn's disease, and irritable bowel syndrome, non-alcoholic steatohepatitis (NASH), or non-alcoholic fatty liver disease (NAFLD), in humans wherein the method comprises administering to a subject a therapeutically effective amount of an oligonucleotide of the present disclosure.

In some embodiments, the method reduces portal hypertension, hepatic protein synthetic capability, hyperbilirubinemia, or encephalopathy wherein the method comprise administering to a subject a therapeutically effective amount of an oligonucleotide of the present disclosure.

The present disclosure is also directed at a method for the treatment of reduction of at least one point in severity of nonalcoholic fatty liver disease or non-alcoholic steatohepatitis grading scoring systems, reduction of the level of serum markers of non-alcoholic steatohepatitis activity, reduction of non-alcoholic steatohepatitis disease activity or reduction in the medical consequences of non-alcoholic steatohepatitis in humans administering to a subject a therapeutically effective amount of an oligonucleotide of the present disclosure. In some embodiments, the present disclosure pertains to a method for treating and/or ameliorating one or more symptoms associated with atherosclerosis or dyslipidemia in a mammal in need thereof, the method comprising: administering to the mammal a therapeutically effective amount of a nucleic acid-lipid particle comprising an oligonucleotide or a single-stranded RNAi agent to APOC3.

In some embodiments, the present disclosure pertains to a method for reducing susceptibility to atherosclerosis or dyslipidemia in a mammal in need thereof, the method comprising: administering to the mammal a therapeutically effective amount of a nucleic acid-lipid particle comprising an oligonucleotide or a single-stranded RNAi agent to APOC3.

In some embodiments, the present disclosure pertains to a method for preventing or delaying the onset of atherosclerosis or dyslipidemia in a mammal in need thereof, the method comprising: administering to the mammal a therapeutically effective amount of a nucleic acid-lipid particle comprising an oligonucleotide or a single-stranded RNAi agent to APOC3.

In some embodiments, the present disclosure pertains to a method for lowering triglyceride levels in a mammal in need thereof, the method comprising: administering to the mammal a therapeutically effective amount of a nucleic acid-lipid particle comprising an oligonucleotide or a single-stranded RNAi agent to APOC3.

In some embodiments, the present disclosure pertains to a method for lowering cholesterol levels in a mammal in need thereof, the method comprising: administering to the mammal a therapeutically effective amount of an oligonucleotide or a single-stranded RNAi agent to APOC3.

In some embodiments, the present disclosure pertains to a method for lowering cholesterol levels in a mammal in need thereof, the method comprising: administering to the mammal a therapeutically effective amount of a nucleic acid-lipid particle comprising an oligonucleotide or a single-stranded RNAi agent to APOC3.

In some embodiments, the present disclosure pertains to a method of inhibiting APOC3 expression in a cell, the method comprising: (a) contacting the cell with an oligonucleotide or a single-stranded RNAi agent to APOC3; and (b) maintaining the cell produced in step (a) for a time sufficient to obtain degradation of the mRNA transcript of an APOC3 gene, thereby inhibiting expression of the APOC3 gene in the cell.

In some embodiments, APOC3 expression is inhibited by at least 30%.

In some embodiments, the present disclosure pertains to a method of treating a disorder mediated by APOC3 expression comprising administering to a human in need of such treatment a therapeutically effective amount of an oligonucleotide or a single-stranded RNAi agent to APOC3.

In some embodiments, the disorder is elevated triglyceride levels.

In some embodiments, the disorder is triglyceride levels >150 mg/dL or >500 mg/dL.

In some embodiments, administration causes an increase in lipoprotein lipase and/or hepatic lipase activity.

In some embodiments, the present disclosure pertains to a method of improving peripheral insulin sensitivity comprising administering to a subject with diabetes an oligonucleotide or a single-stranded RNAi agent to APOC3 thereby improving peripheral insulin sensitivity.

In some embodiments, the present disclosure pertains to a method of improving peripheral insulin sensitivity comprising administering to a subject with moderately controlled type II diabetes and administering an oligonucleotide or a single-stranded RNAi agent to APOC3 thereby improving peripheral insulin sensitivity.

In some embodiments, the present disclosure pertains to a method of lowering free fatty acids comprising administering to a subject with diabetes and administering an oligonucleotide or a single-stranded RNAi agent APOC3, thereby lowering free fatty acids.

In some embodiments, the present disclosure pertains to a method of lowering free fatty acids comprising administering to a subject with moderately controlled type II diabetes and administering an oligonucleotide or a single-stranded RNAi agent to APOC3, thereby lowering free fatty acids.

In some embodiments, the present disclosure pertains to a method of reducing intramyocellular triglyceride deposition comprising administering to a subject with diabetes and administering an oligonucleotide or a single-stranded RNAi agent to APOC3, thereby reducing intramyocellular triglyceride deposition.

In some embodiments, the present disclosure pertains to a method of reducing intramyocellular triglyceride deposition comprising administering to a subject with moderately controlled type II diabetes and administering an oligonucleotide or a single-stranded RNAi agent to APOC3, thereby reducing intramyocellular triglyceride deposition.

In some embodiments, the present disclosure pertains to a method of improving a diabetes profile of a subject comprising administering to the subject an oligonucleotide or a single-stranded RNAi agent to APOC3, wherein insulin sensitivity index, glucose disposal rate, glucose MCR, glucose metabolism:insulin ration is improved; wherein free fatty acids, triglycerides, non-HDL-C, VLDL-C, APOC3 containing VLDL, APOB and LDL-C are reduced and HDL-C is increased, thereby improving the diabetes profile of the subject.

In some embodiments, the subject is on a stable dose of metformin.

In some embodiments, the present disclosure pertains to a compound comprising an oligonucleotide or a single-stranded RNAi agent to APOC3 for use in a subject to: improve peripheral insulin sensitivity; lower free fatty acids; reduce intramyocellular triglyceride deposition; improve a lipid profile; and/or improve a diabetic profile.

In some embodiments, a subject is administered a second agent (e.g., an additional therapeutic agent).

In some embodiments, the second agent is selected from an APOC3 lowering agent, cholesterol lowering agent, non-HDL lipid lowering agent, LDL lowering agent, TG lowering agent, cholesterol lowering agent, HDL raising agent, fish oil, niacin, fibrate, statin, DCCR (salt of diazoxide), glucose-lowering agent or anti-diabetic agents.

The oligonucleotides of the present disclosure can be administered alone or in combination with one or more additional therapeutic agents. By "administered in combination" or "combination therapy" it is meant that the oligonucleotide of the present disclosure and one or more additional therapeutic agents are administered concurrently to the mammal being treated. When administered in combination each component may be administered at the same time or sequentially in any order at different points in time. Thus, each component may be administered separately but sufficiently closely in time so as to provide the desired therapeutic effect. Thus, the compositions and methods of prevention and treatment described herein include use of combination agents.

The combination agents are administered to a mammal in a therapeutically effective amount. By "therapeutically effective amount" it is meant an amount of an oligonucleotide of the present disclosure that, when administered alone or in combination with an additional therapeutic agent to a mammal, is effective to treat the desired disease/condition (e.g., obesity, diabetes, and cardiovascular conditions).

In some embodiments, an oligonucleotides of the present disclosure may be administered in combination with an additional pharmaceutical agent selected from: an anti-inflammatory agent, an anti-diabetic agent, and a cholesterol/lipid modulating agent.

In some embodiments, an oligonucleotides of the present disclosure may be administered in combination with an additional pharmaceutical agent selected from: an acetyl-CoA carboxylase-(ACC) inhibitor, a diacylglycerol O-acyl-transferase 1 (DGAT-1) inhibitor, a diacylglycerol O-acyl-transferase 2 (DGAT-2) inhibitor, monoacylglycerol O-acyltransferase inhibitors, a phosphodiesterase (PDE)-10 inhibitor, an AMPK activator, a sulfonylurea, a meglitinide, an a-amylase inhibitor, an α-glucoside hydrolase inhibitor, an a-glucosidase inhibitor, a PPARγ agonist, a PPAR α/γ agonist, a biguanide, a glucagon-like peptide 1 (GLP-1) modulator, liraglutide, albiglutide, exenatide, albiglutide, lixisenatide, dulaglutide, semaglutide, a protein tyrosine phosphatase-1B (PTP-1B) inhibitor, SIRT-1 activator, a dipeptidyl peptidase IV (DPP-IV) inhibitor, an insulin secreatagogue, a fatty acid oxidation inhibitor, an A2 antagonist, a c-jun amino-terminal kinase (JNK) inhibitor, glucokinase activators (GKa), insulin, an insulin mimetic, a glycogen phosphorylase inhibitor, a VPAC2 receptor agonist, SGLT2 inhibitors, a glucagon receptor modulator, GPR119 modulators, FGF21 derivatives or analogs, TGRS receptor modulators, GPBAR1 receptor modulators, GPR40 agonists, GPR120 modulators, high affinity nicotinic acid receptor (HM74A) activators, SGLT1 inhibitors, inhibitors or modulators of carnitine palmitoyl transferase enzymes, inhibitors of fructose 1,6-diphosphatase, inhibitors of aldose reductase, mineralocorticoid receptor inhibitors, inhibitors of TORC2, inhibitors of CCR2 and/or CCR5, inhibitors of PKC isoforms (e.g. PKCα, PKCβ, PKCγ), inhibitors of fatty acid synthetase, inhibitors of serine palmitoyl transferase, modulators of GPR81, GPR39, GPR43, GPR41, GPR105, Kv1.3, retinol binding protein 4, glucocorticoid receptor, somatostain receptors, inhibitors or modulators of PDHK2 or PDHK4, inhibitors of MAP4K4, modulators of IL1 family including IL1beta, HMG-CoA reductase inhibitors, squalene synthetase inhibitors, fibrates, bile acid sequestrants, ACAT inhibitors, MTP inhibitors, lipooxygenase inhibitors, choesterol absorption inhibitors, PCSK9 modulators, cholesteryl ester transfer protein inhibitors and modulators of RXRalpha.

In some embodiments, an oligonucleotides of the present disclosure may be administered in combination with an additional pharmaceutical agent selected from: cysteamine or a pharmaceutically acceptable salt thereof, cystamine or a pharmaceutically acceptable salt thereof, an anti-oxidant compound, lecithin, vitamin B complex, a bile salt preparations, an antagonists of Cannabinoid-1 (CB1) receptor, an inverse agonists of Cannabinoid-1 (CB1) receptor, a peroxisome proliferator-activated receptor) activity regulators, a benzothiazepine or benzothiepine compound, an RNA antisense construct to inhibit protein tyrosine phosphatase PTPRU, a heteroatom-linked substituted piperidine and derivatives thereof, an azacyclopentane derivative capable of inhibiting stearoyl-coenzyme alpha delta-9 desaturase, acylamide compound having secretagogue or inducer activity of adiponectin, a quaternary ammonium compound, Glatiramer acetate, pentraxin proteins, a HMG-CoA reductase inhibitor, n-acetyl cysteine, isoflavone compound, a macrolide antibiotic, a galectin inhibitor, an antibody, or any combination of thereof.

In some embodiments, an oligonucleotide of the present disclosure may be administered in combination with a treatment of non-alcoholic steatohepatitis (NASH) and/or non-alcoholic fatty liver disease (NAFLD) (i.e., anti-NASH and anti-NAFLD agents), such as Orlistat, TZDs and other insulin sensitizing agents, FGF21 analogs, Metformin, Omega-3-acid ethyl esters (e.g. Lovaza), Fibrates, HMG CoA-reductase Inhibitors, Ezitimbe, Probucol, Ursodeoxycholic acid, TGRS agonists, FXR agonists, Vitamin E, Betaine, Pentoxifylline, CB1 antagonists, Carnitine, N-acetylcysteine, Reduced glutathione, lorcaserin, the combination of naltrexone with buprorion, SGLT2 Inhibitors, Phentermine, Topiramate, Incretin (GLP and GIP) analogs and Angiotensin-receptor blockers. Preferred agents for the treatment of non-alcoholic steatohepatitis (NASH) and/or non-alcoholic fatty liver disease (NAFLD) (i.e., anti-NASH and anti-NAFLD agents) are an acetyl-CoA carboxylase (ACC) inhibitor, a ketohexokinase (KHK) inhibitor, a GLP-1 receptor agonist, an FXR agonist, a CB1 antagonist, an ASK1 inhibitor, an inhibitor of CCR2 and/or CCR5, a PNPLA3 inhibitor, a DGAT1 inhibitor, a DGAT2 inhibitor, an FGF21 analog, an FGF19 analog, an SGLT2 inhibitor, a PPAR agonist, an AMPK activator, an SCD1 inhibitor or an MPO inhibitor. A commonly assigned patent application PCT/IB2017/057577 filed Dec. 1, 2017. is directed to GLP-1 receptor agonists. Most preferred are a FXR agonist, an apoptosis signal-regulating kinase 1 (ASK1) inhibitor, a PPAR agonist, a GLP-1 receptor agonist, a SGLT inhibitor, a an ACC inhibitor and a KHK inhibitor.

In some embodiments, an oligonucleotide of the present disclosure may be administered in combination with an anti-diabetic agent including any of: insulin, metfomin, DPPIV inhibitors (e.g., sitagliptin), GLP-1 receptor agonists, analogues and mimetics, SGLT1 and SGLT2 inhibitors (e.g., ertuglifozin)). Preferred agents are metaformin, sitagliptin and ertuglifozin. Suitable anti-diabetic agents include an acetyl-CoA carboxylase- (ACC) inhibitor such as those described in WO2009144554, WO2003072197, WO2009144555 and WO2008065508, a diacylglycerol O-acyltransferase 1 (DGAT-1) inhibitor, such as those described in WO09016462 or WO2010086820, AZD7687 or LCQ908, a diacylglycerol O-acyltransferase 2 (DGAT-2) inhibitor, such as those described in WO2015/140658, monoacylglycerol O-acyltransferase inhibitors, a phosphodiesterase (PDE)-10 inhibitor, an AMPK activator, a sulfonylurea (e.g., acetohexamide, chlorpropamide, diabinese, glibenclamide, glipizide, glyburide, glimepiride, gliclazide, glipentide, gliquidone, glisolamide, tolazamide, and tolbutamide), a meglitinide, an a-amylase inhibitor (e.g., tendamistat, trestatin and AL-3688), an α-glucoside hydrolase inhibitor (e.g., acarbose), an a-glucosidase inhibitor (e.g., adiposine, camiglibose, emiglitate, miglitol, voglibose, pradimicin-Q, and salbostatin), a PPARγ agonist (e.g., balaglitazone, ciglitazone, darglitazone, englitazone, isaglitazone, pioglitazone and rosiglitazone), a PPAR α/γ agonist (e.g., CLX-0940, GW-1536, GW-1929, GW-2433, KRP-297, L-796449, LR-90, MK-0767 and SB-219994), a biguanide (e.g., metformin), a glucagon-like peptide 1 (GLP-1) receptor agonist (e.g., exendin-3 and exendin-4), liraglutide, albiglutide, exenatide (Byetta®), albiglutide, lixisenatide, dulaglutide, semaglutide, NN-9924, TTP-054. TTP-273, a protein tyrosine phosphatase-1B (PTP-1B) inhibitor (e.g., trodusquemine, hyrtiosal extract, and compounds disclosed by Zhang, S., et al., Drug Discovery Today, 12(9/10), 373-381 (2007)), SIRT-1 activator (e.g., resveratrol, GSK2245840 or GSK184072), a dipeptidyl peptidease IV (DPP-IV) inhibitor (e.g., those in WO2005116014, sitagliptin, vildagliptin, alogliptin, dutogliptin, linagliptin and saxagliptin), an insulin secreatagogue, a fatty acid oxidation inhibitor, an A2 antagonist, a c-jun amino-terminal kinase (JNK) inhibitor, glucokinase activators (GKa) such as those described in WO2010103437, WO2010103438, WO2010013161, WO2007122482, TTP-399, TTP-355, TTP-547, AZD1656, ARRY403, MK-0599, TAK-329, AZD5658 or GKM-001, insulin, an insulin mimetic, a glycogen phosphorylase inhibitor (e.g. GSK1362885), a VPAC2 receptor agonist, SGLT2 inhibitors, such as those described in E. C. Chao et al. Nature Reviews Drug Discovery 9, 551-559 (July 2010) including dapagliflozin, canagliflozin, empagliflozin, tofogliflozin (CSG452), Ertugliflozin, ASP-1941, THR1474, TS-071, ISIS388626 and LX4211 as well as those in WO2010023594, a glucagon receptor modulator such as those described in Demong, D. E. et al. Annual Reports in Medicinal Chemistry 2008, 43, 119-137, GPR119 modulators, particularly agonists, such as those described in WO2010140092, WO2010128425, WO2010128414, WO2010106457, Jones, R. M. et al. in Medicinal Chemistry 2009, 44, 149-170 (e.g. MBX-2982, GSK1292263, APD597 and PSN821), FGF21 derivatives or analogs such as those described in Kharitonenkov, A. et al. et al., Current Opinion in Investigational Drugs 2009, 10(4) 359-364, TGR5 (also termed GPBAR1) receptor modulators, particularly agonists, such as those described in Zhong, M., Current Topics in Medicinal Chemistry, 2010, 10(4), 386-396 and INT777, GPR40 agonists, such as those described in Medina, J. C., Annual Reports in Medicinal Chemistry, 2008, 43, 75-85, including but not limited to TAK-875, GPR120 modulators, particularly agonists, high affinity nicotinic acid receptor (HM74A) activators, and SGLT1 inhibitors, such as GSK1614235. A further representative listing of anti-diabetic agents that can be combined with the oligonucleotides of the present disclosure can be found, for example, at page 28, line 35 through page 30, line 19 of WO2011005611. Preferred anti-diabetic agents are metformin and DPP-IV inhibitors (e.g., sitagliptin, vildagliptin, alogliptin, dutogliptin, linagliptin and saxagliptin). Other antidiabetic agents could include inhibitors or modulators of carnitine palmitoyl transferase enzymes, inhibitors of fructose 1,6-diphosphatase, inhibitors of aldose reductase, mineralocorticoid receptor inhibitors, inhibitors of TORC2, inhibitors of CCR2 and/or CCR5, inhibitors of PKC isoforms (e.g. PKCα, PKCβ, PKCγ), inhibitors of fatty acid synthetase, inhibitors of serine palmitoyl transferase, modulators of GPR81, GPR39, GPR43, GPR41, GPR105, Kv1.3, retinol binding protein 4, glucocorticoid receptor, somatostain receptors (e.g. SSTR1, SSTR2, SSTR3 and SSTR5), inhibitors or modulators of PDHK2 or PDHK4, inhibitors of MAP4K4, modulators of IL1 family including IL1beta, modulators of RXRalpha. In addition suitable anti-diabetic agents include mechanisms listed by Carpino, P. A., Goodwin, B. Expert Opin. Ther. Pat, 2010, 20(12), 1627-51.

Suitable anti-obesity agents include 11β-hydroxy steroid dehydrogenase-1 (11β-HSD type 1) inhibitors, stearoyl-CoA desaturase-1 (SCD-1) inhibitor, MCR-4 agonists, cholecystokinin-A (CCK-A) agonists, monoamine reuptake inhibitors (such as sibutramine), sympathomimetic agents, β3 adrenergic agonists, dopamine agonists (such as bromocriptine), melanocyte-stimulating hormone analogs, 5HT2c agonists, melanin concentrating hormone antagonists, leptin (the OB protein), leptin analogs, leptin agonists, galanin antagonists, lipase inhibitors (such as tetrahydrolipstatin, i.e. orlistat), anorectic agents (such as a bombesin agonist), neuropeptide-Y antagonists (e.g., NPY Y5 antagonists), PYY3-36 (including analogs thereof), thyromimetic agents, dehydroepiandrosterone or an analog thereof, glucocorticoid agonists or antagonists, orexin antagonists, glucagon-like peptide-1 agonists, ciliary neurotrophic factors (such as Axokine™ available from Regeneron Pharmaceuticals, Inc., Tarrytown, N.Y., and Procter & Gamble Company, Cincinnati, Ohio), human agouti-related protein (AGRP) inhibitors, ghrelin antagonists, histamine 3 antagonists or inverse agonists, neuromedin U agonists, MTP/ApoB inhibitors (e.g., gut-selective MTP inhibitors, such as dirlotapide), opioid antagonist, orexin antagonist, the combination of naltrexone with buproprion and the like.

Preferred anti-obesity agents for use in the combination aspects of the present disclosure include gut-selective MTP inhibitors (e.g., dirlotapide, mitratapide and implitapide, R56918 (CAS No. 403987) and CAS No. 913541-47-6), CCKa agonists (e.g., N-benzyl-244-(1H-indol-3-ylmethyl)-5-oxo-1-phenyl-4,5-dihydro-2,3,6,10b-tetraaza-benzo[e]azulen-6-yl]-N-isopropyl-acetamide described in PCT Publication No. WO 2005/116034 or US Publication No. 2005-0267100 A1), 5HT2c agonists (e.g., lorcaserin), MCR4 agonist (e.g., compounds described in U.S. Pat. No. 6,818,658), lipase inhibitor (e.g., Cetilistat), PYY3-36 (as used herein "PYY3-36" includes analogs, such as peglated PYY3-36 e.g., those described in US Publication 2006/0178501), opioid antagonists (e.g., naltrexone), the combination of naltrexone with buproprion, oleoyl-estrone (CAS No. 180003-17-2), obinepitide (TM30338), pramlintide (Symlin®), tesofensine (NS2330), leptin, liraglutide, bromocriptine, orlistat, exenatide (Byetta®), AOD-9604 (CAS No. 221231-10-3), phentermine and topiramate (trade name: Qsymia), and sibutramine. Preferably, oligonucleotides of the present disclosure and combination therapies are administered in conjunction with exercise and a sensible diet.

Those skilled in the art will recognize that oligonucleotides of the present disclosure may also be used in conjunction with cardiovascular or cerebrovascular treatments as described in the paragraphs below. Oligonucleotides of the present disclosure may also be used with cardiovascular therapies including PCI, stenting, drug eluting stents, stem cell therapy and medical devices such as implanted pacemakers, defibrillators, or cardiac resynchronization therapy.

An oligonucleotide of the present disclosure may be used in combination with any of: cholesterol modulating agents (including cholesterol lowering agents) such as a lipase inhibitor, an HMG-CoA reductase inhibitor, an HMG-CoA synthase inhibitor, an HMG-CoA reductase gene expression inhibitor, an HMG-CoA synthase gene expression inhibitor, an MTP/Apo B secretion inhibitor, a CETP inhibitor, a bile acid absorption inhibitor, a cholesterol absorption inhibitor, a cholesterol synthesis inhibitor, a squalene synthetase inhibitor, a squalene epoxidase inhibitor, a squalene cyclase inhibitor, a combined squalene epoxidase/squalene cyclase inhibitor, a fibrate, niacin, an ion-exchange resin, an antioxidant, an ACAT inhibitor or a bile acid sequestrant or an agent such as mipomersen.

Examples of suitable cholesterol/lipid lowering agents and lipid profile therapies include: HMG-CoA reductase inhibitors (e.g., pravastatin, lovastatin, atorvastatin, simvastatin, fluvastatin, NK-104 (a.k.a. itavastatin, or nisvastatin or nisbastatin) and ZD-4522 (a.k.a. rosuvastatin, or atavastatin or visastatin); squalene synthetase inhibitors; fibrates; bile acid sequestrants (such as questran); ACAT inhibitors; MTP inhibitors; lipooxygenase inhibitors; choesterol absorption inhibitors; and cholesteryl ester transfer protein inhibitors. Other atherosclerotic agents include PCSK9 modulators.

Treatment of a KRT14-Related Disorder

In some embodiments, the present disclosure pertains to an oligonucleotide which targets KRT14 (e.g., an oligonucleotide comprising a KRT14 target sequence or a sequence complementary to a KRT14 target sequence). In some embodiments, the present disclosure pertains to an oligonucleotide which directs target-specific knockdown of KRT14. In some embodiments, the present disclosure pertains to an oligonucleotide which directs target-specific knockdown of KRT14 mediated by RNase H and/or RNA interference. Various such oligonucleotides capable of targeting KRT14 are disclosed herein.

In some embodiments, non-limiting examples of an KRT14-related disorder include: epidermolysis bullosa simplex and Dermatopathia pigmentosa reticularis.

In some embodiments, the present disclosure pertains to a method of treating or ameliorating an KRT14-related disorder in a patient thereof, the method comprising the step of administering to the patient a therapeutically effective amount of an oligonucleotide which targets KRT14.

In some embodiments, the present disclosure pertains to a method of treating or ameliorating an KRT14-related disorder in a patient thereof, the method comprising the step of administering to the patient a therapeutically effective amount of an oligonucleotide which targets KRT14, wherein the KRT14-related disorder is selected from: epidermolysis bullosa simplex and Dermatopathia pigmentosa reticularis In some embodiments, the present disclosure pertains to a method for introducing an oligonucleotide that decreases KRT14 gene expression into a cell, the method comprising: contacting the cell with an oligonucleotide. In some embodiments, the oligonucleotide is an antisense oligonucleotide or single-stranded RNAi agent.

In some embodiments, the present disclosure pertains to a method for decreasing KRT14 gene expression in a mammal in need thereof, the method comprising: administering to the mammal a nucleic acid-lipid particle comprising an oligonucleotide which targets KRT14. In some embodiments, the oligonucleotide is an antisense oligonucleotide or single-stranded RNAi agent.

In some embodiments, the present disclosure pertains to a method for the in vivo delivery of an oligonucleotide that targets KRT14 gene expression, the method comprising: administering to a mammal an oligonucleotide which targets KRT14. In some embodiments, the oligonucleotide is an antisense oligonucleotide or single-stranded RNAi agent. In some embodiments, the mammal is a human. In some embodiments, the mammal is afflicted with and/or suffering from a KRT14-related disorder. In some embodiments, the mammal is afflicted with and/or suffering from a KRT14-related disorder selected from: epidermolysis bullosa simplex and Dermatopathia pigmentosa *reticularis*.

In some embodiments, the present disclosure pertains to a method for treating and/or ameliorating one or more symptoms associated with a KRT14-related disorder in a mammal in need thereof, the method comprising: administering to the mammal a therapeutically effective amount of an oligonucleotide which targets KRT14. In some embodiments, the present disclosure pertains to a method for reducing susceptibility to a KRT14-related disorder in a mammal in need thereof, the method comprising: administering to the mammal a therapeutically effective amount of an oligonucleotide which targets KRT14. In some embodiments, the present disclosure pertains to a method for preventing or delaying the onset of a KRT14-related disorder in a mammal in need thereof, the method comprising: administering to the mammal a therapeutically effective amount of an oligonucleotide which targets KRT14. In some embodiments, the present disclosure pertains to a method for treating and/or ameliorating one or more symptoms associated with a KRT14-related disorder in a mammal in need thereof, the method comprising: administering to the mammal a therapeutically effective amount of a nucleic acid-lipid particle comprising an oligonucleotide which targets KRT14. In some embodiments, the present disclosure pertains to a method for reducing susceptibility to a KRT14-related disorder in a mammal in need thereof, the method comprising: administering to the mammal a therapeutically effective amount of a nucleic acid-lipid particle comprising an oligonucleotide which targets KRT14. In some embodiments, the present disclosure pertains to a method for preventing or delaying the onset of a KRT14-related disorder in a mammal in need thereof, the method comprising: administering to the mammal a therapeutically effective amount of a nucleic acid-lipid particle comprising an oligonucleotide which targets KRT14. In some embodiments, the oligonucleotide is an antisense oligonucleotide or single-stranded RNAi agent. In some embodiments, the mammal is a human. In some embodiments, the mammal is afflicted with and/or suffering from a KRT14-related disorder. In some embodiments, the mammal is afflicted with and/or suffering from a KRT14-related disorder selected from: epidermolysis bullosa simplex and Dermatopathia pigmentosa reticularis.

In some embodiments, the present disclosure pertains to a method of inhibiting KRT14 expression in a cell, the method comprising: (a) contacting the cell with an oligonucleotide which targets KRT14; and (b) maintaining the cell produced in step (a) for a time sufficient to obtain degradation of the mRNA transcript of an KRT14 gene, thereby inhibiting expression of the KRT14 gene in the cell. In some embodiments, KRT14 expression is inhibited by at least 30%. In some embodiments, the oligonucleotide is an antisense oligonucleotide or single-stranded RNAi agent.

In some embodiments, the present disclosure pertains to a method of treating a disorder mediated by KRT14 expression comprising administering to a human in need of such treatment a therapeutically effective amount of an oligonucleotide which targets KRT14. In some embodiments, the oligonucleotide is an antisense oligonucleotide or single-stranded RNAi agent.

In some embodiments, the present disclosure pertains to a compound comprising an oligonucleotide which targets KRT14 for use in a subject to treat a KRT14-related disorder. In some embodiments, the oligonucleotide is an antisense oligonucleotide or single-stranded RNAi agent. In some embodiments, a KRT14-related disorder is selected from: epidermolysis bullosa simplex and Dermatopathia pigmentosa reticularis.

In some embodiments, a subject is administered a second agent. In some embodiments, the second agent is an oligonucleotide. In some embodiments, the oligonucleotide targets KRT14. In some embodiments, the oligonucleotide is an antisense oligonucleotide or single-stranded RNAi agent.

Treatment of a Myostatin-Related Disorder

In some embodiments, the present disclosure pertains to an oligonucleotide which targets myostatin (e.g., an oligonucleotide comprising a myostatin target sequence or a sequence complementary to a myostatin target sequence). In some embodiments, the present disclosure pertains to an oligonucleotide which directs target-specific knockdown of myostatin. In some embodiments, the present disclosure pertains to an oligonucleotide which directs target-specific knockdown of myostatin mediated by RNase H and/or RNA interference. Various such oligonucleotides capable of targeting myostatin are disclosed herein.

In some embodiments, non-limiting examples of an myostatin-related disorder include: musculoskeletal disease or disorder; muscle atrophy or dystrophy; muscle atrophy as a result of or associated with any of: treatment with a glucocorticoid such as cortisol, dexamethasone, betamethasone, prednisone, methylprednisolone, or prednisolone, denervation due to nerve trauma or a result of degenerative, metabolic, or inflammatory neuropathy (e.g., Guillian-Barre syndrome, peripheral neuropathy, or exposure to environmental toxins or drugs), or myopathy, such as myotonia; a congenital myopathy, including nemalene myopathy, multi/minicore myopathy and myotubular (centronuclear) myopathy; mitochondrial myopathy; familial periodic paralysis; inflammatory myopathy; metabolic myopathy, such as caused by a glycogen or lipid storage disease; dermatomyositisis; polymyositis; inclusion body myositis; myositis ossificans; rhabdomyolysis and myoglobinurias; a muscular dystrophy syndrome, such as Duchenne, Becker, myotonic, fascioscapulohumeral, Emery-Dreifuss, oculopharyngeal, scapulohumeral, limb girdle, Fukuyama, a congenital muscular dystrophy, or hereditary distal myopathy; osteoporosis, a bone fracture, short stature, or dwarfism; muscle atrophy as a result of or associated with an adult motor neuron disease, infantile spinal muscular atrophy, amyotrophic lateral sclerosis, juvenile spinal muscular atrophy, autoimmune motor neuropathy with multifocal conductor block, paralysis due to stroke or spinal cord injury, skeletal immobilization due to trauma, prolonged bed rest, voluntary inactivity, involuntary inactivity, metabolic stress or nutritional insufficiency, cancer, AIDS, fasting, a thyroid gland disorder, diabetes, benign congenital hypotonia, central core disease, burn injury, chronic obstructive pulmonary disease, liver diseases (examples such as fibrosis, cirrhosis), sepsis, renal failure, congestive heart failure, ageing, space travel or time spent in a zero gravity environment; sarcopenia, skin atrophy, muscle wasting, brain atrophy, atherosclerosis, arteriosclerosis, pulmonary emphysema, osteoporosis, osteoarthritis, immunologic incompetence, high blood pressure, dementia, Huntington's disease, Alzheimer's disease, cataracts, age-related macular degeneration, prostate cancer, stroke, diminished life expectancy, frailty, memory loss, wrinkles, impaired kidney function, and age-related hearing loss; metabolic disorders, including Type II Diabetes, Metabolic Syndrome, hyperglycemia, and obesity; or acute and/or chronic renal disease or failure, liver fibrosis or cirrhosis, cancer such as breast cancer, Parkinson's Disease; cachexia, cachexia associated with a rheumatoid arthritis and cachexia associated with cancer; conditions associated with neuronal death, such as ALS, brain atrophy, or dementia and anemia; or a disorder which causes or is associated with muscle atrophy.

In some embodiments, the present disclosure pertains to a method of treating or ameliorating an myostatin-related disorder in a patient thereof, the method comprising the step of administering to the patient a therapeutically effective amount of an oligonucleotide which targets myostatin.

In some embodiments, the present disclosure pertains to a method of treating or ameliorating an myostatin-related disorder in a patient thereof, the method comprising the step of administering to the patient a therapeutically effective amount of an oligonucleotide which targets myostatin.

In some embodiments, the present disclosure pertains to a method for introducing an oligonucleotide that decreases myostatin gene expression into a cell, the method comprising: contacting the cell with an oligonucleotide. In some embodiments, the oligonucleotide is an antisense oligonucleotide or single-stranded RNAi agent.

In some embodiments, the present disclosure pertains to a method for decreasing myostatin gene expression in a mammal in need thereof, the method comprising: administering to the mammal a nucleic acid-lipid particle comprising an oligonucleotide which targets myostatin. In some embodiments, the oligonucleotide is an antisense oligonucleotide or single-stranded RNAi agent.

In some embodiments, the present disclosure pertains to a method for the in vivo delivery of an oligonucleotide that targets myostatin gene expression, the method comprising: administering to a mammal an oligonucleotide which targets myostatin. In some embodiments, the oligonucleotide is an antisense oligonucleotide or single-stranded RNAi agent. In some embodiments, the mammal is a human. In some embodiments, the mammal is afflicted with and/or suffering from a myostatin-related disorder.

In some embodiments, the present disclosure pertains to a method for treating and/or ameliorating one or more symptoms associated with a myostatin-related disorder in a mammal in need thereof, the method comprising: administering to the mammal a therapeutically effective amount of an oligonucleotide which targets myostatin. In some embodiments, the present disclosure pertains to a method for reducing susceptibility to a myostatin-related disorder in a mammal in need thereof, the method comprising: administering to the mammal a therapeutically effective amount of an oligonucleotide which targets myostatin. In some embodiments, the present disclosure pertains to a method for preventing or delaying the onset of a myostatin-related disorder in a mammal in need thereof, the method comprising: administering to the mammal a therapeutically effective amount of an oligonucleotide which targets myostatin. In some embodiments, the present disclosure pertains to a method for treating and/or ameliorating one or more symptoms associated with a myostatin-related disorder in a mammal in need thereof, the method comprising: administering to the mammal a therapeutically effective amount of a nucleic acid-lipid particle comprising an oligonucleotide which targets myostatin. In some embodiments, the present disclosure pertains to a method for reducing susceptibility to a myostatin-related disorder in a mammal in need thereof, the method comprising: administering to the mammal a therapeutically effective amount of a nucleic acid-lipid particle comprising an oligonucleotide which targets myostatin. In some embodiments, the present disclosure pertains to a method for preventing or delaying the onset of a myostatin-related disorder in a mammal in need thereof, the method comprising: administering to the mammal a therapeutically effective amount of a nucleic acid-lipid particle comprising an oligonucleotide which targets myostatin. In some embodiments, the oligonucleotide is an antisense oligonucleotide or single-stranded RNAi agent. In some embodiments, the mammal is a human. In some embodiments, the mammal is afflicted with and/or suffering from a myostatin-related disorder.

In some embodiments, the present disclosure pertains to a method of inhibiting myostatin expression in a cell, the method comprising: (a) contacting the cell with an oligonucleotide which targets myostatin; and (b) maintaining the cell produced in step (a) for a time sufficient to obtain degradation of the mRNA transcript of an myostatin gene, thereby inhibiting expression of the myostatin gene in the cell. In some embodiments, myostatin expression is inhibited by at least 30%. In some embodiments, the oligonucleotide is an antisense oligonucleotide or single-stranded RNAi agent.

In some embodiments, the present disclosure pertains to a method of treating a disorder mediated by myostatin expression comprising administering to a human in need of such treatment a therapeutically effective amount of an oligonucleotide which targets myostatin. In some embodiments, the oligonucleotide is an antisense oligonucleotide or single-stranded RNAi agent.

In some embodiments, the present disclosure pertains to a compound comprising an oligonucleotide which targets myostatin for use in a subject to treat a myostatin-related disorder.

In some embodiments, a subject is administered a second agent. In some embodiments, the second agent is an oligonucleotide. In some embodiments, the oligonucleotide targets myostatin. In some embodiments, the oligonucleotide is an antisense oligonucleotide or single-stranded RNAi agent.

Treatment of a PCSK9-Related Disorder

In some embodiments, the present disclosure pertains to an oligonucleotide which targets PCSK9 (e.g., an oligonucleotide comprising a PCSK9 target sequence or a sequence complementary to a PCSK9 target sequence). In some embodiments, the present disclosure pertains to an oligonucleotide which directs target-specific knockdown of PCSK9. In some embodiments, the present disclosure pertains to an oligonucleotide which directs target-specific knockdown of PCSK9 mediated by RNaseH and/or RNA interference. Various such oligonucleotides capable of targeting PCSK9 are disclosed herein.

In some embodiments, non-limiting examples of an PCSK9-related disorder include: atherosclerosis; hyperlipoproteinemia; hypercholesterolemia; cardiovascular disease; obesity; hypertension; elevated total cholesterol levels; elevated non-high-density lipoprotein (HDL) cholesterol levels; elevated low-density lipoprotein (LDL-C) levels; elevated apolipoprotein B100 (APOB100) levels; hyperlipidemia; dyslipidemia; atherosclerosis; cardiovascular diseases; coronary heart disease (CHD); primary hypercholesterolemia; familial non-familial hypercholesterolemia; heterozygous familial hypercholesterolemia (heFH); hypercholesteremia that is uncontrolled by statins; and hypercholesterolemia that is resistant to statins.

In some embodiments, the present disclosure pertains to a method of treating or ameliorating an PCSK9-related disorder in a patient thereof, the method comprising the step of administering to the patient a therapeutically effective amount of an oligonucleotide which targets PCSK9.

In some embodiments, the present disclosure pertains to a method of treating or ameliorating an PCSK9-related disorder in a patient thereof, the method comprising the step of administering to the patient a therapeutically effective amount of an oligonucleotide which targets PCSK9, wherein the PCSK9-related disorder is selected from: atherosclerosis; hyperlipoproteinemia; hypercholesterolemia; cardiovascular disease; obesity; hypertension; elevated total cholesterol levels; elevated non-high-density lipoprotein (HDL) cholesterol levels; elevated low-density lipoprotein (LDL-C) levels; elevated apolipoprotein B100 (APOB100) levels; hyperlipidemia; dyslipidemia; atherosclerosis; cardiovascular diseases; coronary heart disease (CHD); primary hypercholesterolemia; familial non-familial hypercholesterolemia; heterozygous familial hypercholesterolemia (heFH); hypercholesteremia that is uncontrolled by statins; and hypercholesterolemia that is resistant to statins.

In some embodiments, the present disclosure pertains to a method for introducing an oligonucleotide that decreases PCSK9 gene expression into a cell, the method comprising: contacting the cell with an oligonucleotide. In some embodiments, the oligonucleotide is an antisense oligonucleotide or single-stranded RNAi agent.

In some embodiments, the present disclosure pertains to a method for decreasing PCSK9 gene expression in a mammal in need thereof, the method comprising: administering to the mammal a nucleic acid-lipid particle comprising an oligonucleotide which targets PCSK9. In some embodiments, the oligonucleotide is an antisense oligonucleotide or single-stranded RNAi agent.

In some embodiments, the present disclosure pertains to a method for the in vivo delivery of an oligonucleotide that targets PCSK9 gene expression, the method comprising: administering to a mammal an oligonucleotide which targets PCSK9. In some embodiments, the oligonucleotide is an antisense oligonucleotide or single-stranded RNAi agent. In some embodiments, the mammal is a human. In some embodiments, the mammal is afflicted with and/or suffering from a PCSK9-related disorder. In some embodiments, the mammal is afflicted with and/or suffering from a PCSK9-related disorder selected from: atherosclerosis; hyperlipoproteinemia; hypercholesterolemia; cardiovascular disease; obesity; hypertension; elevated total cholesterol levels; elevated non-high-density lipoprotein (HDL) cholesterol levels; elevated low-density lipoprotein (LDL-C) levels; elevated apolipoprotein B100 (APOB100) levels; hyperlipidemia; dyslipidemia; atherosclerosis; cardiovascular diseases; coronary heart disease (CHD); primary hypercholesterolemia; familial non-familial hypercholesterolemia; heterozygous familial hypercholesterolemia (heFH); hypercholesteremia that is uncontrolled by statins; and hypercholesterolemia that is resistant to statins.

In some embodiments, the present disclosure pertains to a method for treating and/or ameliorating one or more symptoms associated with a PCSK9-related disorder in a mammal in need thereof, the method comprising: administering to the mammal a therapeutically effective amount of an oligonucleotide which targets PCSK9. In some embodiments, the present disclosure pertains to a method for reducing susceptibility to a PCSK9-related disorder in a mammal in need thereof, the method comprising: administering to the mammal a therapeutically effective amount of an oligonucleotide which targets PCSK9. In some embodiments, the present disclosure pertains to a method for preventing or delaying the onset of a PCSK9-related disorder in a mammal in need thereof, the method comprising: administering to the mammal a therapeutically effective amount of an oligonucleotide which targets PCSK9. In some embodiments, the present disclosure pertains to a method for treating and/or ameliorating one or more symptoms associated with a PCSK9-related disorder in a mammal in need thereof, the method comprising: administering to the mammal a therapeutically effective amount of a nucleic acid-lipid particle comprising an oligonucleotide which targets PCSK9. In some embodiments, the present disclosure pertains to a method for reducing susceptibility to a PCSK9-related disorder in a mammal in need thereof, the method comprising: administering to the mammal a therapeutically effective amount of a nucleic acid-lipid particle comprising an oligonucleotide which targets PCSK9. In some embodiments, the present disclosure pertains to a method for preventing or delaying the onset of a PCSK9-related disorder in a mammal in need thereof, the method comprising: administering to the mammal a therapeutically effective amount of a nucleic acid-lipid particle comprising an oligonucleotide which targets PCSK9. In some embodiments, the oligonucleotide is an antisense oligonucleotide or single-stranded RNAi agent. In some embodiments, the mammal is a human. In some embodiments, the mammal is afflicted with and/or suffering from a PCSK9-related disorder. In some embodiments, the mammal is afflicted with and/or suffering from a PCSK9-related disorder selected from: atherosclerosis; hyperlipoproteinemia; hypercholesterolemia; cardiovascular disease; obesity; hypertension; elevated total cholesterol levels; elevated non-high-density lipoprotein (HDL) cholesterol levels; elevated low-density lipoprotein (LDL-C) levels; elevated apolipoprotein B100 (APOB100) levels; hyperlipidemia; dyslipidemia; atherosclerosis; cardiovascular diseases; coronary heart disease (CHD); primary hypercholesterolemia; familial non-familial hypercholesterolemia; heterozygous familial hypercholesterolemia (heFH); hypercholesteremia that is uncontrolled by statins; and hypercholesterolemia that is resistant to statins.

In some embodiments, the present disclosure pertains to a method of inhibiting PCSK9 expression in a cell, the method comprising: (a) contacting the cell with an oligonucleotide which targets PCSK9; and (b) maintaining the cell produced in step (a) for a time sufficient to obtain degradation of the mRNA transcript of an PCSK9 gene, thereby inhibiting expression of the PCSK9 gene in the cell. In some embodiments, PCSK9 expression is inhibited by at least 30%. In some embodiments, the oligonucleotide is an antisense oligonucleotide or single-stranded RNAi agent.

In some embodiments, the present disclosure pertains to a method of treating a disorder mediated by PCSK9 expression comprising administering to a human in need of such treatment a therapeutically effective amount of an oligonucleotide which targets PCSK9. In some embodiments, the oligonucleotide is an antisense oligonucleotide or single-stranded RNAi agent.

In some embodiments, the present disclosure pertains to a compound comprising an oligonucleotide which targets PCSK9 for use in a subject to treat a PCSK9-related disorder. In some embodiments, the oligonucleotide is an antisense oligonucleotide or single-stranded RNAi agent. In some embodiments, a PCSK9-related disorder is selected from: atherosclerosis; hyperlipoproteinemia; hypercholesterolemia; cardiovascular disease; obesity; hypertension; elevated total cholesterol levels; elevated non-high-density lipoprotein (HDL) cholesterol levels; elevated low-density lipoprotein (LDL-C) levels; elevated apolipoprotein B100 (APOB100) levels; hyperlipidemia; dyslipidemia; atherosclerosis; cardiovascular diseases; coronary heart disease (CHD); primary hypercholesterolemia; familial non-familial hypercholesterolemia; heterozygous familial hypercholesterolemia (heFH); hypercholesteremia that is uncontrolled by statins; and hypercholesterolemia that is resistant to statins.

In some embodiments, a subject is administered a second agent. In some embodiments, the second agent is an oligonucleotide. In some embodiments, the oligonucleotide targets PCSK9. In some embodiments, the oligonucleotide is an antisense oligonucleotide or single-stranded RNAi agent.

Treatment of a PNPLA3-Related Disorder

In some embodiments, the present disclosure pertains to an oligonucleotide which targets PNPLA3 (e.g., an oligonucleotide comprising a PNPLA3 target sequence or a sequence complementary to a PNPLA3 target sequence). In some embodiments, the present disclosure pertains to an oligonucleotide which directs target-specific knockdown of PNPLA3. In some embodiments, the present disclosure pertains to an oligonucleotide which directs target-specific knockdown of PNPLA3 mediated by RNaseH and/or RNA interference. Various such oligonucleotides capable of targeting PNPLA3 are disclosed herein.

In some embodiments, non-limiting examples of an PNPLA3-related disorder include: liver disease, fatty liver (e.g., accumulation of fat in the liver, or an increase in or supra-normal hepatic fat), hepatic steatosis (e.g., simple fatty liver), steatohepatitis, hepatitis, nonalcoholic fatty liver disease (e.g., NAFLD), and/or one or more disease and/or one or more symptom or condition associated with or secondary to a liver disease, including but not limited to: inflammation, destruction of liver cells (e.g., hepatocellular necrosis), scarring of the liver (e.g., fibrosis), irreversible, advanced scarring of the liver (e.g., cirrhosis), insulin resistance, diabetes, dyslipidemia, increased protein activity in the hedgehog (Hh) signaling pathway, fatigue, weakness, nausea, abdominal pain, spider-like blood vessels, jaundice, itching, edema, ascites, mental confusion, obesity, hepatocellular carcinoma.

In some embodiments, the present disclosure pertains to a method of treating or ameliorating an PNPLA3-related disorder in a patient thereof, the method comprising the step of administering to the patient a therapeutically effective amount of an oligonucleotide which targets PNPLA3.

In some embodiments, the present disclosure pertains to a method of treating or ameliorating an PNPLA3-related disorder in a patient thereof, the method comprising the step of administering to the patient a therapeutically effective amount of an oligonucleotide which targets PNPLA3, wherein the PNPLA3-related disorder is selected from: liver disease, fatty liver, steatosis, steatohepatitis, hepatitis, and nonalcoholic fatty liver disease.

In some embodiments, the present disclosure pertains to a method for introducing an oligonucleotide that decreases PNPLA3 gene expression into a cell, the method comprising: contacting the cell with an oligonucleotide. In some embodiments, the oligonucleotide is an antisense oligonucleotide or single-stranded RNAi agent.

In some embodiments, the present disclosure pertains to a method for decreasing PNPLA3 gene expression in a mammal in need thereof, the method comprising: administering to the mammal a nucleic acid-lipid particle comprising an oligonucleotide which targets PNPLA3. In some embodiments, the oligonucleotide is an antisense oligonucleotide or single-stranded RNAi agent.

In some embodiments, the present disclosure pertains to a method for the in vivo delivery of an oligonucleotide that targets PNPLA3 gene expression, the method comprising: administering to a mammal an oligonucleotide which targets PNPLA3. In some embodiments, the oligonucleotide is an antisense oligonucleotide or single-stranded RNAi agent. In some embodiments, the mammal is a human. In some embodiments, the mammal is afflicted with and/or suffering from a PNPLA3-related disorder. In some embodiments, the mammal is afflicted with and/or suffering from a PNPLA3-related disorder selected from: liver disease, fatty liver, steatosis, steatohepatitis, hepatitis, and nonalcoholic fatty liver disease.

In some embodiments, the method of the present disclosure is for the treatment of hyperlipidemia, Type I diabetes, Type II diabetes mellitus, idiopathic Type I diabetes (Type Ib), latent autoimmune diabetes in adults (LADA), early-onset Type 2 diabetes (EOD), youth-onset atypical diabetes (YOAD), maturity onset diabetes of the young (MODY), malnutrition-related diabetes, gestational diabetes, coronary heart disease, ischemic stroke, restenosis after angioplasty, peripheral vascular disease, intermittent claudication, myocardial infarction, dyslipidemia, post-prandial lipemia, conditions of impaired glucose tolerance (IGT), conditions of impaired fasting plasma glucose, metabolic acidosis, ketosis, arthritis, obesity, osteoporosis, hypertension, congestive heart failure, left ventricular hypertrophy, peripheral arterial disease, diabetic retinopathy, macular degeneration, cataract, diabetic nephropathy, glomerulosclerosis, chronic renal failure, diabetic neuropathy, metabolic syndrome, syndrome X, premenstrual syndrome, angina pectoris, thrombosis, atherosclerosis, transient ischemic attacks, stroke, vascular restenosis, hyperglycemia, hyperinsulinemia, hypertryglic-eridemia, elevated low density lipoprotein (LDL) cholesterol levels (hypercholesterolemia), insulin resistance, impaired glucose metabolism, erectile dysfunction, skin and connective tissue disorders, foot ulcerations and ulcerative colitis, endothelial dysfunction and impaired vascular compliance, hyper apo B lipoproteinemia, Alzheimer's, schizophrenia, impaired cognition, inflammatory bowel disease, ulcerative colitis, Crohn's disease, and irritable bowel syndrome, non-alcoholic steatohepatitis (NASH), or non-alcoholic fatty liver disease (NAFLD), in humans wherein the method comprises administering to a subject a therapeutically effective amount of an oligonucleotide of the present disclosure.

In some embodiments, the method reduces portal hypertension, hepatic protein synthetic capability, hyperbilirubinemia, or encephalopathy wherein the method comprise administering to a subject a therapeutically effective amount of an oligonucleotide of the present disclosure.

The present disclosure is also directed at a method for the treatment of reduction of at least one point in severity of nonalcoholic fatty liver disease or non-alcoholic steatohepatitis grading scoring systems, reduction of the level of serum markers of non-alcoholic steatohepatitis activity, reduction of non-alcoholic steatohepatitis disease activity or reduction in the medical consequences of non-alcoholic steatohepatitis in humans administering to a subject a therapeutically effective amount of an oligonucleotide of the present disclosure.

In some embodiments, the present disclosure pertains to a method for treating and/or ameliorating one or more symptoms associated with a PNPLA3-related disorder in a mammal in need thereof, the method comprising: administering to the mammal a therapeutically effective amount of an oligonucleotide which targets PNPLA3. In some embodiments, the present disclosure pertains to a method for reducing susceptibility to a PNPLA3-related disorder in a mammal in need thereof, the method comprising: administering to the mammal a therapeutically effective amount of an oligonucleotide which targets PNPLA3. In some embodiments, the present disclosure pertains to a method for preventing or delaying the onset of a PNPLA3-related disorder in a mammal in need thereof, the method compris-ing: administering to the mammal a therapeutically effective amount of an oligonucleotide which targets PNPLA3. In some embodiments, the present disclosure pertains to a method for treating and/or ameliorating one or more symptoms associated with a PNPLA3-related disorder in a mammal in need thereof, the method comprising: administering to the mammal a therapeutically effective amount of a nucleic acid-lipid particle comprising an oligonucleotide which targets PNPLA3. In some embodiments, the present disclosure pertains to a method for reducing susceptibility to a PNPLA3-related disorder in a mammal in need thereof, the method comprising: administering to the mammal a therapeutically effective amount of a nucleic acid-lipid particle comprising an oligonucleotide which targets PNPLA3. In some embodiments, the present disclosure pertains to a method for preventing or delaying the onset of a PNPLA3-related disorder in a mammal in need thereof, the method comprising: administering to the mammal a therapeutically effective amount of a nucleic acid-lipid particle comprising an oligonucleotide which targets PNPLA3. In some embodiments, the oligonucleotide is an antisense oligonucleotide or single-stranded RNAi agent. In some embodiments, the mammal is a human. In some embodiments, the mammal is afflicted with and/or suffering from a PNPLA3-related disorder. In some embodiments, the mammal is afflicted with and/or suffering from a PNPLA3-related disorder selected from: liver disease, fatty liver, steatosis, steatohepatitis, hepatitis, and nonalcoholic fatty liver disease.

In some embodiments, the present disclosure pertains to a method of inhibiting PNPLA3 expression in a cell, the method comprising: (a) contacting the cell with an oligonucleotide which targets PNPLA3; and (b) maintaining the cell produced in step (a) for a time sufficient to obtain degradation of the mRNA transcript of an PNPLA3 gene, thereby inhibiting expression of the PNPLA3 gene in the cell. In some embodiments, PNPLA3 expression is inhibited by at least 30%. In some embodiments, the oligonucleotide is an antisense oligonucleotide or single-stranded RNAi agent.

In some embodiments, the present disclosure pertains to a method of treating a disorder mediated by PNPLA3 expression comprising administering to a human in need of such treatment a therapeutically effective amount of an oligonucleotide which targets PNPLA3. In some embodiments, the oligonucleotide is an antisense oligonucleotide or single-stranded RNAi agent.

In some embodiments, the present disclosure pertains to a compound comprising an oligonucleotide which targets PNPLA3 for use in a subject to treat a PNPLA3-related disorder. In some embodiments, the oligonucleotide is an antisense oligonucleotide or single-stranded RNAi agent. In some embodiments, a PNPLA3-related disorder is selected from: liver disease, fatty liver, steatosis, steatohepatitis, hepatitis, or nonalcoholic fatty liver disease.

In some embodiments, a subject is administered a second agent (e.g., an additional therapeutic agent). In some embodiments, the second agent is an oligonucleotide. In some embodiments, the oligonucleotide targets PNPLA3. In some embodiments, the oligonucleotide is an antisense oligonucleotide or single-stranded RNAi agent.

The oligonucleotides of the present disclosure can be administered alone or in combination with one or more additional therapeutic agents. By "administered in combination" or "combination therapy" it is meant that the oligonucleotide of the present disclosure and one or more additional therapeutic agents are administered concurrently to the mammal being treated. When administered in combination each component may be administered at the same time or sequentially in any order at different points in time. Thus, each component may be administered separately but sufficiently closely in time so as to provide the desired therapeutic effect. Thus, the compositions and methods of prevention and treatment described herein include use of combination agents.

The combination agents are administered to a mammal in a therapeutically effective amount. By "therapeutically effective amount" it is meant an amount of an oligonucleotide of the present disclosure that, when administered alone or in combination with an additional therapeutic agent to a mammal, is effective to treat the desired disease/condition (e.g., obesity, diabetes, and cardiovascular conditions).

Accordingly, oligonucleotides of the present disclosure may be co-administered with agents for the treatment of non-alcoholic steatohepatitis (NASH) and/or non-alcoholic fatty liver disease (NAFLD) (i.e., anti-NASH and anti-NAFLD agents), such as Orlistat, TZDs and other insulin sensitizing agents, FGF21 analogs, Metformin, Omega-3-acid ethyl esters (e.g. Lovaza), Fibrates, HMG CoA-reductase Inhibitors, Ezitimbe, Probucol, Ursodeoxycholic acid, TGRS agonists, FXR agonists, Vitamin E, Betaine, Pentoxifylline, CB1 antagonists, Carnitine, N-acetylcysteine, Reduced glutathione, lorcaserin, the combination of naltrexone with buproprion, SGLT2 Inhibitors, Phentermine, Topiramate, Incretin (GLP and GIP) analogs and Angiotensin-receptor blockers. Preferred agents for the treatment of non-alcoholic steatohepatitis (NASH) and/or non-alcoholic fatty liver disease (NAFLD) (i.e., anti-NASH and anti-NAFLD agents) are an acetyl-CoA carboxylase (ACC) inhibitor, a ketohexokinase (KHK) inhibitor, a GLP-1 receptor agonist, an FXR agonist, a CB1 antagonist, an ASK1 inhibitor, an inhibitor of CCR2 and/or CCR5, a PNPLA3 inhibitor, a DGAT1 inhibitor, a DGAT2 inhibitor, an FGF21 analog, an FGF19 analog, an SGLT2 inhibitor, a PPAR agonist, an AMPK activator, an SCD1 inhibitor or an MPO inhibitor. A commonly assigned patent application PCT/IB2017/057577 filed Dec. 1, 2017. is directed to GLP-1 receptor agonists. Most preferred are a FXR agonist, an apoptosis signal-regulating kinase 1 (ASK1) inhibitor, a PPAR agonist, a GLP-1 receptor agonist, a SGLT inhibitor, a an ACC inhibitor and a KHK inhibitor.

Further, oligonucleotides of the present disclosure may be co-administered with anti-diabetic agents include (e.g. insulins, metfomin, DPPIV inhibitors (e.g., sitagliptin), GLP-1 receptor agonists, analogues and mimetics, SGLT1 and SGLT2 inhibitors (e.g., ertuglifozin)). Preferred agents are metaformin, sitagliptin and ertuglifozin. Suitable anti-diabetic agents include an acetyl-CoA carboxylase-(ACC) inhibitor such as those described in WO2009144554, WO2003072197, WO2009144555 and WO2008065508, a diacylglycerol O-acyltransferase 1 (DGAT-1) inhibitor, such as those described in WO09016462 or WO2010086820, AZD7687 or LCQ908, a diacylglycerol O-acyltransferase 2 (DGAT-2) inhibitor, such as those described in WO2015/140658, monoacylglycerol O-acyltransferase inhibitors, a phosphodiesterase (PDE)-10 inhibitor, an AMPK activator, a sulfonylurea (e.g., acetohexamide, chlorpropamide, diabinese, glibenclamide, glipizide, glyburide, glimepiride, gliclazide, glipentide, gliquidone, glisolamide, tolazamide, and tolbutamide), a meglitinide, an a-amylase inhibitor (e.g., tendamistat, trestatin and AL-3688), an α-glucoside hydrolase inhibitor (e.g., acarbose), an a-glucosidase inhibitor (e.g., adiposine, camiglibose, emiglitate, miglitol, voglibose, pradimicin-Q, and salbostatin), a PPARγ agonist (e.g., balaglitazone, ciglitazone, darglitazone, englitazone, isaglitazone, pioglitazone and rosiglitazone), a PPAR α/γ agonist (e.g., CLX-0940, GW-1536, GW-1929, GW-2433, KRP-297, L-796449, LR-90, MK-0767 and SB-219994), a biguanide (e.g., metformin), a glucagon-like peptide 1 (GLP-1) receptor agonist (e.g., exendin-3 and exendin-4), liraglutide, albiglutide, exenatide (Byetta®), albiglutide, lixisenatide, dulaglutide, semaglutide, NN-9924, TTP-054. TTP-273, a protein tyrosine phosphatase-1B (PTP-1B) inhibitor (e.g., trodusquemine, hyrtiosal extract, and compounds disclosed by Zhang, S., et al., Drug Discovery Today, 12(9/10), 373-381 (2007)), SIRT-1 activator (e.g., resveratrol, GSK2245840 or GSK184072), a dipeptidyl peptidease IV (DPP-IV) inhibitor (e.g., those in WO2005116014, sitagliptin, vildagliptin, alogliptin, dutogliptin, linagliptin and saxagliptin), an insulin secreatagogue, a fatty acid oxidation inhibitor, an A2 antagonist, a c-jun amino-terminal kinase (JNK) inhibitor, glucokinase activators (GKa) such as those described in WO2010103437, WO2010103438, WO2010013161, WO2007122482, TTP-399, TTP-355, TTP-547, AZD1656, ARRY403, MK-0599, TAK-329, AZD5658 or GKM-001, insulin, an insulin mimetic, a glycogen phosphorylase inhibitor (e.g. GSK1362885), a VPAC2 receptor agonist, SGLT2 inhibitors, such as those described in E. C. Chao et al. Nature Reviews Drug Discovery 9, 551-559 (July 2010) including dapagliflozin, canagliflozin, empagliflozin, tofogliflozin (CSG452), Ertugliflozin, ASP-1941, THR1474, TS-071, ISIS388626 and LX4211 as well as those in WO2010023594, a glucagon receptor modulator such as those described in Demong, D. E. et al. Annual Reports in Medicinal Chemistry 2008, 43, 119-137, GPR119 modulators, particularly agonists, such as those described in WO2010140092, WO2010128425, WO2010128414, WO2010106457, Jones, R. M. et al. in Medicinal Chemistry 2009, 44, 149-170 (e.g. MBX-2982, GSK1292263, APD597 and PSN821), FGF21 derivatives or analogs such as those described in Kharitonenkov, A. et al. et al., Current Opinion in Investigational Drugs 2009, 10(4)$_{359}$-364, TGRS (also termed GPBAR1) receptor modulators, particularly agonists, such as those described in Zhong, M., Current Topics in Medicinal Chemistry, 2010, 10(4), 386-396 and INT777, GPR40 agonists, such as those described in Medina, J. C., Annual Reports in Medicinal Chemistry, 2008, 43, 75-85, including but not limited to TAK-875, GPR120 modulators, particularly agonists, high affinity nicotinic acid receptor (HM74A) activators, and SGLT1 inhibitors, such as GSK1614235. A further representative listing of anti-diabetic agents that can be combined with the oligonucleotides of the present disclosure can be found, for example, at page 28, line 35 through page 30, line 19 of WO2011005611. Preferred anti-diabetic agents are metformin and DPP-IV inhibitors (e.g., sitagliptin, vildagliptin, alogliptin, dutogliptin, linagliptin and saxagliptin). Other antidiabetic agents could include inhibitors or modulators of carnitine palmitoyl transferase enzymes, inhibitors of fructose 1,6-diphosphatase, inhibitors of aldose reductase, mineralocorticoid receptor inhibitors, inhibitors of TORC2, inhibitors of CCR2 and/or CCR5, inhibitors of PKC isoforms (e.g. PKC☐, PKC☐, PKC☐), inhibitors of fatty acid synthetase, inhibitors of serine palmitoyl transferase, modulators of GPR81, GPR39, GPR43, GPR41, GPR105, Kv1.3, retinol binding protein 4, glucocorticoid receptor, somatostain receptors (e.g. SSTR1, SSTR2, SSTR3 and SSTR5), inhibitors or modulators of PDHK2 or PDHK4, inhibitors of MAP4K4, modulators of IL1 family including IL1beta, modulators of RXRalpha. In addition suitable anti-diabetic agents include mechanisms listed by Carpino, P. A., Goodwin, B. Expert Opin. Ther. Pat, 2010, 20(12), 1627-51.

Suitable anti-obesity agents include 11☐-hydroxy steroid dehydrogenase-1 (11☐-HSD type 1) inhibitors, stearoyl-CoA desaturase-1 (SCD-1) inhibitor, MCR-4 agonists, cholecystokinin-A (CCK-A) agonists, monoamine reuptake inhibitors (such as sibutramine), sympathomimetic agents, ☐3 adrenergic agonists, dopamine agonists (such as bromocriptine), melanocyte-stimulating hormone analogs, 5HT2c agonists, melanin concentrating hormone antagonists, leptin (the OB protein), leptin analogs, leptin agonists, galanin antagonists, lipase inhibitors (such as tetrahydrolipstatin, i.e. orlistat), anorectic agents (such as a bombesin agonist), neuropeptide-Y antagonists (e.g., NPY Y5 antagonists), PYY3-36 (including analogs thereof), thyromimetic agents, dehydroepiandrosterone or an analog thereof, glucocorticoid agonists or antagonists, orexin antagonists, glucagon-like peptide-1 agonists, ciliary neurotrophic factors (such as Axokine™ available from Regeneron Pharmaceuticals, Inc., Tarrytown, N.Y. and Procter & Gamble Company, Cincinnati, Ohio), human agouti-related protein (AGRP) inhibitors, ghrelin antagonists, histamine 3 antagonists or inverse agonists, neuromedin U agonists, MTP/ApoB inhibitors (e.g., gut-selective MTP inhibitors, such as dirlotapide), opioid antagonist, orexin antagonist, the combination of naltrexone with buproprion and the like.

Preferred anti-obesity agents for use in the combination aspects of the present disclosure include gut-selective MTP inhibitors (e.g., dirlotapide, mitratapide and implitapide, R56918 (CAS No. 403987) and CAS No. 913541-47-6), CCKa agonists (e.g., N-benzyl-244-(1H-indol-3-ylmethyl)-5-oxo-1-phenyl-4,5-dihydro-2,3,6,10b-tetraaza-benzo[e]azulen-6-yl]-N-isopropyl-acetamide described in PCT Publication No. WO 2005/116034 or US Publication No. 2005-0267100 A1), 5HT2c agonists (e.g., lorcaserin), MCR4 agonist (e.g., compounds described in U.S. Pat. No. 6,818,658), lipase inhibitor (e.g., Cetilistat), PYY3-36 (as used herein "PYY3-36" includes analogs, such as peglated PYY3-36 e.g., those described in US Publication 2006/0178501), opioid antagonists (e.g., naltrexone), the combination of naltrexone with buproprion, oleoyl-estrone (CAS No. 180003-17-2), obinepitide (TM30338), pramlintide (Symlin®), tesofensine (NS2330), leptin, liraglutide, bromocriptine, orlistat, exenatide (Byetta®), AOD-9604 (CAS No. 221231-10-3), phentermine and topiramate (trade name: Qsymia), and sibutramine. Preferably, oligonucleotides of the present disclosure and combination therapies are administered in conjunction with exercise and a sensible diet.

Those skilled in the art will recognize that oligonucleotides of the present disclosure may also be used in conjunction with cardiovascular or cerebrovascular treatments as described in the paragraphs below. Oligonucleotides of the present disclosure may also be used with cardiovascular therapies including PCI, stenting, drug eluting stents, stem cell therapy and medical devices such as implanted pacemakers, defibrillators, or cardiac resynchronization therapy.

The oligonucleotides of the present disclosure may be used in combination with cholesterol modulating agents (including cholesterol lowering agents) such as a lipase inhibitor, an HMG-CoA reductase inhibitor, an HMG-CoA synthase inhibitor, an HMG-CoA reductase gene expression inhibitor, an HMG-CoA synthase gene expression inhibitor, an MTP/Apo B secretion inhibitor, a CETP inhibitor, a bile acid absorption inhibitor, a cholesterol absorption inhibitor, a cholesterol synthesis inhibitor, a squalene synthetase inhibitor, a squalene epoxidase inhibitor, a squalene cyclase inhibitor, a combined squalene epoxidase/squalene cyclase inhibitor, a fibrate, niacin, an ion-exchange resin, an antioxidant, an ACAT inhibitor or a bile acid sequestrant or an agent such as mipomersen.

Examples of suitable cholesterol/lipid lowering agents and lipid profile therapies include: HMG-CoA reductase inhibitors (e.g., pravastatin, lovastatin, atorvastatin, simvastatin, fluvastatin, NK-104 (a.k.a. itavastatin, or nisvastatin or nisbastatin) and ZD-4522 (a.k.a. rosuvastatin, or atavastatin or visastatin); squalene synthetase inhibitors; fibrates; bile acid sequestrants (such as questran); ACAT inhibitors; MTP inhibitors; lipooxygenase inhibitors; choesterol absorption inhibitors; and cholesteryl ester transfer protein inhibitors. Other atherosclerotic agents include PCSK9 modulators.

Administration of an Oligonucleotide or a Single-Stranded RNAi Agent

In some embodiments, provided oligonucleotides are capable of directing a decrease in the expression and/or level of a target gene or its gene product. In some embodiments, provided oligonucleotides are capable of directing a decrease in the expression and/or level of a target gene or its gene product via RNA interference. In some embodiments, provided oligonucleotides are capable of directing a decrease in the expression and/or level of a target gene or its gene product via a biochemical mechanism which does not involve RNA interference or RISC (including, but not limited to, RNaseH-mediated knockdown or steric hindrance of gene expression). In some embodiments, provided oligonucleotides are capable of directing a decrease in the expression and/or level of a target gene or its gene product via RNA interference and/or RNase H-mediated knockdown. In some embodiments, provided oligonucleotides are capable of directing a decrease in the expression and/or level of a target gene or its gene product by sterically blocking translation after annealing to a target gene mRNA, and/or by altering or interfering with mRNA splicing and/or exon inclusion or exclusion. In some embodiments, provided oligonucleotides are administered with any vehicle, in any dosing regiment, and in any manner described herein or known in the art.

In some embodiments, a provided oligonucleotide composition is administered at a dose and/or frequency lower than that of an otherwise comparable reference oligonucleotide composition with comparable effect in improving the knockdown of a target transcript. In some embodiments, a stereocontrolled oligonucleotide composition is administered at a dose and/or frequency lower than that of an otherwise comparable stereorandom reference oligonucleotide composition with comparable effect in improving the knockdown of the target transcript.

In some embodiments, the present disclosure recognizes that properties, e.g., improved single-stranded RNA interference activity, etc. of oligonucleotides and compositions thereof can be optimized by chemical modifications and/or stereochemistry. In some embodiments, the present disclosure provides methods for optimizing oligonucleotide properties through chemical modifications and stereochemistry.

By controlling of chemical modifications and/or stereochemistry, the present disclosure provides improved oligonucleotide compositions and methods. In some embodiments, provided oligonucleotides capable of directing single-stranded RNA interference comprise chemical modifications. In some embodiments, provided oligonucleotides capable of directing single-stranded RNA interference comprise base modifications, sugar modifications, internucleotidic linkage modifications, or any combinations thereof. In some embodiments, provided oligonucleotides capable of directing single-stranded RNA interference comprise base modifications. In some embodiments, provided oligonucleotides capable of directing single-stranded RNA interference comprise sugar modifications. In some embodiments, provided oligonucleotides comprises 2'-modifications on the sugar moieties. In some embodiments, provided oligonucleotides comprises one or more modified internucleotidic linkages and one or more natural phosphate linkages. A natural phosphate linkage can be incorporated into various locations of an oligonucleotide. In some embodiments, a natural phosphate linkage is incorporated into the 5'-end region. In some embodiments, a natural phosphate linkage is incorporated into the middle of an oligonucleotide. In some embodiments, the present disclosure provides a method comprising administering a composition comprising a first plurality of oligonucleotides, which composition displays improved delivery as compared with a reference composition comprising a plurality of oligonucleotides, each of which also has the common base sequence but which differs structurally from the oligonucleotides of the first plurality in that: individual oligonucleotides within the reference plurality differ from one another in stereochemical structure; and/or at least some oligonucleotides within the reference plurality have a structure different from a structure represented by the plurality of oligonucleotides of the composition.

In some embodiments, the present disclosure provides a method of administering an oligonucleotide composition comprising a first plurality of oligonucleotides capable of directing single-stranded RNA interference and having a common nucleotide sequence, the improvement that comprises:

administering an oligonucleotide comprising a first plurality of oligonucleotides that is characterized by improved delivery relative to a reference oligonucleotide composition of the same common nucleotide sequence.

In some embodiments, provided oligonucleotides, compositions and methods provide improved systemic delivery. In some embodiments, provided oligonucleotides, compositions and methods provide improved cytoplasmatic delivery. In some embodiments, improved delivery is to a population of cells. In some embodiments, improved delivery is to a tissue. In some embodiments, improved delivery is to an organ. In some embodiments, improved delivery is to an organism. Example structural elements (e.g., chemical modifications, stereochemistry, combinations thereof, etc.), oligonucleotides, compositions and methods that provide improved delivery are extensively described in this disclosure.

In some embodiments, the present disclosure provides a method of identifying and/or characterizing an oligonucleotide composition, the method comprising steps of:

providing at least one composition comprising a first plurality of oligonucleotides; and assessing delivery relative to a reference composition.

In some embodiments, the present disclosure provides a method of identifying and/or characterizing an oligonucleotide composition, the method comprising steps of:

providing at least one composition comprising a first plurality of oligonucleotides; and assessing cellular uptake relative to a reference composition.

In some embodiments, properties of a provided oligonucleotide compositions are compared to a reference oligonucleotide composition. In some embodiments, a reference oligonucleotide composition comprises a reference plurality of oligonucleotides.

In some embodiments, a reference oligonucleotide composition is a stereorandom oligonucleotide composition. In some embodiments, a reference oligonucleotide composition is a stereorandom composition of oligonucleotides of which all internucleotidic linkages are phosphorothioate. In some embodiments, a reference oligonucleotide composition is a DNA oligonucleotide composition with all phosphate linkages.

In some embodiments, a reference composition is a composition of oligonucleotides having the same base sequence and the same chemical modifications. In some embodiments, a reference composition is a composition of oligonucleotides having the same base sequence and the same pattern of chemical modifications. In some embodiments, a reference composition is a chirally un-controlled (or stereorandom) composition of oligonucleotides having the same base sequence and chemical modifications.

In some embodiments, a reference composition is a composition of oligonucleotides having the same base sequence but different chemical modifications. In some embodiments, a reference composition is a composition of oligonucleotides having the same base sequence, base modifications, internucleotidic linkage modifications but different sugar modifications. In some embodiments, a reference composition has fewer 2'-modified sugar modifications. In some embodiments, a reference composition is a composition of oligonucleotides having the same base sequence, base modifications, sugar modifications but different internucleotidic linkage modifications. In some embodiments, a reference composition has more internucleotidic linkage modifications. In some embodiments, a reference composition has fewer natural phosphate linkages. In some embodiments, a reference composition comprising oligonucleotides having no natural phosphate linkages.

In some embodiments, a reference composition is a composition comprising a reference plurality of oligonucleotides wherein individual oligonucleotides within the reference plurality differ from one another in stereochemical structure. In some embodiments, a reference composition is a composition comprising a reference plurality of oligonucleotides, wherein at least some oligonucleotides within the reference plurality have a structure different from a structure represented by a plurality of oligonucleotides of a composition compared to the reference composition.

In some embodiments, a reference oligonucleotide composition comprises a reference plurality of oligonucleotides capable of directing single-stranded RNA interference and having the same common nucleotide sequence but lacking at least one of the one or more modified sugar moieties in oligonucleotides of the oligonucleotide composition compared to the reference composition. In some embodiments, a reference oligonucleotide composition comprises a reference plurality of oligonucleotides capable of directing single-stranded RNA interference and having the same common nucleotide sequence but have no modified sugar moieties. In some embodiments, a reference oligonucleotide composition comprises a reference plurality of oligonucleotides capable of directing single-stranded RNA interference and having the same common nucleotide sequence but do not comprise natural phosphate linkages. In some embodiments, a reference composition is an oligonucleotide or a single-stranded RNAi agent of oligonucleotides having the same chemical modification patterns. In some embodiments, a reference composition is an oligonucleotide or a single-stranded RNAi agent of another stereoisomer.

In some embodiments, a reference oligonucleotide composition of a provided oligonucleotide composition is a comparable composition absence of the lipids in the provided composition. In some embodiments, a reference oligonucleotide composition is a stereorandom oligonucleotide composition. In some embodiments, a reference oligonucleotide composition is a stereorandom composition of oligonucleotides of which all internucleotidic linkages are phosphorothioate. In some embodiments, a reference oligonucleotide composition is a DNA oligonucleotide composition with all phosphate linkages. In some embodiments, a reference composition is a composition of oligonucleotides having the same base sequence and the same chemical modifications. In some embodiments, a reference composition is a composition of oligonucleotides having the same base sequence and the same pattern of chemical modifications. In some embodiments, a reference composition is a chirally un-controlled (or stereorandom) composition of oligonucleotides having the same base sequence and chemical modifications. In some embodiments, a reference composition is a composition of oligonucleotides having the same base sequence but different chemical modifications. In some embodiments, a reference composition is a composition of oligonucleotides having the same base sequence, base modifications, internucleotidic linkage modifications but different sugar modifications. In some embodiments, a reference composition has fewer 2'-modified sugar modifications. In some embodiments, a reference composition is a composition of oligonucleotides having the same base sequence, base modifications, sugar modifications but different internucleotidic linkage modifications. In some embodiments, a reference composition has more internucleotidic linkage modifications. In some embodiments, a reference composition has fewer natural phosphate linkages. In some embodiments, a reference composition comprising oligonucleotides having no natural phosphate linkages. In some embodiments, a reference composition is a composition comprising a reference plurality of oligonucleotides wherein individual oligonucleotides within the reference plurality differ from one another in stereochemical structure. In some embodiments, a reference composition is a composition comprising a reference plurality of oligonucleotides, wherein at least some oligonucleotides within the reference plurality have a structure different from a structure represented by a plurality of oligonucleotides of a composition compared to the reference composition. In some embodiments, a reference oligonucleotide composition comprises a reference plurality of oligonucleotides capable of directing single-stranded RNA interference and having the same common nucleotide sequence but lacking at least one of the one or more modified sugar moieties in oligonucleotides of the oligonucleotide composition compared to the reference composition. In some embodiments, a reference oligonucleotide composition comprises a reference plurality of oligonucleotides capable of directing single-stranded RNA interference and having the same common nucleotide sequence but have no modified sugar moieties. In some embodiments, a reference oligonucleotide composition comprises a reference plurality of oligonucleotides capable of directing single-stranded RNA interference and having the same common nucleotide sequence but do not comprise natural phosphate linkages. In some embodiments, a reference composition is an oligonucleotide or a single-stranded RNAi agent of oligonucleotides having the same chemical modification patterns. In some embodiments, a reference composition is an oligonucleotide or a single-stranded RNAi agent of another stereoisomer.

In some embodiments, oligonucleotides of the first plurality comprise one or more structural elements (e.g., modifications, stereochemistry, patterns, etc.) that oligonucleotides of the reference plurality do not all have. Such structural elements can be any one described in this disclosure.

In some embodiments, oligonucleotides of the first plurality comprise more phosphorothioate linkages than oligonucleotides of the reference composition. In some embodiments, oligonucleotides of the first plurality comprise more phosphorothioate linkages than oligonucleotides of the reference composition at the 5'-end region. In some embodiments, oligonucleotides of the first plurality comprise more phosphorothioate linkages than oligonucleotides of the reference composition at the 3'-end region. In some embodiments, oligonucleotides of the first plurality comprise more Sp chiral internucleotidic linkages than oligonucleotides of the reference composition. In some embodiments, oligonucleotides of the first plurality comprise more Sp phosphorothioate linkages than oligonucleotides of the reference composition. In some embodiments, oligonucleotides of the first plurality comprise more Sp phosphorothioate linkages than oligonucleotides of the reference composition at the 5'-end region. In some embodiments, oligonucleotides of the first plurality comprise more Sp phosphorothioate linkages than oligonucleotides of the reference composition at the 3'-end region. In some embodiments, oligonucleotides of the first plurality comprise more modified bases than oligonucleotides of the reference composition. In some embodiments, oligonucleotides of the first plurality comprise more methylated bases than oligonucleotides of the reference composition. In some embodiments, oligonucleotides of the first plurality comprise more methylated bases than oligonucleotides of the reference composition at the 5'-end region. In some embodiments, oligonucleotides of the first plurality comprise more methylated bases than oligonucleotides of the reference composition at the 3'-end region. In some embodiments, oligonucleotides of the first plurality comprise fewer 2'-MOE modifications than oligonucleotides of the reference composition. In some embodiments, oligonucleotides of the first plurality comprise fewer 2'-MOE modifications than oligonucleotides of the reference composition. In some embodiments, oligonucleotides of the first plurality comprise fewer 2'-MOE modifications than oligonucleotides of the reference composition at the 5'-end region. In some embodiments, oligonucleotides of the first plurality comprise fewer 2'-MOE modifications than oligonucleotides of the reference composition at the 3'-end region. In some embodiments, individual oligonucleotides within the reference plurality differ from one another in stereochemical structure. In some embodiments, at least some oligonucleotides within the reference plurality have a structure different from a structure represented by the plurality of oligonucleotides of the composition. In some embodiments, the reference composition is a substantially racemic preparation of oligonucleotides that share the base sequence. In some embodiments, the reference composition is an oligonucleotide or a single-stranded RNAi agent of another oligonucleotide type. In some embodiments, oligonucleotides of the reference composition comprise more phosphorothioate linkages. In some embodiments, oligonucleotides of the reference composition comprise only phosphorothioate linkages. In some embodiments, oligonucleotides of the reference composition comprise fewer modified sugar moieties. In some embodiments, oligonucleotides of the reference composition comprise fewer modified sugar moieties, wherein the modification is 2'—OR$^1$. In some embodiments, oligonucleotides of the reference composition comprise more modified sugar moieties. In some embodiments, oligonucleotides of the reference composition comprise more modified sugar moieties, the modification is 2'—OR$^1$. In some embodiments, oligonucleotides of the reference composition comprise fewer phosphorothioate linkages. In some embodiments, oligonucleotides of the reference composition comprise fewer methylated bases. In some embodiments, oligonucleotides of the reference composition comprise more 2'-MOE modifications. In some embodiments, oligonucleotides of the reference composition comprise fewer natural phosphate linkages. In some embodiments, oligonucleotides of the reference composition comprise fewer natural phosphate linkages at the 5'- and/or 3'-end region In some embodiments, oligonucleotides of a provided composition comprise fewer 2'-MOE modifications than oligonucleotides of the reference composition. In some embodiments, oligonucleotides of a provided composition comprise fewer 2'-MOE modifications than oligonucleotides of the reference composition. In some embodiments, oligonucleotides of a provided composition comprise fewer 2'-MOE modifications than oligonucleotides of the reference composition at the 5'-end region. In some embodiments, oligonucleotides of a provided composition comprise fewer 2'-MOE modifications than oligonucleotides of the reference composition at the 3'-end region. In some embodiments, individual oligonucleotides within the reference plurality differ from one another in stereochemical structure. In some embodiments, at least some oligonucleotides within the reference plurality have a structure different from a structure represented by the plurality of oligonucleotides of the composition. In some embodiments, the reference composition is a substantially racemic preparation of oligonucleotides that share the base sequence. In some embodiments, the reference composition is an oligonucleotide or a single-stranded RNAi agent of another oligonucleotide type. In some embodiments, oligonucleotides of the reference composition comprise more phosphorothioate linkages. In some embodiments, oligonucleotides of the reference composition comprise only phosphorothioate linkages. In some embodiments, oligonucleotides of the reference composition comprise fewer modified sugar moieties. In some embodiments, oligonucleotides of the reference composition comprise fewer modified sugar moieties, wherein the modification is 2'—OR$^1$. In some embodiments, oligonucleotides of the reference composition comprise more modified sugar moieties. In some embodiments, oligonucleotides of the reference composition comprise more modified sugar moieties, the modification is 2'—OR$^1$. In some embodiments, oligonucleotides of the reference composition comprise fewer phosphorothioate linkages. In some embodiments, oligonucleotides of the reference composition comprise fewer methylated bases. In some embodiments, oligonucleotides of the reference composition comprise more 2'-MOE modifications. In some embodiments, oligonucleotides of the reference composition comprise fewer natural phosphate linkages. In some embodiments, oligonucleotides of the reference composition comprise fewer natural phosphate linkages at the 5'- and/or 3'-end region. In some embodiments, oligonucleotides of a reference plurality comprise fewer nucleotidic units comprising —F. In some embodiments, oligonucleotides of a reference plurality comprise fewer 2'-F modified sugar moieties. In some embodiments, oligonucleotides of a reference plurality comprise fewer chirally controlled modified internucleotidic linkages.

In some embodiments, provided chirally controlled oligonucleotide compositions comprises oligonucleotides of one oligonucleotide type. In some embodiments, provided chirally controlled oligonucleotide compositions comprises oligonucleotides of only one oligonucleotide type. In some embodiments, provided chirally controlled oligonucleotide compositions has oligonucleotides of only one oligonucleotide type. In some embodiments, provided chirally controlled oligonucleotide compositions comprises oligonucleotides of two or more oligonucleotide types. In some embodiments, using such compositions, provided methods can target more than one target. In some embodiments, an oligonucleotide or a single-stranded RNAi agent comprising two or more oligonucleotide types targets two or more targets. In some embodiments, an oligonucleotide or a single-stranded RNAi agent comprising two or more oligonucleotide types targets two or more mismatches. In some embodiments, a single oligonucleotide type targets two or more targets, e.g., mutations. In some embodiments, a target region of oligonucleotides of one oligonucleotide type comprises two or more "target sites" such as two mutations or SNPs.

In some embodiments, oligonucleotides in a provided chirally controlled oligonucleotide composition optionally comprise modified bases or sugars. In some embodiments, a provided chirally controlled oligonucleotide composition does not have any modified bases or sugars. In some embodiments, a provided chirally controlled oligonucleotide composition does not have any modified bases. In some embodiments, oligonucleotides in a provided chirally controlled oligonucleotide composition comprise modified bases and sugars. In some embodiments, oligonucleotides in a provided chirally controlled oligonucleotide composition comprise a modified base. In some embodiments, oligonucleotides in a provided chirally controlled oligonucleotide composition comprise a modified sugar. Modified bases and sugars for oligonucleotides are widely known in the art, including but not limited in those described in the present disclosure. In some embodiments, a modified base is 5-mC. In some embodiments, a modified sugar is a 2'-modified sugar. Suitable 2'-modification of oligonucleotide sugars are widely known by a person having ordinary skill in the art. In some embodiments, 2'-modifications include but are not limited to 2'—OR', wherein R' is not hydrogen. In some embodiments, a 2'-modification is 2'—OR$^1$, wherein R$^1$ is optionally substituted $C_{1-6}$ aliphatic. In some embodiments, a 2'-modification is 2'-MOE. In some embodiments, a modification is 2'-halogen. In some embodiments, a modification is 2'—F. In some embodiments, modified bases or sugars may further enhance activity, stability and/or selectivity of a chirally controlled oligonucleotide composition, whose common pattern of backbone chiral centers provides unexpected activity, stability and/or selectivity.

In some embodiments, a provided chirally controlled oligonucleotide composition does not have any modified sugars. In some embodiments, a provided chirally controlled oligonucleotide composition does not have any 2'-modified sugars. In some embodiments, the present disclosure surprising found that by using chirally controlled oligonucleotide compositions, modified sugars are not needed for stability, activity, and/or control of cleavage patterns. Furthermore, in some embodiments, the present disclosure surprisingly found that chirally controlled oligonucleotide compositions of oligonucleotides without modified sugars deliver better properties in terms of stability, activity, turnover and/or control of cleavage patterns. For example, in some embodiments, it is surprising found that chirally controlled oligonucleotide compositions of oligonucleotides having no modified sugars dissociates much faster from cleavage products and provide significantly increased turnover than compositions of oligonucleotides with modified sugars.

As discussed in detail herein, the present disclosure provides, among other things, a chirally controlled oligonucleotide composition, meaning that the composition contains a plurality of oligonucleotides of at least one type. Each oligonucleotide molecule of a particular "type" is comprised of preselected (e.g., predetermined) structural elements with respect to: (1) base sequence; (2) pattern of backbone linkages; (3) pattern of backbone chiral centers; and (4) pattern of backbone P-modification moieties. In some embodiments, provided oligonucleotide compositions contain oligonucleotides that are prepared in a single synthesis process. In some embodiments, provided compositions contain oligonucleotides having more than one chiral configuration within a single oligonucleotide molecule (e.g., where different residues along the oligonucleotide have different stereochemistry); in some such embodiments, such oligonucleotides may be obtained in a single synthesis process, without the need for secondary conjugation steps to generate individual oligonucleotide molecules with more than one chiral configuration.

Oligonucleotide compositions as provided herein can be used as single-stranded RNAi agents. In addition, oligonucleotide compositions as provided herein can be used as reagents for research and/or diagnostic purposes. One of ordinary skill in the art will readily recognize that the present disclosure disclosure herein is not limited to particular use but is applicable to any situations where the use of synthetic oligonucleotides is desirable. Among other things, provided compositions are useful in a variety of therapeutic, diagnostic, agricultural, and/or research applications.

In some embodiments, provided oligonucleotide compositions comprise oligonucleotides and/or residues thereof that include one or more structural modifications as described in detail herein. In some embodiments, provided oligonucleotide compositions comprise oligonucleotides that contain one or more modified nucleotides. In some embodiments, provided oligonucleotide compositions comprise oligonucleotides that contain one or more artificial nucleic acids or residues, including but not limited to: peptide nucleic acids (PNA), Morpholino and locked nucleic acids (LNA), glycon nucleic acids (GNA), threose nucleic acids (TNA), Xeno nucleic acids (XNA), manitol nucleic acid (MNA), anitol nucleic acid (ANA), and F-HNA, and any combination thereof. In some embodiments, a provided oligonucleotide comprises a Morpholino as described in Braasch et al. 2002 Biochem. 41: 4503-4510, or U.S. Pat. Nos. 5,698,685; 5,166,315; 5,185,444; or 5,034,506. In some embodiments, a provided oligonucleotide comprises a F-HNA as described in U.S. Pat. Nos. 8,088,904; 8,440,803; or 8,796,437; or in WO 2017/011276. Various modified nucleotides, including modified sugars are described in, for example, WO 2016/154096 and WO 2016/141236.

In any of the embodiments, the disclosure is useful for oligonucleotide-based modulation of gene expression, immune response, etc. Accordingly, stereo-defined, oligonucleotide compositions of the disclosure, which contain oligonucleotides of predetermined type (i.e., which are chirally controlled, and optionally chirally pure), can be used in lieu of conventional stereo-random or chirally impure counterparts. In some embodiments, provided compositions show enhanced intended effects and/or reduced unwanted side effects. Certain embodiments of biological and clinical/therapeutic applications of the disclosure are discussed explicitly below.

Various dosing regimens can be utilized to administer provided chirally controlled oligonucleotide compositions. In some embodiments, multiple unit doses are administered, separated by periods of time. In some embodiments, a given composition has a recommended dosing regimen, which may involve one or more doses. In some embodiments, a dosing regimen comprises a plurality of doses each of which are separated from one another by a time period of the same length; in some embodiments, a dosing regimen comprises a plurality of doses and at least two different time periods separating individual doses. In some embodiments, all doses within a dosing regimen are of the same unit dose amount. In some embodiments, different doses within a dosing regimen are of different amounts. In some embodiments, a dosing regimen comprises a first dose in a first dose amount, followed by one or more additional doses in a second dose amount different from the first dose amount. In some embodiments, a dosing regimen comprises a first dose in a first dose amount, followed by one or more additional doses in a second (or subsequent) dose amount that is same as or different from the first dose (or another prior dose) amount. In some embodiments, a dosing regimen comprises administering at least one unit dose for at least one day. In some embodiments, a dosing regimen comprises administering more than one dose over a time period of at least one day, and sometimes more than one day. In some embodiments, a dosing regimen comprises administering multiple doses over a time period of at least week. In some embodiments, the time period is at least 2, 3, 4, 5, 6, 7, 8, 9, 10, 11, 12, 13, 14, 15, 16, 17, 18, 19, 20, 21, 22, 23 24, 25, 26, 27, 28, 29, 30, 31, 32, 33, 34, 35, 36, 37, 38, 39, 40 or more (e.g., about 45, 50, 55, 60, 65, 70, 75, 80, 85, 90, 95, 100 or more) weeks. In some embodiments, a dosing regimen comprises administering one dose per week for more than one week. In some embodiments, a dosing regimen comprises administering one dose per week for 2, 3, 4, 5, 6, 7, 8, 9, 10, 11, 12, 13, 14, 15, 16, 17, 18, 19, 20, 21, 22, 23 24, 25, 26, 27, 28, 29, 30, 31, 32, 33, 34, 35, 36, 37, 38, 39, 40 or more (e.g., about 45, 50, 55, 60, 65, 70, 75, 80, 85, 90, 95, 100 or more) weeks. In some embodiments, a dosing regimen comprises administering one dose every two weeks for more than two week period. In some embodiments, a dosing regimen comprises administering one dose every two weeks over a time period of 2, 3, 4, 5, 6, 7, 8, 9, 10, 11, 12, 13, 14, 15, 16, 17, 18, 19, 20, 21, 22, 23 24, 25, 26, 27, 28, 29, 30, 31, 32, 33, 34, 35, 36, 37, 38, 39, 40 or more (e.g., about 45, 50, 55, 60, 65, 70, 75, 80, 85, 90, 95, 100 or more) weeks. In some embodiments, a dosing regimen comprises administering one dose per month for one month. In some embodiments, a dosing regimen comprises administering one dose per month for more than one month. In some embodiments, a dosing regimen comprises administering one dose per month for 2, 3, 4, 5, 6, 7, 8, 9, 10, 11, 12, or more months. In some embodiments, a dosing regimen comprises administering one dose per week for about 10 weeks. In some embodiments, a dosing regimen comprises administering one dose per week for about 20 weeks. In some embodiments, a dosing regimen comprises administering one dose per week for about 30 weeks. In some embodiments, a dosing regimen comprises administering one dose per week for 26 weeks. In some embodiments, an oligonucleotide or a single-stranded RNAi agent is administered according to a dosing regimen that differs from that utilized for a chirally uncontrolled (e.g., stereorandom) oligonucleotide composition of the same sequence, and/or of a different chirally controlled oligonucleotide composition of the same sequence. In some embodiments, an oligonucleotide or a single-stranded RNAi agent is administered according to a dosing regimen that is reduced as compared with that of a chirally uncontrolled (e.g., stereorandom) oligonucleotide composition of the same sequence in that it achieves a lower level of total exposure over a given unit of time, involves one or more lower unit doses, and/or includes a smaller number of doses over a given unit of time. In some embodiments, an oligonucleotide or a single-stranded RNAi agent is administered according to a dosing regimen that extends for a longer period of time than does that of a chirally uncontrolled (e.g., stereorandom) oligonucleotide composition of the same sequence Without wishing to be limited by theory, Applicant notes that in some embodiments, the shorter dosing regimen, and/or longer time periods between doses, may be due to the improved stability, bioavailability, and/or efficacy of a chirally controlled oligonucleotide composition. In some embodiments, an oligonucleotide or a single-stranded RNAi agent has a longer dosing regimen compared to the corresponding chirally uncontrolled oligonucleotide composition. In some embodiments, an oligonucleotide or a single-stranded RNAi agent has a shorter time period between at least two doses compared to the corresponding chirally uncontrolled oligonucleotide composition. Without wishing to be limited by theory, Applicant notes that in some embodiments longer dosing regimen, and/or shorter time periods between doses, may be due to the improved safety of a chirally controlled oligonucleotide composition.

In some embodiments, with their improved delivery (and other properties), provided compositions can be administered in lower dosages and/or with lower frequency to achieve biological effects, for example, clinical efficacy.

A single dose can contain various amounts of oligonucleotides. In some embodiments, a single dose can contain various amounts of a type of chirally controlled oligonucleotide, as desired suitable by the application. In some embodiments, a single dose contains about 1, 5, 10, 20, 30, 40, 50, 60, 70, 80, 90, 100, 110, 120, 130, 140, 150, 160, 170, 180, 190, 200, 210, 220, 230, 240, 250, 260, 270, 280, 290, 300 or more (e.g., about 350, 400, 450, 500, 550, 600, 650, 700, 750, 800, 850, 900, 950, 1000 or more) mg of a type of chirally controlled oligonucleotide. In some embodiments, a single dose contains about 1 mg of a type of chirally controlled oligonucleotide. In some embodiments, a single dose contains about 5 mg of a type of chirally controlled oligonucleotide. In some embodiments, a single dose contains about 10 mg of a type of chirally controlled oligonucleotide. In some embodiments, a single dose contains about 15 mg of a type of chirally controlled oligonucleotide. In some embodiments, a single dose contains about 20 mg of a type of chirally controlled oligonucleotide. In some embodiments, a single dose contains about 50 mg of a type of chirally controlled oligonucleotide. In some embodiments, a single dose contains about 100 mg of a type of chirally controlled oligonucleotide. In some embodiments, a single dose contains about 150 mg of a type of chirally controlled oligonucleotide. In some embodiments, a single dose contains about 200 mg of a type of chirally controlled oligonucleotide. In some embodiments, a single dose contains about 250 mg of a type of chirally controlled oligonucleotide. In some embodiments, a single dose contains about 300 mg of a type of chirally controlled oligonucleotide. In some embodiments, a chirally controlled oligonucleotide is administered at a lower amount in a single dose, and/or in total dose, than a chirally uncontrolled oligonucleotide. In some embodiments, a chirally controlled oligonucleotide is administered at a lower amount in a single dose, and/or in total dose, than a chirally uncontrolled oligonucleotide due to improved efficacy. In some embodiments, a chirally controlled oligonucleotide is administered at a higher amount in a single dose, and/or in total dose, than a chirally uncontrolled oligonucleotide. In some embodiments, a chirally controlled oligonucleotide is administered at a higher amount in a single dose, and/or in total dose, than a chirally uncontrolled oligonucleotide due to improved safety.

Biologically Active Oligonucleotides

In some embodiments, the present disclosure encompasses oligonucleotides which capable of acting as single-stranded RNAi agents.

In some embodiments, provided compositions include one or more oligonucleotides fully or partially complementary to strand of: structural genes, genes control and/or termination regions, and/or self-replicating systems such as viral or plasmid DNA. In some embodiments, provided compositions include one or more oligonucleotides that are or act as RNAi agents or other RNA interference reagents (RNAi agents or iRNA agents), shRNA, antisense oligonucleotides, self-cleaving RNAs, ribozymes, fragment thereof and/or variants thereof (such as Peptidyl transferase 23S rRNA, RNase P, Group I and Group II introns, GIRL branching ribozymes, Leadzyme, Hairpin ribozymes, Hammerhead ribozymes, HDV ribozymes, Mammalian CPEB3 ribozyme, VS ribozymes, glmS ribozymes, CoTC ribozyme, etc.), microRNAs, microRNA mimics, supermirs, aptamers, antimirs, antagomirs, U1 adaptors, triplex-forming oligonucleotides, RNA activators, long non-coding RNAs, short non-coding RNAs (e.g., piRNAs), immunomodulatory oligonucleotides (such as immunostimulatory oligonucleotides, immunoinhibitory oligonucleotides), GNA, LNA, ENA, PNA, TNA, morpholinos, G-quadruplex (RNA and DNA), antiviral oligonucleotides, and decoy oligonucleotides.

In some embodiments, provided compositions include one or more hybrid (e.g., chimeric) oligonucleotides. In the context of the present disclosure, the term "hybrid" broadly refers to mixed structural elements of oligonucleotides. Hybrid oligonucleotides may refer to, for example, (1) an oligonucleotide molecule having mixed classes of nucleotides, e.g., part DNA and part RNA within the single molecule (e.g., DNA-RNA); (2) complementary pairs of nucleic acids of different classes, such that DNA:RNA base pairing occurs either intramolecularly or intermolecularly; or both; (3) an oligonucleotide with two or more kinds of the backbone or internucleotide linkages.

In some embodiments, provided compositions include one or more oligonucleotide that comprises more than one classes of nucleic acid residues within a single molecule. For example, in any of the embodiments described herein, an oligonucleotide may comprise a DNA portion and an RNA portion. In some embodiments, an oligonucleotide may comprise a unmodified portion and modified portion.

Provided oligonucleotide compositions can include oligonucleotides containing any of a variety of modifications, for example as described herein. In some embodiments, particular modifications are selected, for example, in light of intended use. In some embodiments, it is desirable to modify one or both strands of a double-stranded oligonucleotide (or a double-stranded portion of a single-stranded oligonucleotide). In some embodiments, the two strands (or portions) include different modifications. In some embodiments, the two strands include the same modifications. One of skill in the art will appreciate that the degree and type of modifications enabled by methods of the present disclosure allow for numerous permutations of modifications to be made. Examples of such modifications are described herein and are not meant to be limiting.

The phrase "antisense strand" as used herein, refers to an oligonucleotide that is substantially or 100% complementary to a target sequence of interest. The phrase "antisense strand" includes the antisense region of both oligonucleotides that are formed from two separate strands, as well as unimolecular oligonucleotides that are capable of forming hairpin or dumbbell type structures. In reference to a double-stranded RNAi agent such as a siRNA, the antisense strand is the strand preferentially incorporated into RISC, and which targets RISC-mediated knockdown of a RNA target. In reference to a double-stranded RNAi agent, the terms "antisense strand" and "guide strand" are used interchangeably herein; and the terms "sense strand" or "passenger strand" are used interchangeably herein in reference to the strand which is not the antisense strand.

The phrase "sense strand" refers to an oligonucleotide that has the same nucleoside sequence, in whole or in part, as a target sequence such as a messenger RNA or a sequence of DNA.

By "target sequence" is meant any nucleic acid sequence whose expression or activity is to be modulated. The target nucleic acid can be DNA or RNA, such as endogenous DNA or RNA, viral DNA or viral RNA, or other RNA encoded by a gene, virus, bacteria, fungus, mammal, or plant. In some embodiments, a target sequence is associated with a disease or disorder. In reference to RNA interference and RNase H-mediated knockdown, a target sequence is generally a RNA target sequence.

By "specifically hybridizable" and "complementary" is meant that a nucleic acid can form hydrogen bond(s) with another nucleic acid sequence by either traditional Watson-Crick or other non-traditional types. In reference to the nucleic molecules of the present disclosure, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al, 1987, CSH Symp. Quant. Biol. LIT pp. 123-133; Frier et al., 1986, Proc. Nat. Acad. Sci. USA 83: 9373-9377; Turner et al., 1987, J. Am. Chem. Soc. 109:3783-3785)

A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9,10 out of 10 being 50%, 60%, 70%, 80%, 90%, and 100% complementary). "Perfectly complementary" or 100% complementarity means that all the contiguous residues of a nucleic acid sequence will hydrogen bond with the same number of contiguous residues in a second nucleic acid sequence. Less than perfect complementarity refers to the situation in which some, but not all, nucleoside units of two strands can hydrogen bond with each other. "Substantial complementarity" refers to polynucleotide strands exhibiting 90% or greater complementarity, excluding regions of the polynucleotide strands, such as overhangs, that are selected so as to be noncomplementary. Specific binding requires a sufficient degree of complementarity to avoid non-specific binding of the oligomeric compound to non-target sequences under conditions in which specific binding is desired, e.g., under physiological conditions in the case of in vivo assays or therapeutic treatment, or in the case of in vitro assays, under conditions in which the assays are performed. In some embodiments, non-target sequences differ from corresponding target sequences by at least 5 nucleotides.

When used as therapeutics, a provided oligonucleotide is administered as a pharmaceutical composition. In some embodiments, the pharmaceutical composition comprises a therapeutically effective amount of a provided oligonucleotide comprising, or a pharmaceutically acceptable salt thereof, and at least one pharmaceutically acceptable inactive ingredient selected from pharmaceutically acceptable diluents, pharmaceutically acceptable excipients, and pharmaceutically acceptable carriers. In some embodiments, the pharmaceutical composition is formulated for intravenous injection, oral administration, buccal administration, inhalation, nasal administration, topical administration, ophthalmic administration or otic administration. In further embodiments, the pharmaceutical composition is a tablet, a pill, a capsule, a liquid, an inhalant, a nasal spray solution, a suppository, a suspension, a gel, a colloid, a dispersion, a suspension, a solution, an emulsion, an ointment, a lotion, an eye drop or an ear drop.

Pharmaceutical Compositions

When used as therapeutics, a provided oligonucleotide or oligonucleotide composition described herein is administered as a pharmaceutical composition. In some embodiments, the pharmaceutical composition comprises a therapeutically effective amount of a provided oligonucleotides, or a pharmaceutically acceptable salt thereof, and at least one pharmaceutically acceptable inactive ingredient selected from pharmaceutically acceptable diluents, pharmaceutically acceptable excipients, and pharmaceutically acceptable carriers. In some embodiments, the pharmaceutical composition is formulated for intravenous injection, oral administration, buccal administration, inhalation, nasal administration, topical administration, ophthalmic administration or otic administration. In some embodiments, the pharmaceutical composition is a tablet, a pill, a capsule, a liquid, an inhalant, a nasal spray solution, a suppository, a suspension, a gel, a colloid, a dispersion, a suspension, a solution, an emulsion, an ointment, a lotion, an eye drop or an ear drop.

In some embodiments, the present disclosure provides a pharmaceutical composition comprising chirally controlled oligonucleotide, or composition thereof, in admixture with a pharmaceutically acceptable excipient. One of skill in the art will recognize that the pharmaceutical compositions include the pharmaceutically acceptable salts of the chirally controlled oligonucleotide, or composition thereof, described above.

A variety of supramolecular nanocarriers can be used to deliver nucleic acids. Example nanocarriers include, but are not limited to liposomes, cationic polymer complexes and various polymeric. Complexation of nucleic acids with various polycations is another approach for intracellular delivery; this includes use of PEGlyated polycations, polyethyleneamine (PEI) complexes, cationic block co-polymers, and dendrimers. Several cationic nanocarriers, including PEI and polyamidoamine dendrimers help to release contents from endosomes. Other approaches include use of polymeric nanoparticles, microspheres, liposomes, dendrimers, biodegradable polymers, conjugates, prodrugs, inorganic colloids such as sulfur or iron, antibodies, implants, biodegradable implants, biodegradable microspheres, osmotically controlled implants, lipid nanoparticles, emulsions, oily solutions, aqueous solutions, biodegradable polymers, poly(lactide-coglycolic acid), poly(lactic acid), liquid depot, polymer micelles, quantum dots and lipoplexes. In some embodiments, an oligonucleotide is conjugated to another molecular.

Additional nucleic acid delivery strategies are known in addition to the example delivery strategies described herein.

In therapeutic and/or diagnostic applications, the compounds of the disclosure can be formulated for a variety of modes of administration, including systemic and topical or localized administration. Techniques and formulations generally may be found in Remington, The Science and Practice of Pharmacy, (20th ed. 2000).

Provided oligonucleotides, and compositions thereof, are effective over a wide dosage range. For example, in the treatment of adult humans, dosages from about 0.01 to about 1000 mg, from about 0.5 to about 100 mg, from about 1 to about 50 mg per day, and from about 5 to about 100 mg per day are examples of dosages that may be used. The exact dosage will depend upon the route of administration, the form in which the compound is administered, the subject to be treated, the body weight of the subject to be treated, and the preference and experience of the attending physician.

Pharmaceutically acceptable salts are generally well known to those of ordinary skill in the art, and may include, by way of example but not limitation, acetate, benzenesulfonate, besylate, benzoate, bicarbonate, bitartrate, bromide, calcium edetate, carnsylate, carbonate, citrate, edetate, edisylate, estolate, esylate, fumarate, gluceptate, gluconate, glutamate, glycollylarsanilate, hexylresorcinate, hydrabamine, hydrobromide, hydrochloride, hydroxynaphthoate, iodide, isethionate, lactate, lactobionate, malate, maleate, mandelate, mesylate, mucate, napsylate, nitrate, pamoate (embonate), pantothenate, phosphate/diphosphate, polygalacturonate, salicylate, stearate, subacetate, succinate, sulfate, tannate, tartrate, or teoclate. Other pharmaceutically acceptable salts may be found in, for example, Remington, The Science and Practice of Pharmacy (20th ed. 2000). Preferred pharmaceutically acceptable salts include, for example, acetate, benzoate, bromide, carbonate, citrate, gluconate, hydrobromide, hydrochloride, maleate, mesylate, napsylate, pamoate (embonate), phosphate, salicylate, succinate, sulfate, or tartrate.

In some embodiments, a provided single-stranded RNAi agent is formulated in a pharmaceutical composition described in U.S. Applications No. 61/774,759; 61/918,175, filed Dec. 19, 2013; 61/918,927; 61/918,182; 61/918,941; 62/025,224; 62/046,487; or International Applications No. PCT/US04/042911; PCT/EP2010/070412; or PCT/IB2014/059503.

Depending on the specific conditions being treated, such agents may be formulated into liquid or solid dosage forms and administered systemically or locally. The agents may be delivered, for example, in a timed- or sustained-low release form as is known to those skilled in the art. Techniques for formulation and administration may be found in Remington, The Science and Practice of Pharmacy (20th ed. 2000). Suitable routes may include oral, buccal, by inhalation spray, sublingual, rectal, transdermal, vaginal, transmucosal, nasal or intestinal administration; parenteral delivery, including intramuscular, subcutaneous, intramedullary injections, as well as intrathecal, direct intraventricular, intravenous, intra-articullar, intra-sternal, intra-synovial, intra-hepatic, intralesional, intracranial, intraperitoneal, intranasal, or intraocular injections or other modes of delivery.

For injection, the agents of the disclosure may be formulated and diluted in aqueous solutions, such as in physiologically compatible buffers such as Hank's solution, Ringer's solution, or physiological saline buffer. For such transmucosal administration, penetrants appropriate to the barrier to be permeated are used in the formulation. Such penetrants are generally known in the art.

Use of pharmaceutically acceptable inert carriers to formulate the compounds herein disclosed for the practice of the disclosure into dosages suitable for systemic administration is within the scope of the disclosure. With proper choice of carrier and suitable manufacturing practice, the compositions of the present disclosure, in particular, those formulated as solutions, may be administered parenterally, such as by intravenous injection.

The compounds can be formulated readily using pharmaceutically acceptable carriers well known in the art into dosages suitable for oral administration. Such carriers enable the compounds of the disclosure to be formulated as tablets, pills, capsules, liquids, gels, syrups, slurries, suspensions and the like, for oral ingestion by a subject (e.g., patient) to be treated.

For nasal or inhalation delivery, the agents of the disclosure may also be formulated by methods known to those of skill in the art, and may include, for example, but not limited to, examples of solubilizing, diluting, or dispersing substances such as, saline, preservatives, such as benzyl alcohol, absorption promoters, and fluorocarbons.

In certain embodiments, oligonucleotides and compositions are delivered to the CNS. In certain embodiments, oligonucleotides and compositions are delivered to the cerebrospinal fluid. In certain embodiments, oligonucleotides and compositions are administered to the brain parenchyma. In certain embodiments, oligonucleotides and compositions are delivered to an animal/subject by intrathecal administration, or intracerebroventricular administration. Broad distribution of oligonucleotides and compositions, described herein, within the central nervous system may be achieved with intraparenchymal administration, intrathecal administration, or intracerebroventricular administration.

In certain embodiments, parenteral administration is by injection, by, e.g., a syringe, a pump, etc. In certain embodiments, the injection is a bolus injection. In certain embodiments, the injection is administered directly to a tissue, such as striatum, caudate, cortex, hippocampus and cerebellum.

In certain embodiments, methods of specifically localizing a pharmaceutical agent, such as by bolus injection, decreases median effective concentration (EC50) by a factor of 20, 25, 30, 35, 40, 45 or 50. In certain embodiments, the pharmaceutical agent in an antisense compound as further described herein. In certain embodiments, the targeted tissue is brain tissue. In certain embodiments the targeted tissue is striatal tissue. In certain embodiments, decreasing EC50 is desirable because it reduces the dose required to achieve a pharmacological result in a patient in need thereof.

In certain embodiments, an antisense oligonucleotide is delivered by injection or infusion once every month, every two months, every 90 days, every 3 months, every 6 months, twice a year or once a year.

Pharmaceutical compositions suitable for use in the present disclosure include compositions wherein the active ingredients are contained in an effective amount to achieve its intended purpose. Determination of the effective amounts is well within the capability of those skilled in the art, especially in light of the detailed disclosure provided herein.

In addition to the active ingredients, these pharmaceutical compositions may contain suitable pharmaceutically acceptable carriers comprising excipients and auxiliaries which facilitate processing of an active compound into preparations which can be used pharmaceutically. The preparations formulated for oral administration may be in the form of tablets, dragees, capsules, or solutions.

Pharmaceutical preparations for oral use can be obtained by combining an active compound with solid excipients, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; cellulose preparations, for example, maize starch, wheat starch, rice starch, potato starch, gelatin, gum tragacanth, methyl cellulose, hydroxypropylmethyl-cellulose, sodium carboxymethyl-cellulose (CMC), and/or polyvinylpyrrolidone (PVP: povidone). If desired, disintegrating agents may be added, such as the cross-linked polyvinylpyrrolidone, agar, or alginic acid or a salt thereof such as sodium alginate.

Dragee cores are provided with suitable coatings. For this purpose, concentrated sugar solutions may be used, which may optionally contain gum arabic, talc, polyvinylpyrrolidone, carbopol gel, polyethylene glycol (PEG), and/or titanium dioxide, lacquer solutions, and suitable organic solvents or solvent mixtures. Dye-stuffs or pigments may be added to the tablets or dragee coatings for identification or to characterize different combinations of active compound doses.

Pharmaceutical preparations that can be used orally include push-fit capsules made of gelatin, as well as soft, sealed capsules made of gelatin, and a plasticizer, such as glycerol or sorbitol. The push-fit capsules can contain the active ingredients in admixture with filler such as lactose, binders such as starches, and/or lubricants such as talc or magnesium stearate and, optionally, stabilizers. In soft capsules, an active compound may be dissolved or suspended in suitable liquids, such as fatty oils, liquid paraffin, or liquid polyethylene glycols (PEGs). In addition, stabilizers may be added.

A composition can be obtained by combining an active compound with a lipid. In some embodiments, the lipid is conjugated to an active compound. In some embodiments, the lipid is not conjugated to an active compound. In some embodiments, a lipid comprises a $C_{10}$-$C_{40}$ linear, saturated or partially unsaturated, aliphatic chain. In some embodiments, a lipid comprises a $C_{10}$-$C_{40}$ linear, saturated or partially unsaturated, aliphatic chain, optionally substituted with one or more $C_{1-4}$ aliphatic group. In some embodiments, the lipid is selected from the group consisting of: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl. In some embodiments, a lipid has a structure of any of:

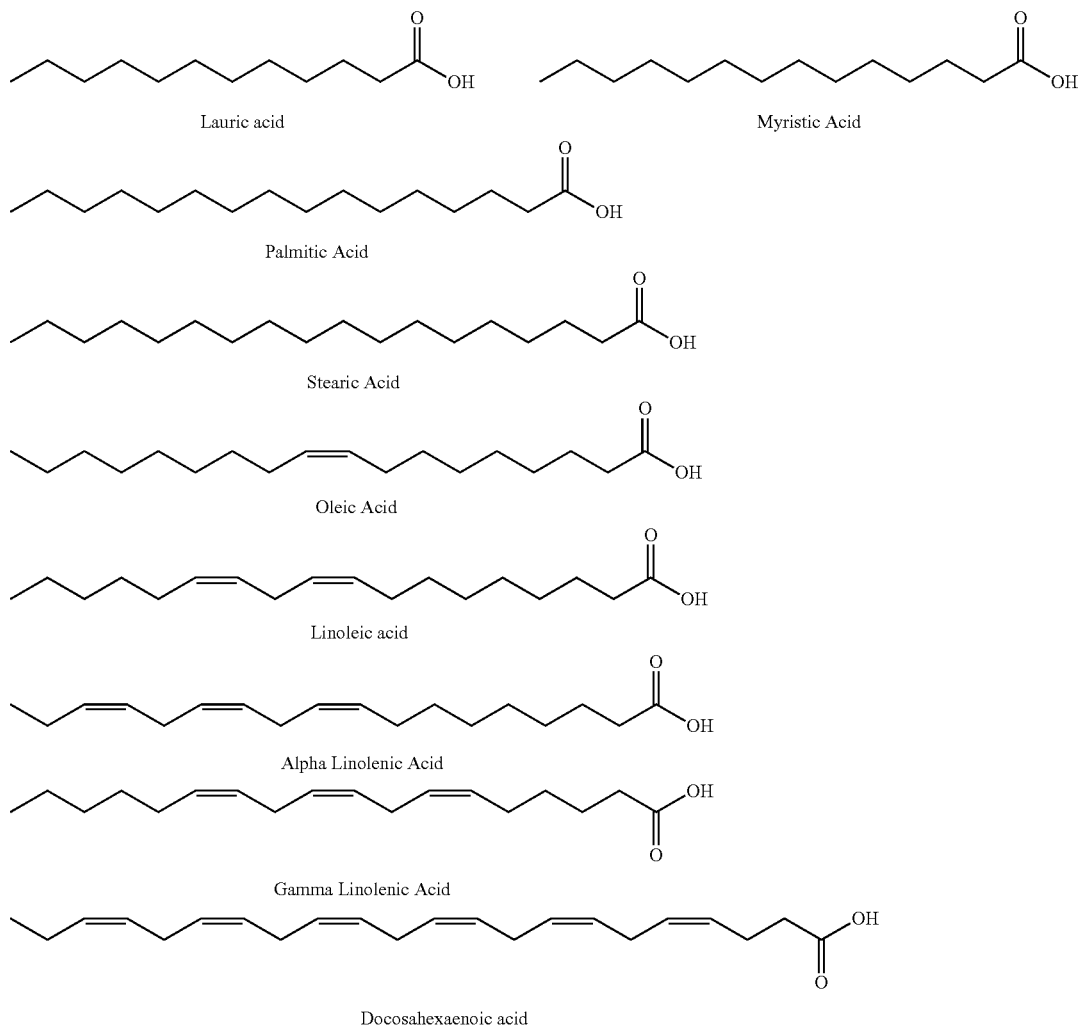

Lauric acid

Myristic Acid

Palmitic Acid

Stearic Acid

Oleic Acid

Linoleic acid

Alpha Linolenic Acid

Gamma Linolenic Acid

Docosahexaenoic acid

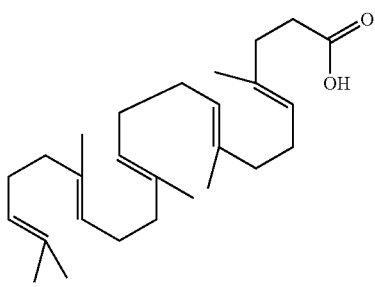

Turbinaric acid

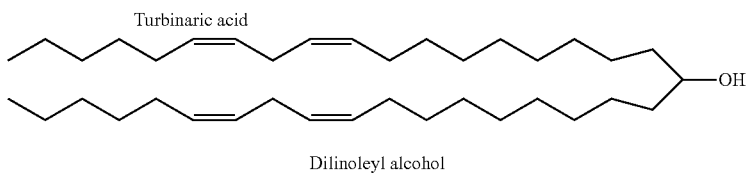

Dilinoleyl alcohol

In some embodiments, an active compound is any oligonucleotide or other nucleic acid described herein. In some embodiments, an active compound is a nucleic acid of a sequence comprising or consisting of any sequence of any nucleic acid listed in Table 1A. In some embodiments, a composition comprises a lipid and an an active compound, and further comprises another component selected from: another lipid, and a targeting compound or moiety. In some embodiments, a lipid includes, without limitation: an amino lipid; an amphipathic lipid; an anionic lipid; an apolipoprotein; a cationic lipid; a low molecular weight cationic lipid; a cationic lipid such as CLinDMA and DLinDMA; an ionizable cationic lipid; a cloaking component; a helper lipid; a lipopeptide; a neutral lipid; a neutral zwitterionic lipid; a hydrophobic small molecule; a hydrophobic vitamin; a PEG-lipid; an uncharged lipid modified with one or more hydrophilic polymers; phospholipid; a phospholipid such as 1,2-dioleoyl-sn-glycero-3-phosphoethanolamine; a stealth lipid; a sterol; a cholesterol; and a targeting lipid; and any other lipid described herein or reported in the art. In some embodiments, a composition comprises a lipid and a portion of another lipid capable of mediating at least one function of another lipid. In some embodiments, a targeting compound or moiety is capable of targeting a compound (e.g., a composition comprising a lipid and a active compound) to a particular cell or tissue or subset of cells or tissues. In some embodiments, a targeting moiety is designed to take advantage of cell- or tissue-specific expression of particular targets, receptors, proteins, or other subcellular components; In some embodiments, a targeting moiety is a ligand (e.g., a small molecule, antibody, peptide, protein, carbohydrate, aptamer, etc.) that targets a composition to a cell or tissue, and/or binds to a target, receptor, protein, or other subcellular component.

Certain example lipids for use in preparation of a composition for delivery of an active compound allow (e.g., do not prevent or interfere with) the function of an active compound. Non-limiting example lipids include: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl.

As described in the present disclosure, lipid conjugation, such as conjugation with fatty acids, may improve one or more properties of oligonucleotides.

In some embodiments, a composition for delivery of an active compound is capable of targeting an active compound to particular cells or tissues, as desired. In some embodiments, a composition for delivery of an active compound is capable of targeting an active compound to a muscle cell or tissue. In some embodiments, the present disclosure pertains to compositions and methods related to delivery of active compounds, wherein the compositions comprise an active compound a lipid. In various embodiments to a muscle cell or tissue, the lipid is selected from: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl. The example lipids used include stearic acid, oleic acid, alpha-linolenic acid, gamma-linolenic acids, cis-DHA, turbinaric acid and dilinoleyl acid. In these Tables, "TBD" indicates that the particular composition was effective for delivery, but the numerical results were outside the standard range, and thus the final results remain to be determined; however, the compositions indicated as "TBD" in the Tables were efficacious at delivery of an active compound.

A composition comprising an active compound and any of: stearic acid, oleic acid, alpha-linolenic acid, gamma-linolenic acid, cis-DHA or turbinaric acid, was able to deliver an active compound to gastrocnemius muscle tissue. A composition comprising an active compound and any of: stearic acid, alpha-linolenic, gamma-linolenic, cis-DHA, or turbinaric acid, was able to deliver an active compound to heart muscle tissue. A composition comprising an active compound and any of: stearic acid, oleic acid, alpha-linolenic acid, gamma-linolenic acid, cis-DHA or turbinaric acid, was able to deliver an active compound to quadriceps muscle tissue. A composition comprising an active compound and any of: stearic, oleic, alpha-linolenic, gamma-linolenic, cis-DHA, or turbinaric acid was able to deliver an active compound to the gastrocnemius muscle tissue. A composition comprising an active compound and any of: stearic acid, alpha-linolenic, gamma-linolenic, cis-DHA, or turbinaric acid was able to deliver an active compound to heart muscle tissue. A composition comprising an active compound and any of: dilinoleyl, stearic acid, oleic acid, alpha-linolenic, gamma-linolenic, cis-DHA or turbinaric acid was able to delivery an active compound to the diaphragm muscle tissue.

Thus: A composition comprising a lipid, selected from: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl, and an active compound is capable of delivering an active compound to extra-hepatic cells and tissues, e.g., muscle cells and tissues.

Depending upon the particular condition, or disease state, to be treated or prevented, additional therapeutic agents, which are normally administered to treat or prevent that condition, may be administered together with oligonucleotides of this disclosure. For example, chemotherapeutic agents or other anti-proliferative agents may be combined with the oligonucleotides of this disclosure to treat proliferative diseases and cancer. Examples of known chemotherapeutic agents include, but are not limited to, adriamycin, dexamethasone, vincristine, cyclophosphamide, fluorouracil, topotecan, taxol, interferons, and platinum derivatives.

Example Uses

In some embodiments, the present disclosure encompasses the use of a composition comprising a lipid and an oligonucleotide or a single-stranded RNAi agent. In some embodiments, the present disclosure provides methods for delivering an oligonucleotide or a single-stranded RNAi agent to a target location comprising administering a provided composition. In some embodiments, a provided method delivers an oligonucleotide or a single-stranded RNAi agent into a cell. In some embodiments, a provided method delivers an oligonucleotide or a single-stranded RNAi agent into a muscle cell. In some embodiments, a provided method delivers an oligonucleotide or a single-stranded RNAi agent into a cell within a tissue. In some embodiments, a provided method delivers an oligonucleotide or a single-stranded RNAi agent into a cell within an organ. In some embodiments, a provided method delivers an oligonucleotide or a single-stranded RNAi agent into a cell within a subject, comprising administering to the subject a provided composition. In some embodiments, a provided method delivers an oligonucleotide or a single-stranded RNAi agent into cytoplasm. In some embodiments, a provided method delivers an oligonucleotide or a single-stranded RNAi agent into nucleus.

In some embodiments, the present disclosure pertains to methods related to the delivery of an oligonucleotide or a single-stranded RNAi agent to a cell or tissue, or a cell or tissue in a mammal (e.g., a human subject), which method pertains to a use of a composition comprising a biological agent and a lipid. any one or more additional components selected from: a polynucleotide, a dye, an intercalating agent (e.g. an acridine), a cross-linker (e.g. psoralene, or mitomycin C), a porphyrin (e.g., TPPC4, texaphyrin, or Sapphyrin), a polycyclic aromatic hydrocarbon (e.g., phenazine, or dihydrophenazine), an artificial endonuclease, a chelating agent, EDTA, an alkylating agent, a phosphate, an amino, a mercapto, a PEG (e.g., PEG-40K), MPEG, [MPEG]2, a polyamino, an alkyl, a substituted alkyl, a radiolabeled marker, an enzyme, a hapten (e.g. biotin), a transport/absorption facilitator (e.g., aspirin, vitamin E, or folic acid), a synthetic ribonuclease, a protein, e.g., a glycoprotein, or peptide, e.g., a molecule having a specific affinity for a co-ligand, or antibody e.g., an antibody, a hormone, a hormone receptor, a non-peptidic species, a lipid, a lectin, a carbohydrate, a vitamin, a cofactor, or a drug. In some embodiments, the present disclosure pertains to compositions or methods related to a composition comprising an oligonucleotide or a single-stranded RNAi agent and a lipid comprising a $C_{10}$-$C_{60}$ linear, saturated or partially unsaturated, aliphatic chain. In some embodiments, the present disclosure pertains to compositions or methods related to a composition comprising an oligonucleotide or a single-stranded RNAi agent and a lipid comprising a $C_{10}$-$C_{60}$ linear, saturated or partially unsaturated, aliphatic chain, optionally substituted with one or more $C_{1-4}$ aliphatic group. In some embodiments, the present disclosure provides chirally controlled oligonucleotide compositions and a lipid selected from the group consisting of: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl, wherein the composition is suitable for delivery of the oligonucleotide to a muscle cell or tissue, or a muscle cell or tissue in a mammal (e.g., a human subject). In some embodiments, an oligonucleotide or a single-stranded RNAi agent is an oligonucleotide comprising one or more chiral internucleotidic linkages, and a provided composition is an oligonucleotide or a single-stranded RNAi agent. In some embodiments, an oligonucleotide or a single-stranded RNAi agent is an oligonucleotide comprising one or more chiral internucleotidic linkages, and a provided composition is a non-chirally controlled oligonucleotide composition of the oligonucleotide.

In some embodiments, the present disclosure pertains to a method of delivering an oligonucleotide or a single-stranded RNAi agent to a cell or tissue, wherein the method comprises steps of: providing a composition comprising an oligonucleotide or a single-stranded RNAi agent and a lipid; and contacting the cell or tissue with the composition; in some embodiments, the present disclosure pertains to a method of administering an oligonucleotide or a single-stranded RNAi agent to a subject, wherein the method comprises steps of: providing a composition comprising an oligonucleotide or a single-stranded RNAi agent and a lipid; and administering the composition to the subject. In some embodiments, a lipid comprises a $C_{10}$-$C_{60}$ linear, saturated or partially unsaturated, aliphatic chain. In some embodiments, a lipid comprises a $C_{10}$-$C_{60}$ linear, saturated or partially unsaturated, aliphatic chain, optionally substituted with one or more $C_{1-4}$ aliphatic group. In some embodiments, the lipid is selected from the group consisting of: lauric acid, myristic acid, palmitic acid, stearic acid, oleic acid, linoleic acid, alpha-linolenic acid, gamma-linolenic acid, docosahexaenoic acid (cis-DHA), turbinaric acid and dilinoleyl.

In some embodiments, an oligonucleotide or a single-stranded RNAi agent is an oligonucleotide, whose sequence is or comprises an element that is substantially complementary to a targeted element in a cellular nucleic acid. In some embodiments, a targeted element is or comprises a sequence element that is associated with a muscle disease, disorder or condition. In some embodiments, a muscle disease, disorder or condition is DMD. In some embodiments, a cellular nucleic acid is or comprises a transcript. In some embodiments, a cellular nucleic acid is or comprises a primary transcript. In some embodiments, a cellular nucleic acid is or comprises a genomic nucleic acid. The present disclosure encompasses the recognition that certain lipids and other compounds are useful for delivery of single-stranded RNAi agents to cells and tissues, e.g., in a mammal or human subject. Many technologies for delivering such agents can suffer from an inability to target desired cells or tissues.

Delivery of single-stranded RNAi agents to tissues outside the liver remains difficult. Juliano reported that, despite advances at the clinical level, effective delivery of oligonucleotides in vivo remains a major challenge, especially at extra-hepatic sites. Juliano 2016 Nucl. Acids Res. Doi: 10.1093/nar/gkw236. Lou also reported that delivery of RNAi agent to organs beyond the liver remains the biggest hurdle to using the technology for a host of diseases. Lou 2014 SciBX 7(48); doi:10.1038/scibx.2014.1394.

The present disclosure encompasses certain surprising findings, including that certain lipids and other compounds are particularly effective at delivering single-stranded RNAi agents, including oligonucleotides, to particular cells and tissues, including cells and tissues outside the liver, including, as non-limiting examples, muscle cells and tissues.

In some embodiments, provided compositions alter single-stranded RNA interference system so that an undesired target and/or biological function are suppressed. In some embodiments, in such cases provided composition can also induce cleavage of the transcript after hybridization.

In some embodiments, provided compositions alter single-stranded RNA interference system so a desired target and/or biological function is enhanced. In some embodiments, provided compositions, by incorporating chemical modifications, stereochemistry and/or combinations thereof, effectively suppress or prevent cleavage of a target transcript after contact.

In some embodiments, each oligonucleotide of a plurality comprises one or more modified sugar moieties and modified internucleotidic linkages. In some embodiments, each oligonucleotide of a plurality comprises two or more modified sugar moieties. In some embodiments, each oligonucleotide of a plurality comprises three or more modified sugar moieties. In some embodiments, each oligonucleotide of a plurality comprises four or more modified sugar moieties. In some embodiments, each oligonucleotide of a plurality comprises five or more modified sugar moieties. In some embodiments, each oligonucleotide of a plurality comprises ten or more modified sugar moieties. In some embodiments, each oligonucleotide of a plurality comprises about 15 or more modified sugar moieties. In some embodiments, each oligonucleotide of a plurality comprises about 20 or more modified sugar moieties. In some embodiments, each oligonucleotide of a plurality comprises about 25 or more modified sugar moieties.

Stereopure APOC3 ASOs were generated using proprietary technology that enables precise control of stereochemistry. Stereorandom and stereopure APOC3 ASOs were tested in vitro and in vivo. In vitro potency of APOC3 ASOs was measured using Hep3B human hepatocytes. In vivo activity of GalNAc-conjugated APOC3 ASOs was measured using mice harbouring the human APOC3 transgene. Mice were dosed s.c. with APOC3 ASOs, and liver APOC3 mRNA levels were measured by qPCR, and serum hApoC-III protein levels were measured by ELISA. ASO liver exposure was measured by hybridization ELISA.

Results:

Stereopure and stereorandom ASOs had similar in vitro potencies. Both stereorandom and stereopure GalNAc-conjugated APOC3 ASOs demonstrated >90% knockdown of serum hApoC-III in vivo at one week after treatment in human APOC3 transgenic mice. However, treatment with stereopure ASOs extended the duration of effect by 4 weeks compared to treatment with stereorandom ASOs. A dose response study of these ASOs in human APOC3 transgenic mice demonstrated a dose-response relationship for all three ASOs. The stereopure ASO was significantly more active than the stereorandom ASOs at the 1 mg/kg dose. At this dose, stereorandom ASOs showed ~45% reduction of liver mRNA and 70% reduction of serum hApoC-III protein, while the stereopure ASO showed 75% reduction of mRNA and 90% reduction of serum hApoC-III protein. ASO liver exposure demonstrated a PK/PD correlation for stereorandom and stereopure ASOs. Furthermore, liver exposure of stereopure ASOs was up to 4.5-fold greater than stereorandom ASOs Stereopure APOC3 ASOs were generated in which the stereochemistry of the phosphorothioate backbone was precisely controlled. Stereorandom and stereopure APOC3 ASOs were tested in vitro and in vivo. In vitro potency of APOC3 ASOs was measured using Hep3B human hepatocytes. Results showed that stereopure ASOs, optimized through stereopure design principles, had similar in vitro potencies of the chemically matched stereorandom ASOs. In vivo activity of GalNAc-conjugated APOC3 ASOs was measured using mice harbouring the human APOC3 (hAPOC3) transgene. Mice were dosed subcutaneously with APOC3 ASOs, and liver APOC3 mRNA levels were measured by qPCR, and serum hApoC-III protein levels were measured by ELISA. ASO liver exposure was measured by hybridization ELISA. Both stereopure and stereorandom GalNAc-conjugated APOC3 ASOs demonstrated >90% knockdown of serum hApoC-III in vivo at one week after treatment in human APOC3 transgenic mice. However, treatment with the optimized stereopure ASOs extended the duration of effect by 4 weeks compared with stereorandom ASOs. A dose-response study of these ASOs in human APOC3 transgenic mice demonstrated a dose-dependent relationship for all three ASOs. The stereopure ASO was significantly more active than the stereorandom ASOs at the 1 mg/kg dose. At this dose, stereorandom ASOs showed ~45% reduction of liver mRNA and 70% reduction of serum hApoC-III protein, while the stereopure ASO showed 75% reduction of mRNA and 90% reduction of serum hApoC-III protein. ASO liver exposure demonstrated a PK/PD correlation for stereorandom and stereopure ASOs. Furthermore, liver exposure of stereopure ASOs was up to 4.5-fold greater than stereorandom ASOs.

Results of these studies suggest that control of stereochemistry increases both the duration and the potency of APOC3 ASOs, thereby potentially enhancing the pharmacological properties of ASOs for APOC3 targeting in the clinic.

Oligonucleotide therapeutics need to reach tissues of interest in sufficient quantity to modulate their specific gene targets. With Wave's proprietary chemistry platform, which allows for the precise design and control of the stereochemistry of oligonucleotides, we have evaluated how chirality influences the spectrum of antisense oligonucleotide (ASO) properties ranging from RNaseH activity, stability, immune activation, and tissue distribution. Using phenotypic assays in relevant human cell models mediated by gymnosis (ie, free uptake by cells without transfection agents), we screened for stereopure ASO compounds with target modulation. With chemistry and stereochemical control optimized, we were able to improve the potency and efficacy of ASOs in vitro. These lead molecules were then evaluated in appropriate animal models where human gene targets were expressed. Data was obtained from a discovery program targeting qPOC3 in hepatocytes. Emerging evidence suggests that stereopure ASOs selected on the basis of gymnotic assay conditions also have better target efficacy in vivo, and this approach may offer a more stringent discovery filter for clinical candidates.

EXAMPLE EMBODIMENTS

Among other things, the present disclosure provides the following Example Embodiments:

1. A composition comprising an oligonucleotide which is a single-stranded RNAi agent, wherein the single-stranded RNAi agent is complementary or substantially complementary to a target RNA sequence,
   has a length of about 15 to about 49 nucleotides, and
   is capable of directing target-specific RNA interference,
   wherein the single-stranded RNAi agent comprises at least one non-natural base, sugar, and/or internucleotidic linkage.
2. The composition of embodiment 1, wherein the single-stranded RNAi agent has a length of 15 to 49 nucleotides.
3. The composition of embodiment 1, wherein the single-stranded RNAi agent has a length of 17 to 25 nucleotides.
4. The composition of embodiment 1, wherein the single-stranded RNAi agent has a length of 19 to 23 nucleotides.
5. A composition comprising a single-stranded oligonucleotide, which oligonucleotide comprises:
   a) an element of consecutive nucleotides, each of which independently comprises a 2'-substituent.
6. The composition of embodiment 5, wherein the single-stranded oligonucleotide has a length of 15 to 49 nucleotides.
7. The composition of embodiment 5, wherein the single-stranded oligonucleotide has a length of 17 to 25 nucleotides.
8. The composition of embodiment 5, wherein the single-stranded oligonucleotide has a length of 19 to 23 nucleotides.
9. A chirally controlled oligonucleotide composition comprising oligonucleotides of a particular oligonucleotide type characterized by:
   a) a common base sequence and length, wherein the base sequence is complementary to a target gene;
   b) a common pattern of backbone linkages;
   c) a common pattern of backbone chiral centers;
   which composition is chirally controlled in that it is enriched, relative to a substantially racemic preparation of oligonucleotides having the same common base sequence and length, for oligonucleotides of the particular oligonucleotide type; and
   wherein the oligonucleotides comprise an element of consecutive nucleotides, each of which independently comprises a 2'-substituent.
10. A chirally controlled oligonucleotide composition comprising oligonucleotides of a particular oligonucleotide type characterized by:
    a) a common base sequence and length;
    b) a common pattern of backbone linkages;
    c) a common pattern of backbone chiral centers;
    which composition is chirally controlled in that it is enriched, relative to a substantially racemic preparation of oligonucleotides having the same common base sequence and length, for oligonucleotides of the particular oligonucleotide type; and
    wherein the oligonucleotides are complementary or substantially complementary to a target RNA sequence;
    have a length of about 15 to about 49 nucleotides; and
    are capable of directing target-specific RNA interference.
11. The composition of embodiment 10, wherein the oligonucleotides have a length of 15 to 49 nucleotides.
12. The composition of embodiment 10, wherein the oligonucleotides have a length of 17 to 25 nucleotides.
13. The composition of embodiment 10, wherein the oligonucleotides have a length of 19 to 23 nucleotides.
14. A composition comprising an oligonucleotide which is a single-stranded RNAi agent,
    wherein the single-stranded RNAi agent is complementary or substantially complementary to a target RNA sequence,
    has a length of about 15 to about 49 nucleotides,
    wherein the length includes a span of at least about 10 consecutive nucleotides which have a pattern of 2'-modifications of abababab, wherein a represents a first type of 2'-modification and b represents a second type of 2'-modification, wherein each first type can be the same or different, and each second type can be the same or different, and each first type is different from each second type,
    and wherein the single-stranded RNAi agent is capable of directing target-specific RNA interference.
15. The composition of embodiment 14, wherein the single-stranded RNAi agent has a length of 15 to 49 nucleotides.
16. The composition of embodiment 14, wherein the single-stranded RNAi agent has a length of 17 to 25 nucleotides.
17. The composition of embodiment 14, wherein the single-stranded RNAi agent has a length of 19 to 23 nucleotides.
18. The composition of any of embodiments 14 to 17, wherein the length includes a span of at least about 12 consecutive nucleotides which have a pattern of 2' modifications of ababababab, wherein a represents a first type of 2'-modification and b represents a second type of 2'-modification, wherein each first type can be the same or different, and each second type can be the same or different, and each first type is different from each second type.
19. The composition of any of embodiments 14 to 18, wherein the length includes a span of at least about 14 consecutive nucleotides which have a pattern of 2' modifications of abababababab, wherein a represents a first type of 2'-modification and b represents a second type of 2'-modification, wherein each first type can be the same or different, and each second type can be the same or different, and each first type is different from each second type.
20. The composition of any of the preceding embodiments, wherein the oligonucleotide comprises at least one internucleotidic linkage wherein the linkage phosphorus is in the Sp configuration.
21. The composition of any of the preceding embodiments, wherein the oligonucleotide comprises at least one internucleotidic linkage wherein the linkage phosphorus is in the Rp configuration.
22. The composition of any of the preceding embodiments, wherein the oligonucleotide comprises comprise at least one phosphorothioate.
23. The composition of any of the preceding embodiments, wherein the oligonucleotide comprises at least one phosphorothioate in the Sp configuration.
24. The composition of any of the preceding embodiments, wherein the oligonucleotide comprises at least one phosphorothioate in the Rp configuration.
25. The composition of any of the preceding embodiments, wherein the first nucleotide comprising an optionally substituted pyrimidine nucleobase from the 5'-end of the oligonucleotide comprises a chiral internucleotidic linkage connecting it with the next nucleotide.
26. The composition of any of the preceding embodiments, wherein the first nucleotide comprising a pyrimidine nucleobase from the 5'-end of the oligonucleotide comprises a Sp chiral internucleotidic linkage connecting it with the next nucleotide.

27. The composition of any of the preceding embodiments, wherein the first nucleotide comprising a pyrimidine nucleobase from the 5'-end of the oligonucleotide comprises a Rp chiral internucleotidic linkage connecting it with the next nucleotide.
28. The composition of any of the preceding embodiments, wherein the first nucleotide comprising a pyrimidine nucleobase from the 5'-end of the oligonucleotide comprises a phosphorothioate connecting it with the next nucleotide. The composition of any of the preceding embodiments, wherein the next nucleotide comprises a pyrimidine nucleobase.
29. The composition of any of the preceding embodiments, wherein the oligonucleotide comprises at least one chiral internucleotidic linkage immediately 5' to a nucleotide comprising a pyrimidine nucleobase.
30. The composition of any of the preceding embodiments, wherein the oligonucleotide comprises at least one Sp chiral internucleotidic linkage immediately 5' to a nucleotide comprising a pyrimidine nucleobase.
31. The composition of any of the preceding embodiments, wherein the oligonucleotide comprises at least one Rp chiral internucleotidic linkage immediately 5' to a nucleotide comprising a pyrimidine nucleobase.
32. The composition of any of the preceding embodiments, wherein the oligonucleotide comprises at least one phosphorothioate immediately 5' to a nucleotide comprising a pyrimidine nucleobase.
33. The composition of any of the preceding embodiments, wherein a pyrimidine nucleobase is optionally substituted

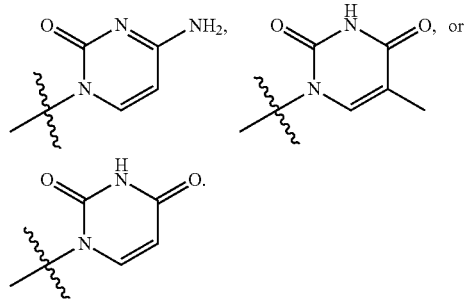

34. The composition of any of the preceding embodiments, wherein a pyrimidine nucleobase is

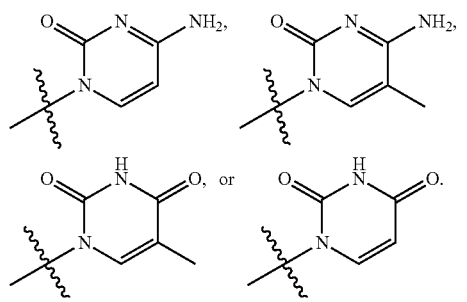

35. The composition of any of the preceding embodiments, wherein the 5' internucleotidic linkage of the oligonucleotides is an chiral internucleotidic linkage.
36. The composition of any of the preceding embodiments, wherein the 5' internucleotidic linkage of the oligonucleotide is an internucleotidic linkage comprising a Sp linkage phosphorus.
37. The composition of any of the preceding embodiments, wherein the 5' internucleotidic linkage of the oligonucleotide is an internucleotidic linkage comprising a Rp linkage phosphorus.
38. The composition of any of the preceding embodiments, wherein the 5' internucleotidic linkage is a phosphorothioate.
39. The composition of any of the preceding embodiments, wherein the 3' internucleotidic linkage of the oligonucleotide is a chiral internucleotidic linkage. The composition of any of the preceding embodiments, wherein the 3' internucleotidic linkage of the oligonucleotide is a chiral internucleotidic linkage comprising a Sp linkage phosphorus.
40. The composition of any of the preceding embodiments, wherein the 3' internucleotidic linkage of the oligonucleotide is a chiral internucleotidic linkage comprising a Sp linkage phosphorus.
41. The composition of any of the preceding embodiments, wherein the 3' internucleotidic linkage of the oligonucleotide is a phosphorothioate.
42. The composition of any of the preceding embodiments, wherein the pattern of backbone chiral centers comprises $S_LS_LS_LS_LS_LS_L$, wherein each $S_L$ independently represents a chiral internucleotidic linkage comprising a chiral center in S configuration.
43. The composition of any of the preceding embodiments, wherein the pattern of backbone chiral centers comprises $S_LS_LS_LS_LS_LS_LS_L$.
44. The composition of any of the preceding embodiments, wherein the pattern of backbone chiral centers comprises $S_LS_LS_LS_LS_LS_LS_LS_L$.
45. The composition of any of the preceding embodiments, wherein the pattern of backbone chiral centers comprises $S_LS_LS_LS_LS_LS_LS_LS_LS_L$.
46. The composition of any of the preceding embodiments, wherein the pattern of backbone chiral centers comprises $S_LA_LS_LA_L$, wherein each AL independently represents an achiral internucleotidic linkage.
47. The composition of any of the preceding embodiments, wherein the pattern of backbone chiral centers comprises $S_LA_LS_LA_LS_L$.
48. The composition of any of the preceding embodiments, wherein the pattern of backbone chiral centers comprises $S_LS_LS_LA_LS_LA_LS_LS_LS_L$.
49. The composition of any of the preceding embodiments, wherein the pattern of backbone chiral centers comprises $S_LS_LS_LS_LA_LS_LA_LS_LS_LS_LS_L$.
50. The composition of any of the preceding embodiments, wherein the pattern of backbone chiral centers comprises $A_LS_LA_LS_LA_L$.
51. The composition of any of the preceding embodiments, wherein the pattern of backbone chiral centers comprises $S_LA_LS_LA_LS_LA_L$.
52. The composition of any of the preceding embodiments, wherein the pattern of backbone chiral centers comprises $S_LA_LS_LA_LS_LA_LA_L$.
53. The composition of any of the preceding embodiments, wherein the pattern of backbone chiral centers comprises $A_LS_LS_LS_LA_L$.
54. The composition of any of the preceding embodiments, wherein the pattern of backbone chiral centers comprises $S_LA_LS_LS_LS_LA_L$.
55. The composition of any of the preceding embodiments, wherein the pattern of backbone chiral centers comprises $A_LS_LS_LS_LA_LS_L$.

56. The composition of any of the preceding embodiments, wherein the pattern of backbone chiral centers comprises $S_L S_L A_L S_L S_L A_L S_L SL$.

57. The composition of any of the preceding embodiments, wherein the pattern of backbone chiral centers comprises $R_L$, wherein each $R_L$ independently represents a chiral internucleotidic linkage comprising a chiral center in R configuration.

58. The composition of any of the preceding embodiments, wherein the pattern of backbone chiral centers comprises $R_L R_L R_L$, wherein each $R_L$ independently represents a chiral internucleotidic linkage comprising a chiral center in R configuration.

59. The composition of any of the preceding embodiments, wherein the pattern of backbone chiral centers comprises SpSpSpSpSp, wherein each Sp independently represents a chiral internucleotidic linkage comprising a Sp linkage phosphorus.

60. The composition of any of the preceding embodiments, wherein the pattern of backbone chiral centers comprises SpSpSpSpSpSp, wherein each Sp independently represents a chiral internucleotidic linkage comprising a Sp linkage phosphorus.

61. The composition of any of the preceding embodiments, wherein the pattern of backbone chiral centers comprises SpSpSpSpSpSpSp, wherein each Sp independently represents a chiral internucleotidic linkage comprising a Sp linkage phosphorus.

62. The composition of any of the preceding embodiments, wherein the pattern of backbone chiral centers comprises SpSpSpSpSpSpSpSp, wherein each Sp independently represents a chiral internucleotidic linkage comprising a Sp linkage phosphorus.

63. The composition of any of the preceding embodiments, wherein the pattern of backbone chiral centers comprises SpSpSpSpSpSpSpSpSp, wherein each Sp independently represents a chiral internucleotidic linkage comprising a Sp linkage phosphorus.

64. The composition of any of the preceding embodiments, wherein the pattern of backbone chiral centers comprises SpOSpO, wherein each Sp independently represents a chiral internucleotidic linkage comprising a Sp linkage phosphorus, and O represents a natural phosphodiester linkage.

65. The composition of any of the preceding embodiments, wherein the pattern of backbone chiral centers comprises SpOSpOSp, wherein each Sp independently represents a chiral internucleotidic linkage comprising a Sp linkage phosphorus, and O represents a natural phosphodiester linkage.

66. The composition of any of the preceding embodiments, wherein the pattern of backbone chiral centers comprises SpSpSpOSpOSpSpSp, wherein each Sp independently represents a chiral internucleotidic linkage comprising a Sp linkage phosphorus, and O represents a natural phosphodiester linkage. The composition of any of the preceding embodiments, wherein the pattern of backbone chiral centers comprises SpSpSpSpOSpOSpSpSpSp, wherein each Sp independently represents a chiral internucleotidic linkage comprising a Sp linkage phosphorus, and O represents a natural phosphodiester linkage.

67. The composition of any of the preceding embodiments, wherein the pattern of backbone chiral centers comprises OSpOSpO, wherein each Sp independently represents a chiral internucleotidic linkage comprising a Sp linkage phosphorus, and O represents a natural phosphodiester linkage.

68. The composition of any of the preceding embodiments, wherein the pattern of backbone chiral centers comprises SpOSpOSpO, wherein each Sp independently represents a chiral internucleotidic linkage comprising a Sp linkage phosphorus, and O represents a natural phosphodiester linkage.

69. The composition of any of the preceding embodiments, wherein the pattern of backbone chiral centers comprises SpOSpOSpOSpO, wherein each Sp independently represents a chiral internucleotidic linkage comprising a Sp linkage phosphorus, and O represents a natural phosphodiester linkage.

70. The composition of any of the preceding embodiments, wherein the pattern of backbone chiral centers comprises OSpSpSpO, wherein each Sp independently represents a chiral internucleotidic linkage comprising a Sp linkage phosphorus, and O represents a natural phosphodiester linkage.

71. The composition of any of the preceding embodiments, wherein the pattern of backbone chiral centers comprises SpOSpSpSpO, wherein each Sp independently represents a chiral internucleotidic linkage comprising a Sp linkage phosphorus, and O represents a natural phosphodiester linkage.

72. The composition of any of the preceding embodiments, wherein the pattern of backbone chiral centers comprises OSpSpSpOSp, wherein each Sp independently represents a chiral internucleotidic linkage comprising a Sp linkage phosphorus, and O represents a natural phosphodiester linkage.

73. The composition of any of the preceding embodiments, wherein the pattern of backbone chiral centers comprises SpSpOSpSpSpOSpSp, wherein each Sp independently represents a chiral internucleotidic linkage comprising a Sp linkage phosphorus, and O represents a natural phosphodiester linkage.

74. The composition of any of the preceding embodiments, wherein the pattern of backbone chiral centers comprises Rp, wherein each Rp independently represents a chiral internucleotidic linkage comprising a Rp linkage phosphorus.

75. The composition of any of the preceding embodiments, wherein the pattern of backbone chiral centers comprises RpRpRp, wherein each Rp independently represents a chiral internucleotidic linkage comprising a Rp linkage phosphorus.

76. The composition of any one of embodiments 59-75, wherein a chiral internucleotidic linkage is a phosphorothioate diester linkage.

77. A composition comprising an oligonucleotide, which oligonucleotide comprises an element of consecutive nucleotidic units, wherein at least 50%, 55%, 60%, 65%, 70%, 75%, 80%, 85%, 90%, or 95% of the nucleotidic units of the element independently comprise a 2'-substitution.

78. An oligonucleotide composition comprising a first plurality of oligonucleotides which share:
  1) a common base sequence;
  2) a common pattern of backbone linkages;
  3) common stereochemistry independently at one or more chiral internucleotidic linkages (chirally controlled internucleotidic linkages);
which composition is chirally controlled in that level of the first plurality of oligonucleotides in the composition is predetermined.

79. The composition of embodiment 78, wherein the oligonucleotides comprise an element of consecutive nucleotidic units, wherein 10%-100% of the nucleotidic units of the element independently comprise a 2'-substitution.

80. The composition of embodiment 78, wherein a predetermined level is a percentage of 1%-100% of all oligonucleotides in the composition.

81. The composition of any one of embodiments 78-79, wherein a predetermined level is a percentage of 1%400% of all oligonucleotides in the composition that share the common base sequence.

82. The composition of any one of embodiments 78-80, wherein a predetermined level is a percentage of 1%-100% of all oligonucleotides in the composition that share the common base sequence, the common pattern of base modification, the common pattern of sugar modification, and the common pattern of modified internucleotidic linkages.

83. The composition of any one of embodiments 78-82, wherein the percentage is at least 1%.

84. The composition of any one of embodiments 78-82, wherein the percentage is at least 5%.

85. The composition of any one of embodiments 78-82, wherein the percentage is at least 10%.

86. The composition of any one of embodiments 78-82, wherein the percentage is $(90\%)^{11}$-100%, wherein n is the number of chirally controlled internucleotidic linkages.

87. The composition of any one of embodiments 78-86, wherein the percentage is at least $(91\%)^n$, $(92\%)^n$, $(93\%)^n$, $(94\%)^n$, $(95\%)^n$, $(96\%)^n$, $(97\%)^n$, $(98\%)^n$, or $(99\%)^n$.

88. The composition of any one of embodiments 78-86, wherein the percentage is at least $(92\%)^{11}$.

89. The composition of any one of embodiments 78-86, wherein the percentage is at least $(95\%)^{11}$.

90. The composition of any one of embodiments 78-86, wherein the percentage is at least $(97\%)^{11}$.

91. The composition of any one of embodiments 78-86, wherein the percentage is at least $(98\%)^{11}$.

92. The composition of any one of embodiments 86-91, wherein n is at least 1, 2, 3, 4, 5, 6, 7, 8, 9, 10, 11, 12, 13, 14, 15, 16, 17, 18, 19 or 20.

93. The composition of embodiment 92, wherein n is no more than 25, 30, 40 or 50.

94. The composition of embodiment 92 or 93, wherein n is at least 5.

95. The composition of embodiment 92 or 93, wherein n is at least 10.

96. The composition of embodiment 92 or 93, wherein n is at least 15.

97. The composition of embodiment 92 or 93, wherein n is at least 18.

98. The composition of any one of embodiments 87-97, wherein product of diastereopurity of each of the chirally controlled internucleotidic linkages is utilized as the level, wherein diastereopurity of each chirally controlled internucleotidic linkage is represented by diastereopurity of a dimer comprising the same internucleotidic linkage and 5'- and 3'-nucleosides flanking the internucleotidic linkage and prepared under comparable methods as the oligonucleotides, which comparable methods comprise the same oligonucleotide preparation cycles that include identical reagents and reaction conditions for the dimer as for the chirally controlled internucleotidic linkage in the oligonucleotides.

99. The composition of any one of embodiments 78-98, all oligonucleotides in the composition that share a common base sequence, a common pattern of base modification, a common pattern of sugar modification, and/or a common pattern of modified internucleotidic linkages are at least 1%, 5%, 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% of all oligonucleotides in the composition.

100. The composition of any one of embodiments 78-99, all oligonucleotides in the composition that share a common base sequence, a common pattern of base modification, a common pattern of sugar modification, and/or a common pattern of modified internucleotidic linkages are at least 90% of all oligonucleotides in the composition.

101. The composition of any one of embodiments 78-99, all oligonucleotides in the composition that share a common base sequence, a common pattern of base modification, a common pattern of sugar modification, and/or a common pattern of modified internucleotidic linkages are at least 1%, 5%, 10%, 15%, 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% of all oligonucleotides in the composition.

102. The composition of any one of embodiments 78-101, all oligonucleotides in the composition that share a common base sequence, a common pattern of base modification, a common pattern of sugar modification, and/or a common pattern of modified internucleotidic linkages are at least 90% of all oligonucleotides in the composition.

103. A chirally controlled oligonucleotide composition comprising oligonucleotides which have:
a) a common base sequence and length;
b) a common pattern of backbone linkages, which comprises at least one chiral internucleotidic linkage comprising a chiral linkage phosphorus;
which composition is chirally controlled in that the composition is enriched, relative to a substantially racemic preparation of oligonucleotides having the same common base sequence and length and the same common pattern of backbone linkages, for oligonucleotides that have a) the common base sequence and length, b) the common pattern of backbone linkages; and c) a specific stereochemical configuration selected from Rp and Sp at the chiral linkage phosphorus of the at least one chiral internucleotidic linkage (chirally controlled internucleotidic linkage);
wherein the oligonucleotides comprise an element of consecutive nucleotidic units, wherein at least 50%, 55%, 60%, 65%, 70%, 75%, 80%, 85%, 90%, or 95% of the nucleotidic units of the element independently comprise a 2'-substitution.

104. The composition of embodiment 77-103, wherein at least 55%, 60%, 65%, 70%, 75%, 80%, 85%, 90%, or 95% of the nucleotidic units of the element independently comprise a 2'-substitution.

105. The composition of embodiment 77-103, wherein at least 60%, 65%, 70%, 75%, 80%, 85%, 90%, or 95% of the nucleotidic units of the element independently comprise a 2'-substitution.

106. The composition of embodiment 77-103, wherein at least 65%, 70%, 75%, 80%, 85%, 90%, or 95% of the nucleotidic units of the element independently comprise a 2'-substitution.

107. The composition of embodiment 77-103, wherein at least 70%, 75%, 80%, 85%, 90%, or 95% of the nucleotidic units of the element independently comprise a 2'-substitution.

108. The composition of embodiment 77-103, wherein at least 75%, 80%, 85%, 90%, or 95% of the nucleotidic units of the element independently comprise a 2'-substitution.

109. The composition of embodiment 77-103, wherein at least 80%, 85%, 90%, or 95% of the nucleotidic units of the element independently comprise a 2'-substitution.

110. The composition of embodiment 77-103, wherein at least 85%, 90%, or 95% of the nucleotidic units of the element independently comprise a 2'-substitution.

111. The composition of embodiment 77-103, wherein at least 90%, or 95% of the nucleotidic units of the element independently comprise a 2'-substitution.

112. The composition of embodiment 77-103, wherein at least 95% of the nucleotidic units of the element independently comprise a 2'-substitution.

113. A chirally controlled oligonucleotide composition comprising oligonucleotides which have:
a) a common base sequence and length;
b) a common pattern of backbone linkages, which comprises at least one chiral internucleotidic linkage comprising a chiral linkage phosphorus;
which composition is chirally controlled in that the composition is enriched, relative to a substantially racemic preparation of oligonucleotides having the same common base sequence and length and the same common pattern of backbone linkages, for oligonucleotides that have a) the common base sequence and length, b) the common pattern of backbone linkages; and c) a specific stereochemical configuration selected from Rp and Sp at the chiral linkage phosphorus of the at least one chiral internucleotidic linkage (chirally controlled internucleotidic linkage);
wherein the oligonucleotides comprise an element of consecutive nucleotidic units, each of which independently comprises a 2'-substituent.

114. A composition comprising an oligonucleotide, which oligonucleotide comprises an element of consecutive nucleotidic units, wherein each nucleotidic unit of the element independently comprises a 2'-substitution.

115. The composition of any one of embodiments 77-114, wherein the element comprises at least 2, 3, 4, 5, 6, 7, 8, 9, 10, 11, 12, 13, 14, 15, 16, 17, 18, 19, 20, or 21 consecutive nucleotidic units.

116. The composition of any one of embodiments 77-114, wherein the element comprises at least 4, 5, 6, 7, 8, 9, 10, 11, 12, 13, 14, 15, 16, 17, 18, 19, 20, or 21 consecutive nucleotidic units.

117. The composition of any one of embodiments 77-114, wherein the element comprises at least 5, 6, 7, 8, 9, 10, 11, 12, 13, 14, 15, 16, 17, 18, 19, 20, or 21 consecutive nucleotidic units.

118. The composition of any one of embodiments 77-114, wherein the element comprises at least 6, 7, 8, 9, 10, 11, 12, 13, 14, 15, 16, 17, 18, 19, 20, or 21 consecutive nucleotidic units.

119. The composition of any one of embodiments 77-114, wherein the element comprises at least 7, 8, 9, 10, 11, 12, 13, 14, 15, 16, 17, 18, 19, 20, or 21 consecutive nucleotidic units.

120. The composition of any one of embodiments 77-114, wherein the element comprises at least 8, 9, 10, 11, 12, 13, 14, 15, 16, 17, 18, 19, 20, or 21 consecutive nucleotidic units.

121. The composition of any one of embodiments 77-114, wherein the element comprises at least 9, 10, 11, 12, 13, 14, 15, 16, 17, 18, 19, 20, or 21 consecutive nucleotidic units.

122. The composition of any one of embodiments 77-114, wherein the element comprises at least 10, 11, 12, 13, 14, 15, 16, 17, 18, 19, 20, or 21 consecutive nucleotidic units.

123. The composition of any one of embodiments 77-114, wherein the element comprises at least 11, 12, 13, 14, 15, 16, 17, 18, 19, 20, or 21 consecutive nucleotidic units.

124. The composition of any one of embodiments 77-114, wherein the element comprises at least 12, 13, 14, 15, 16, 17, 18, 19, 20, or 21 consecutive nucleotidic units.

125. The composition of any one of embodiments 77-114, wherein the element comprises at least 13, 14, 15, 16, 17, 18, 19, 20, or 21 consecutive nucleotidic units.

126. The composition of any one of embodiments 77-114, wherein the element comprises at least 14, 15, 16, 17, 18, 19, 20, or 21 consecutive nucleotidic units.

127. The composition of any one of embodiments 77-114, wherein the element comprises at least 15, 16, 17, 18, 19, 20, or 21 consecutive nucleotidic units.

128. The composition of any one of embodiments 77-114, wherein the element comprises at least 16, 17, 18, 19, 20, or 21 consecutive nucleotidic units.

129. The composition of any one of embodiments 77-114, wherein the element comprises at least 17, 18, 19, 20, or 21 consecutive nucleotidic units.

130. The composition of any one of embodiments 77-114, wherein the element comprises at least 18, 19, 20, or 21 consecutive nucleotidic units.

131. The composition of any one of embodiments 77-114, wherein the element comprises at 19, 20, or 21 consecutive nucleotidic units.

132. The composition of any one of embodiments 77-114, wherein the element comprises at least 20, or 21 consecutive nucleotidic units.

133. The composition of any one of embodiments 77-114, wherein the element comprises at least 21 consecutive nucleotidic units.

134. The composition of any one of the preceding embodiments, wherein the oligonucleotides comprise a carbohydrate moiety.

135. A composition comprising an oligonucleotide, wherein the oligonucleotide comprising a carbohydrate moiety connected to the oligonucleotide at a nucleobase, optionally through a linker.

136. The composition of any one of embodiments 134-135, wherein a carbohydrate moiety is $R^{CD}$.

137. The composition of embodiment 136, wherein $R^{CD}$ is optionally substituted

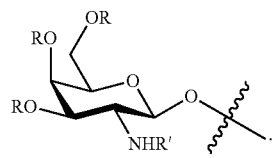

138. The composition of embodiment 136, wherein $R^{CD}$ is

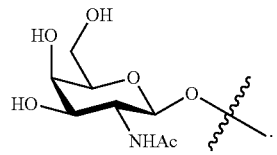

139. The composition of embodiment 136, wherein $R^{CD}$ is optionally substituted

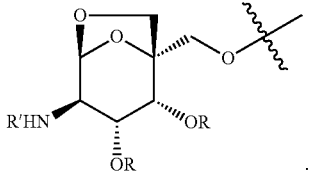

140. The composition of embodiment 136, wherein $R^{CD}$ is

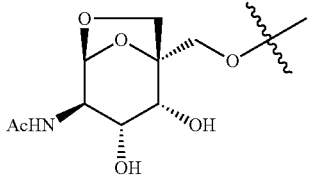

141. The composition of embodiment 136, wherein $R^{CD}$ is of such a structure that $R^{CD}$—H is

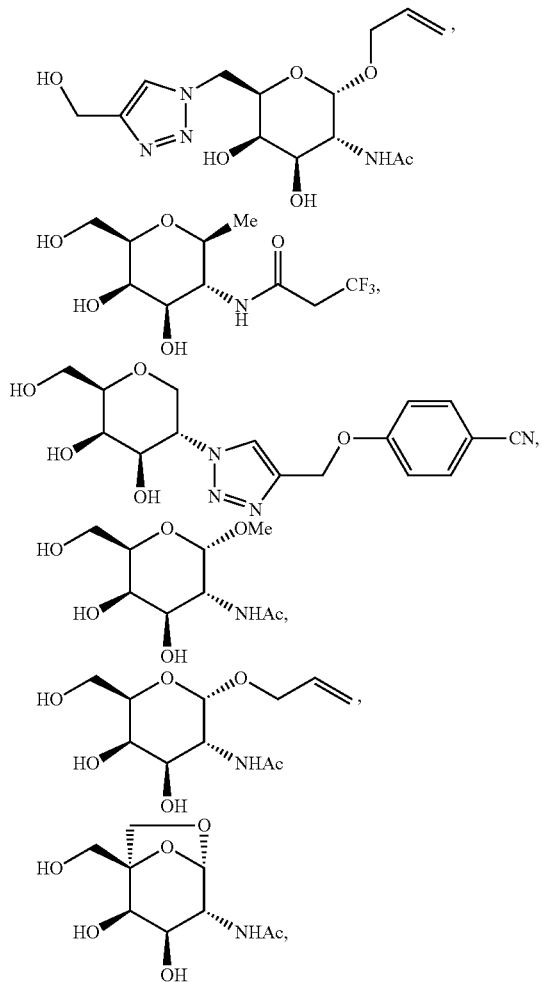

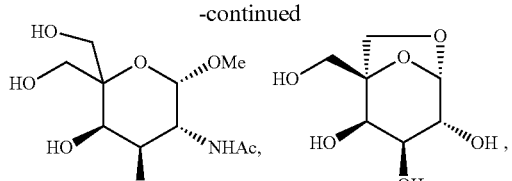

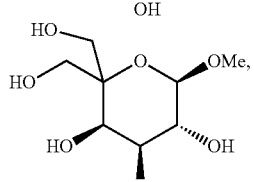

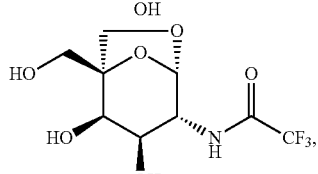

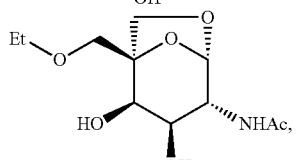

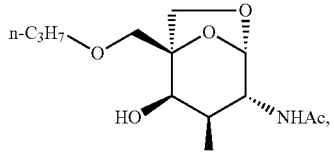

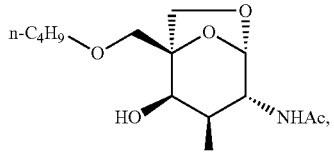

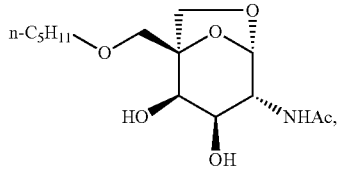

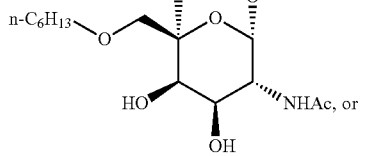

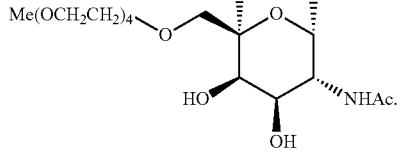

142. The composition of any one of the preceding embodiments, wherein the oligonucleotide comprises a lipid moiety.

143. A composition comprising an oligonucleotide, wherein the oligonucleotide comprises a lipid moiety connected to the oligonucleotide at a nucleobase, optionally through a linker.

144. The composition of embodiment 142 or 143, wherein a lipid moiety is $R^{LD}$.

145. The composition of embodiment 144, wherein $R^{LD}$ is

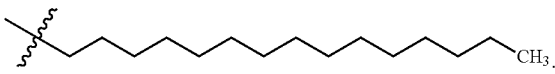 [SMILES: *CCCCCCCCCCCCCCC]

146. The composition of any one of the preceding embodiments, wherein the oligonucleotide comprises a target moiety.

147. A composition comprising an oligonucleotide, wherein the oligonucleotide comprises a target moiety connected to the oligonucleotide at a nucleobase, optionally through a linker.

148. The composition of embodiment 142 or 143, wherein the target moiety is $R^{TD}$.

149. The composition of any one of embodiments 134-148, where the moiety is connected to a nucleobase T.

150. The composition of embodiment 149, wherein the moiety, optional together with the linker, replaces the methyl group of T.

151. The composition of any one of embodiments 134-149, wherein the moiety is connected through a linker.

152. The composition of embodiment 151, wherein the linker is $L^M$.

153. The composition of embodiment 152, wherein the linker has the structure of

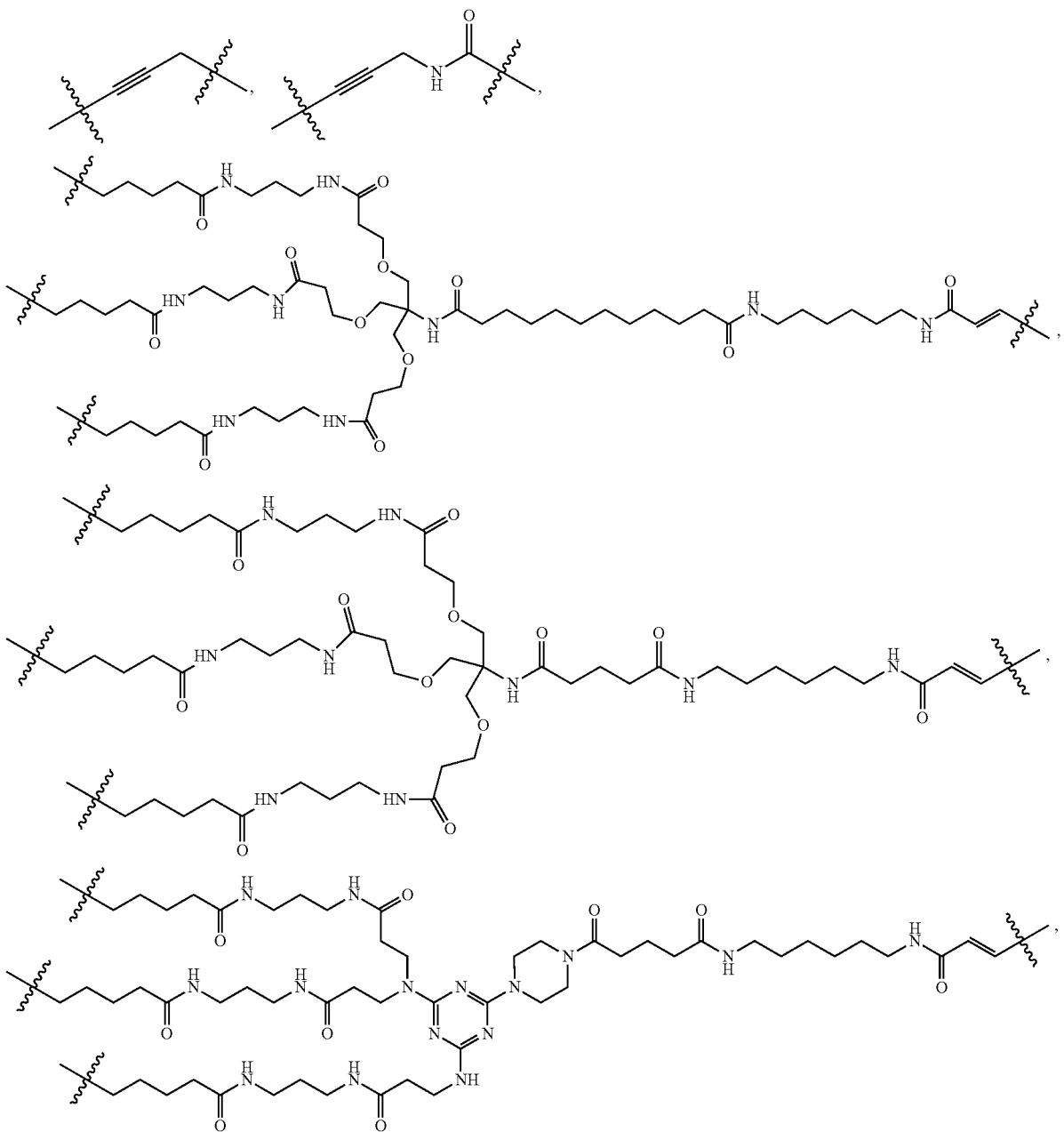

-continued

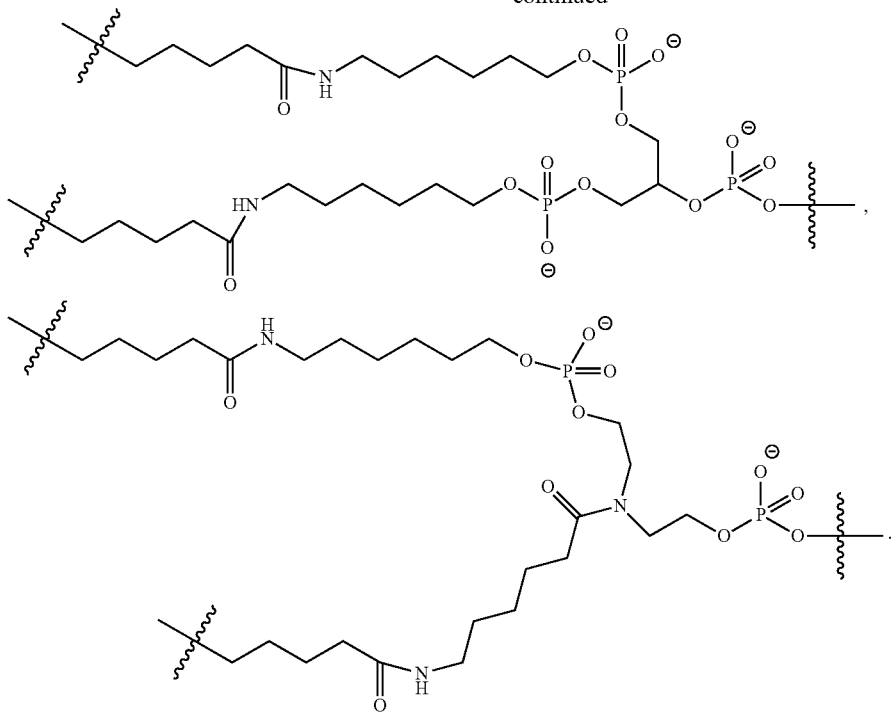

154. A composition comprising a compound which is an oligonucleotide comprising a 5'-end group $R^E$.

155. A compound having the structure of formula O-I:

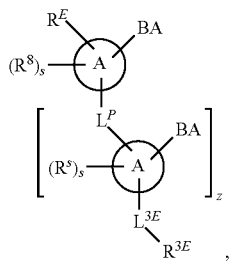

O-1 or a salt thereof, wherein:

$R^E$ is a 5'-end group;

each BA is independently an optionally substituted group selected from $C_{1-30}$ cycloaliphatic, $C_{6-30}$ aryl, $C_{5-30}$ heteroaryl having 1-10 heteroatoms, $C_{3-30}$ heterocyclyl having 1-10 heteroatoms, a natural nucleobase moiety, and a modified nucleobase moiety;

each $R^s$ is independently —F, —Cl, —Br, —I, —CN, —N$_3$, —NO, —NO$_2$, -L-R', -L-OR', -L-SR', -L-N(R')$_2$, —O-L-OR', —O-L-SR', or —O-L-N(R')$_2$;

s is 0-20;

each L is independently a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N (R')—, —N(R')C(O)O—, —S(O)—, —S(O)$_2$—, —S(O)$_2$N (R')—, —C(O)S—, —C(O)O—, —P(O)(OR')—, —P(O) (SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP (NR')O—, —OP(R')O—, or —OP(OR')[B(R')$_3$]O—; and one or more carbon atoms are optionally and independently replaced with $Cy^L$;

each $Cy^L$ is independently an optionally substituted tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each Ring A is independently an optionally substituted 3-20 membered monocyclic, bicyclic or polycyclic ring having 0-10 heteroatoms;

each $L^P$ is independently an internucleotidic linkage;

z is 1-1000;

$L^{3E}$ is -L- or -L-L-;

$R^{3E}$ is —R', -L-R', —OR', or a solid support;

each R' is independently —R, —C(O)R, —C(O)OR, or —S(O)$_2$R;

each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or:

two or more R groups on the same atom are optionally and independently taken together with the atom to form an optionally substituted, 3-30 membered monocyclic, bicyclic or polycyclic ring having, in addition to the atom, 0-10 heteroatoms; or two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms.

156. A compound having the structure of formula O-I:

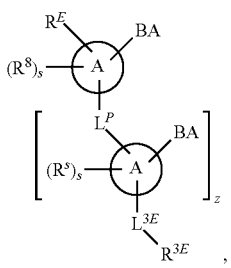

O-I or a salt thereof, wherein:

$R^E$ is a 5'-end group;

each BA is independently an optionally substituted group selected from $C_{1-30}$ cycloaliphatic, $C_{6-30}$ aryl, $C_{5-30}$ heteroaryl having 1-10 heteroatoms, $C_{3-30}$ heterocyclyl having 1-10 heteroatoms, a natural nucleobase moiety, and a modified nucleobase moiety;

each $R^s$ is independently —F, —Cl, —Br, —I, —CN, —$N_3$, —NO, —$NO_2$, -L-R', -L-OR', -L-SR', -L-N(R')$_2$, —O-L-OR', —O-L-SR', or —O-L-N(R')$_2$;

s is 0-20;

each L is independently a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with $Cy^L$;

each $Cy^L$ is independently an optionally substituted tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each Ring A is independently an optionally substituted 3-20 membered monocyclic, bicyclic or polycyclic ring having 0-10 heteroatoms;

each $L^P$ independently has the structure of formula I:

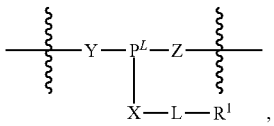

I or a salt form thereof, wherein:

$P^L$ is P(=W), P, or P→B(R')$_3$;

W is O, S or Se;

$R^1$ is -L-R, halogen, —CN, —$NO_2$, —Si(R)$_3$, —OR, —SR, or —N(R)$_2$;

each of X, Y and Z is independently —O—, —S—, —N(-L-$R^1$), or L;

z is 1-1000;

$L^{3E}$ is -L- or -L-L-;

$R^{3E}$ is —R', -L-R', —OR', a 3'-end cap, or a solid support;

each R' is independently —R, —C(O)R, —C(O)OR, or —S(O)$_2$R;

each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or:

two or more R groups on the same atom are optionally and independently taken together with the atom to form an optionally substituted, 3-30 membered monocyclic, bicyclic or polycyclic ring having, in addition to the atom, 0-10 heteroatoms; or two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms.

157. The compound of any one of embodiments 155-156, wherein z is at least 10.

158. The compound of any one of embodiments 155-156, wherein z is at least 15.

159. The compound of any one of embodiments 155-158, wherein each Ring A is independently

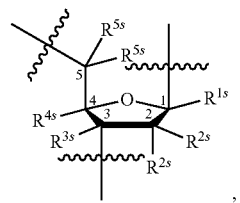

wherein:

BA is connected at C1;

each of $R^{1s}$, $R^{2s}$, $R^{3s}$, $R^{4s}$ and $R^{5s}$ is independently $R^s$.

160. The compound of embodiment 159, wherein each Ring A is independently

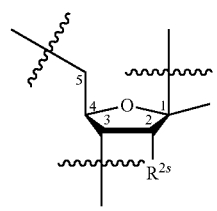

161. The compound of embodiment 159, wherein each Ring A is independently

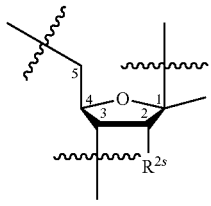

,

162. The compound of embodiment 159, wherein each Ring A is independently

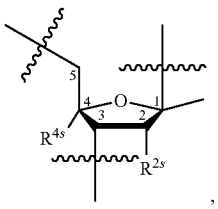

, wherein $R^{2s}$ and $R^{4s}$ are R, and the two R groups are taken together with their intervening atoms to form a ring.

163. The compound of any one of embodiments 155-162, wherein each BA is independently an optionally substituted group selected from $C_{1-30}$ cycloaliphatic, $C_{6-30}$ aryl, $C_{5-30}$ heteroaryl having 1-10 heteroatoms, and $C_{3-30}$ heterocyclyl having 1-10 heteroatoms.

164. The compound of any one of embodiments 155-162, wherein each BA is independently an optionally substituted group selected from $C_{6-30}$ aryl, $C_{5-30}$ heteroaryl having 1-10 heteroatoms, and $C_{3-30}$ heterocyclyl having 1-10 heteroatoms.

165. The compound of any one of embodiments 155-162, wherein each BA is independently an optionally substituted group selected from heteroaryl having 1-10 heteroatoms, and $C_{3-30}$ heterocyclyl having 1-10 heteroatoms.

166. The compound of any one of embodiments 155-162, wherein each BA is independently an optionally substituted $C_{5-30}$ heteroaryl group having 1-10 heteroatoms.

167. The compound of any one of embodiments 155-166, wherein each BA is independently optionally substituted or protected adenine, cytosine, guanosine, thymine, or uracil.

168. The compound of any one of embodiments 155-166, wherein each BA is independently optionally substituted adenine, cytosine, guanosine, thymine, or uracil.

169. The compound of any one of embodiments 155-168, wherein $R^{3E}$ is —H.

170. The compound of any one of embodiments 155-168, wherein $R^{3E}$ is —OH.

171. The compound of any one of embodiments 155-168, wherein $R^{3E}$ is a solid support for oligonucleotide synthesis.

172. The compound of any one of embodiments 155-171, wherein $L^{3E}$ is -L-.

173. The compound of any one of embodiments 155-171, wherein $L^{3E}$ is a covalent bond.

174. The compound of any one of embodiments 155-171, wherein $L^{3E}$ is —O—.

175. The compound of any one of embodiments 155-174, wherein z is no more than 200.

176. The compound of any one of embodiments 155-175, wherein z is no more than 100.

177. The compound of any one of embodiments 155-176, wherein z is no more than 50.

178. The compound of any one of embodiments 154-177, wherein $R^E$ is —$C(R^{5s})_3$, -L-$P^{DB}$, —$C(R^{5s})_2OH$, -L-$R^{5s}$, or -L-$P^{5s}$-L-$R^{5s}$, or a salt form thereof, wherein $P^{DB}$ is a phosphate group, or a derivative or a bioisostere thereof.

179. The compound of any one of embodiments 154-178, wherein $R^E$-(E)-CH=CH—$P^{DB}$, wherein $P^{DB}$ is a phosphate group, or a derivative or a bioisostere thereof.

180. The compound of any one of embodiments 154-179, wherein $P^{DB}$ is —OP(O)(OR)$_2$, —OP(O)(OR)(H), —OP(O)(OR)(SR), —OP(O)(OH)(OR), —OP(O)(SH)(OR), —OP(O)(XR)—X-L-X—P(O)(XR)$_2$, —OP(O)(XH)—X-L-X—P(O)(XH)(XR), —OP(O)(XR)—X-L-X—P(O)(XR)(R), —OP(O)(XH)—X-L-X—P(O)(XH)(R), —OP(O)(XH)—X-L-X—P(O)(XH)(H), —OP(O)(XR)—O-L-O—P(O)(XR)$_2$, —OP(O)(XR)—O-L-O—P(O)(XR)(R), —OP(O)(XR)—O-L-O—P(O)(XR)$_2$, —OP(O)(SR)—O-L-O—P(O)(XR)$_2$, —OP(O)(OR)—O-L-O—P(O)(XR)$_2$, —OP(O)(OH)—O-L-O—P(O)(XR)$_2$, —OP(O)(OH)—O-L-O—P(O)(OR)(XR), —OP(O)(OH)—O-L-O—P(O)(OH)(XR), —OP(O)(OH)—O-L-O—P(O)(OH)(OR), —OP(O)(OH)—O-L-O—P(O)(OH)(SR), —OP(O)(OH)—O-L-O—P(O)(OH)(R), —OP(O)(OH)—O-L-O—P(O)(OH)(H), —OP(O)(SH)—O-L-O—P(O)(XR)$_2$, —OP(O)(SH)—O-L-O—P(O)(OR)(XR), —OP(O)(SH)—O-L-O—P(O)(OH)(XR), —OP(O)(SH)—O-L-O—P(O)(OH)(OR), —OP(O)(SH)—O-L-O—P(O)(OH)(SR), —OP(O)(SH)—O-L-O—P(O)(OH)(R), or —OP(O)(SH)—O-L-O—P(O)(OH)(H).

181. The compound of embodiment 180, wherein each X in $P^{DB}$ is independently —O—, —S—, or a covalent bond.

182. The compound of any one of embodiments 180-181, wherein each L in $P^{DB}$ is independently a covalent bond, or a bivalent, optionally substituted, linear or branched $C_{1-6}$ aliphatic, wherein one or more methylene units are optionally and independently replaced with —O—, —S— or —N(R')—.

183. The compound of any one of embodiments 154-178, wherein $R^E$ is -L-P(O)(XR)$_2$ or a salt form thereof.

184. The compound of any one of embodiments 154-178, wherein $R^E$ is -L-P(O)(XR)$_2$ or a salt form thereof, wherein each X is independently —O—, —S—, or a covalent bond.

185. The compound of any one of embodiments 154-178, wherein $R^E$ is -L-P(O)(OR)$_2$ or a salt form thereof.

186. The compound of any one of embodiments 154-178, wherein $R^E$ is -L-P(O)(OR)(SR) or a salt form thereof.

187. The compound of any one of embodiments 154-178, wherein $R^E$ is -L-P(O)(OR)(R) or a salt form thereof.

188. The compound of any one of embodiments 181-187, wherein L in $R^E$ is a covalent bond, or a bivalent, optionally substituted, linear or branched $C_{1-6}$ aliphatic, wherein one or more methylene units are optionally and independently replaced with —O—, —S— or —N(R')—.

189. The compound of any one of embodiments 181-188, wherein R in $R^E$ is H.

190. The compound of any one of embodiments 154-188, wherein $R^E$ is -(E)-CH=CH—P(O)(OH)$_2$ or a salt form thereof.

191. The compound of any one of embodiments 154-178, wherein $R^E$ is -L-$R^{5s}$.

192. The compound of any one of embodiments 154-178, wherein $R^E$ is —X-L-R.

193. The compound of embodiment 191 or 192, wherein L in $R^E$ comprises an optionally substituted, bivalent or multivalent

group.
194. The compound of embodiment 191 or 192, wherein L in $R^E$ comprises an optionally substituted

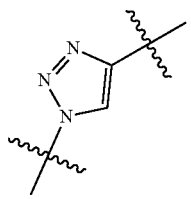 [SMILES: *c1cn(*)nn1]

group.
195. The compound of embodiment 191 or 192, wherein L in $R^E$ comprises a

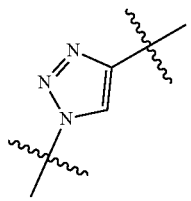 [SMILES: *c1cn(*)nn1]

group.
196. The compound of any one of embodiments 154-178, wherein $R^E$ is

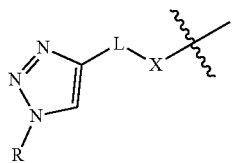

197. The compound of embodiment 196, wherein X in $R^E$ is —C(R)$_2$—.
198. The compound of embodiment 196, wherein X in $R^E$ is —O—.
199. The compound of embodiment 196, wherein X in $R^E$ is —S—.
200. The compound of embodiment 196, wherein X in $R^E$ is —N(R)—.
201. The compound of any one of embodiments 178-200, wherein each R in $R^E$ is independently —H, or an optionally substituted group selected from $C_{1-10}$ alkyl, $C_{1-10}$ allyl, and $C_{6-14}$ aryl.
202. The compound of any one of embodiments 154-178, wherein $R^E$ is —CH$_2$OH.
203. The compound of any one of embodiments 154-178, wherein $R^E$ is —CH$_2$OP(O)(OH)$_2$ or a salt form thereof.
204. The compound of any one of embodiments 154-178, wherein $R^E$ is —CH$_2$OP(O)(OH)H or a salt form thereof.
205. The compound of any one of embodiments 154-178, wherein $R^E$ is —CH$_2$OP(O)(OH)(SH) or a salt form thereof.
206. The compound of any one of embodiments 154-178, wherein $R^E$ is —CH$_2$OP(O)(OH)(OCH$_2$CH$_2$CH$_3$) or a salt form thereof.
207. The compound of any one of embodiments 154-178, wherein $R^E$ is —CH$_2$OP(O)(SH)OCH$_2$C(CH$_3$)$_2$CH$_2$OP(O)(OH)$_2$ or a salt form thereof.
208. The compound of any one of embodiments 154-178, wherein $R^E$ is —CH$_2$OP(O)(SH)OCH$_2$C(CH$_3$)$_2$CH$_2$OP(O)(OH)(SH) or a salt form thereof.
209. The compound of any one of embodiments 154-178, wherein $R^E$ is —CH$_2$OP(O)(SH)OCH$_2$C(CH$_3$)$_2$CH$_2$OP(O)(OH)(H) or a salt form thereof.
210. The compound of any one of embodiments 178-189, wherein L in $R^E$ is —C(R)$_2$—O—, wherein each R is independently —H or optionally substituted $C_{1-4}$ aliphatic.
211. The compound of any one of embodiments 178-189, wherein L in $R^E$ is —CHR—O—, wherein R is —H or optionally substituted $C_{1-4}$ aliphatic.
212. The compound of any one of embodiments 178-189, wherein L in $R^E$ is —CHR—O—, wherein R is optionally substituted $C_{1-4}$ aliphatic.
213. The compound of any one of embodiments 210-212, wherein L in $R^E$ is —CHR—O—, wherein R is $C_{1-4}$ aliphatic or haloaliphatic.
214. The compound of any one of embodiments 210-212, wherein L in $R^E$ is —CHR—O—, wherein R is $C_{1-3}$ aliphatic or haloaliphatic.
215. The compound of any one of embodiments 210-212, wherein L in $R^E$ is —CHR—O—, wherein R is $C_{1-2}$ aliphatic or haloaliphatic.
216. The compound of any one of embodiments 210-215, wherein L in $R^E$ is —CHR—O—, wherein R is methyl.
217. The compound of any one of embodiments 210-215, wherein L in $R^E$ is —CHR—O—, wherein R is methyl substituted with one or more halogen.
218. The compound of any one of embodiments 210-217, wherein for L, —O— is connected to P.
219. The compound of any one of embodiments 210-218, wherein L in $R^E$ is —CHR—O—, wherein —CHR— has an R configuration.
220. The compound of any one of embodiments 210-218, wherein L in $R^E$ is —CHR—O—, wherein —CHR— has an S configuration.
221. The compound of any one of embodiments 154-178, wherein $R^E$ is —(R)—CH(Me)-OH.
222. The compound of any one of embodiments 154-178, wherein $R^E$ is —(S)—CH(Me)-OH.
223. The compound of any one of embodiments 154-178 and 210-220, wherein $R^E$ is —(R)—CH(Me)-O—P(O)(OH)$_2$ or a salt form thereof.
224. The compound of any one of embodiments 154-178 and 210-220, wherein $R^E$ is —(S)—CH(Me)-O—P(O)(OH)$_2$ or a salt form thereof.
225. The compound of any one of embodiments 154-224, wherein the 5'-nucleoside comprising $R^E$ has the structure of

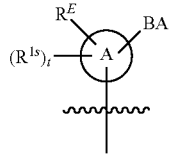

226. The compound of any one of embodiments 154-225, wherein the 5'-nucleoside comprising $R^E$ has the structure of

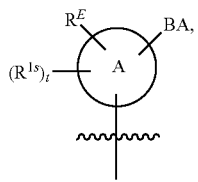

wherein BA is T.

227. The compound of embodiment 226, wherein the 5'-nucleoside comprising $R^E$ has the structure of

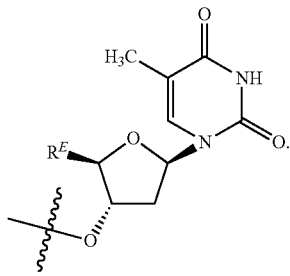

228. The compound of any one of embodiments 154-178, wherein the 5'-nucleoside comprising $R^E$ has the structure of

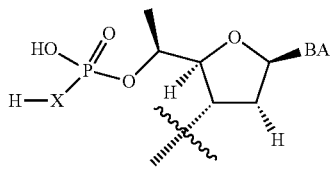

or a salt form thereof.

229. The compound of any one of embodiments 154-178, wherein the 5'-nucleoside comprising RE has the structure of

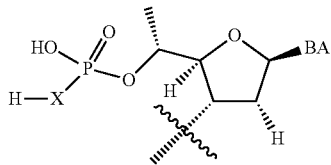

or a salt form thereof.

230. The compound of any one of embodiments 228-229, wherein X is O.

231. The compound of any one of embodiments 228-233, wherein BA is T.

232. The compound of any one of embodiments 155-231, wherein a heteroatom is independently selected from oxygen, nitrogen, sulfur, phosphorus, boron and silicon.

233. The compound of any one of embodiments 155-231, wherein a heteroatom is independently selected from oxygen, nitrogen, sulfur, and phosphorus.

234. The compound of any one of embodiments 155-231, wherein a heteroatom is independently selected from oxygen, nitrogen, and sulfur.

235. A compound, which is a multimer of oligonucleotides, wherein each oligonucleotide is independently an oligonucleotide or compound described in any one of the preceding embodiments.

236. The compound of embodiment 235, wherein each oligonucleotide monomer of the multimer is independently a compound of any one of embodiments 155-234.

237. The compound of any one of embodiments 235-236, wherein each oligonucleotide monomer is the same.

238. The compound of any one of embodiments 235-236, wherein at least one oligonucleotide monomer is different from at least one of the other oligonucleotide monomers.

239. A compound having the structure of $A^c$-$[$-$L^M$-$(R^D)_a]_b$ or a salt thereof.

240. A compound having the structure of $[(A^c)_a$-$L^M]_b$-$R^D$, or a salt thereof.

241. A compound having the structure of $(Ac)_a$-$L^M$-$(Ac)_b$, or a salt thereof.

242. The compound of any one of embodiments 235-238, wherein the compound is a compound of embodiment 241.

243. A compound having the structure of $(Ac)_a$-$L^M$-$(R^D)_b$, or a salt thereof.

244. The compound of any one of embodiments 239-243, wherein:
each $A^c$ is independently an oligonucleotide moiety (e.g., $[H]_a$-$A^c$ or $[H]_b$-$A^c$ is an oligonucleotide);
a is 1-1000;
b is 1-1000;
$L^M$ is a multivalent linker; and
each $R^D$ is independently a lipid moiety, a carbohydrate moiety, or a targeting moiety.

245. The compound of any one of embodiments 239-243, wherein:
each $A^c$ is independently an oligonucleotide moiety (e.g., $[H]_a$-$A^c$ or $[H]_b$-$A^c$ is an oligonucleotide);
a is 1-1000;
b is 1-1000;
each $R^D$ is independently $R^{LD}$, $R^{CD}$ or $R^{TD}$;
$R^{CD}$ is an optionally substituted, linear or branched group selected from a $C_{1-100}$ aliphatic group and a $C_{1-100}$ heteroaliphatic group having 1-30 heteroatoms, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with $Cy^L$;
$R^{LD}$ is an optionally substituted, linear or branched group selected from a $C_{1-100}$ aliphatic group wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with Cy$^L$;
R$^{TD}$ is a targeting moiety;
each L$^M$ is independently a covalent bond, or a bivalent or multivalent, optionally substituted, linear or branched group selected from a C$_{1-100}$ aliphatic group and a C$_{1-100}$ heteroaliphatic group having 1-30 heteroatoms, wherein one or more methylene units are optionally and independently replaced with C$_{1-6}$ alkylene, C$_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with Cy$^L$;
each Cy$^L$ is independently an optionally substituted tetravalent group selected from a C$_{3-20}$ cycloaliphatic ring, a C$_{6-20}$ aryl ring, a 5-20 membered heteroaryl ring having 1-10 heteroatoms, and a 3-20 membered heterocyclyl ring;
each R' is independently —R, —C(O)R, —C(O)OR, or —S(O)$_2$R; and
each R is independently —H, or an optionally substituted group selected from C$_{1-30}$ aliphatic, C$_{1-30}$ heteroaliphatic having 1-10 heteroatoms, C$_{6-30}$ aryl, C$_{6-30}$ arylaliphatic, C$_{6-30}$ arylheteroaliphatic having 1-10 heteroatoms, 5-30 membered heteroaryl having 1-10 heteroatoms, and 3-30 membered heterocyclyl having 1-10 heteroatoms, or
two R groups are optionally and independently taken together to form a covalent bond, or:
two or more R groups on the same atom are optionally and independently taken together with the atom to form an optionally substituted, 3-30 membered monocyclic, bicyclic or polycyclic ring having, in addition to the atom, 0-10 heteroatoms; or
two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms.

246. The compound of any one of embodiments 239-245, wherein each R$^D$ is independently R$^{LD}$ or R$^{CD}$.

247. The compound of any one of embodiments 239-246, wherein at least one L$^M$ comprises —S—S—.

248. The compound of any one of embodiments 239-247, wherein at least one L$^M$ comprises Cy$^L$.

249. The compound of embodiment 248, wherein Cy$^L$ is or comprises a

group, which is bivalent or multivalent.

250. The compound of any one of embodiments 239-246, wherein at least one L$^M$ comprises an bivalent, optionally substituted

group.

251. The compound of any one of embodiments 239-250, wherein a is 1-100 and b is 1-100.

252. The compound of any one of embodiments 239-251, wherein a is 1.

253. The compound of any one of embodiments 239-252, wherein b is 1.

254. The compound of any one of embodiments 239-253, wherein A$^c$ is a moiety of ([H]$_a$-A$^c$ or [H]$_b$-A$^c$ is) a compound of any one of embodiments 154-234.

255. A compound, which is a compound of any one of embodiments 155-238 connected, optionally through a linker, to one or more carbohydrate, lipid, and/or targeting moieties.

256. The compound of embodiment 255, wherein the linker has the structure of L$^M$, and each of the moieties is independently R$^D$.

257. The compound of embodiment 255-256, wherein the compound is a compound of any one of embodiments 239-254.

258. The compound of any one of embodiments 239-257, wherein the compound comprises a R$^{CD}$ group.

259. The compound of any one of embodiments 239-257, wherein the compound comprises a R$^{CD}$ group connected to a nucleobase optionally through a linker.

260. The compound of any one of embodiments 239-257, comprising a R$^{CD}$ group which is optionally substituted

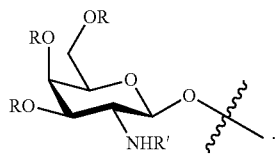

261. The compound of any one of embodiments 239-257, comprising a R$^{CD}$ group which is

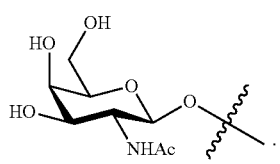

262. The compound of any one of embodiments 239-257, comprising a $R^{CD}$ group which is optionally substituted
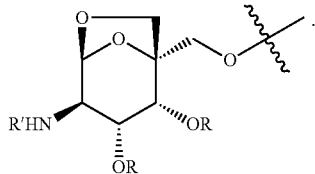
263. The compound of any one of embodiments 239-257, comprising a $R^{CD}$ group which is
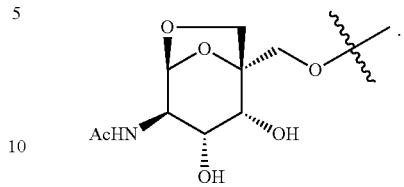
264. The compound of any one of embodiments 239-257, comprising a $R^{CD}$ group which is selected from:
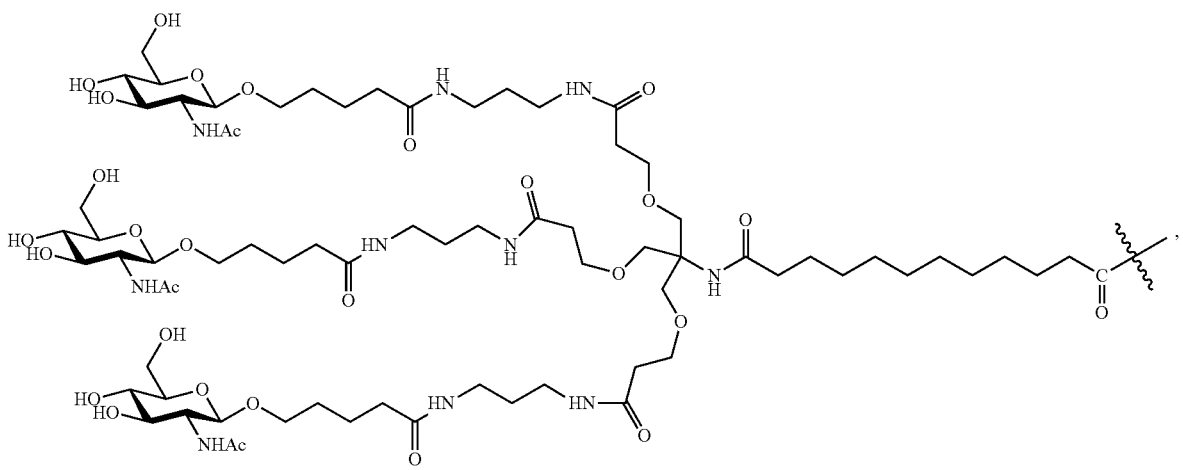
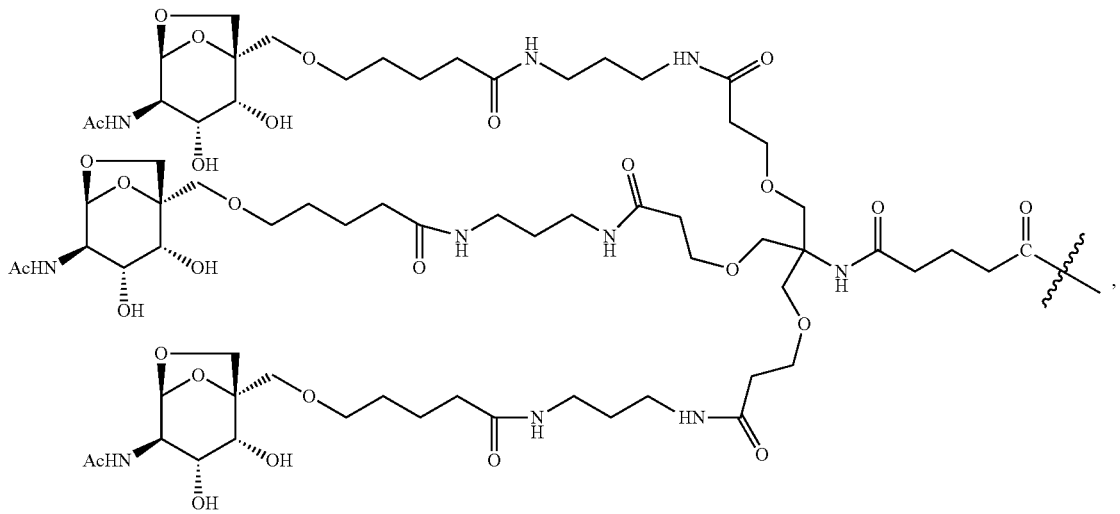

-continued
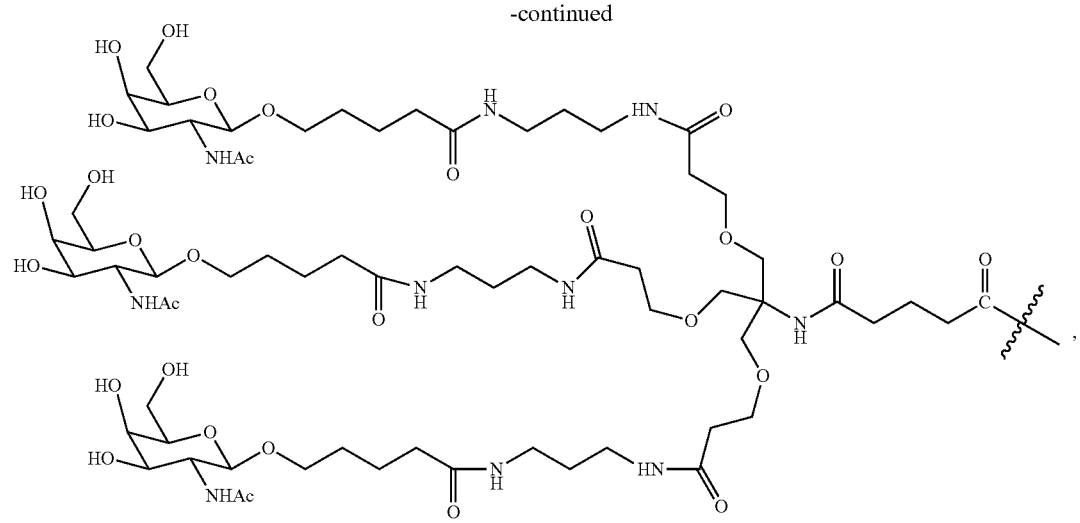
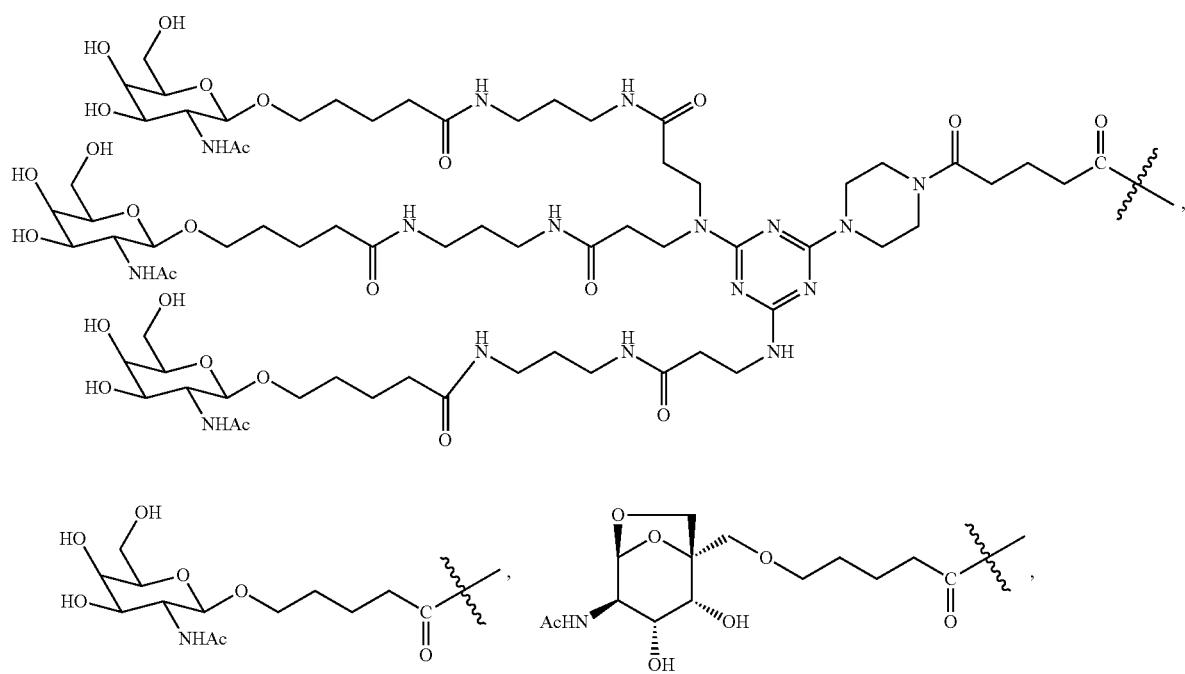
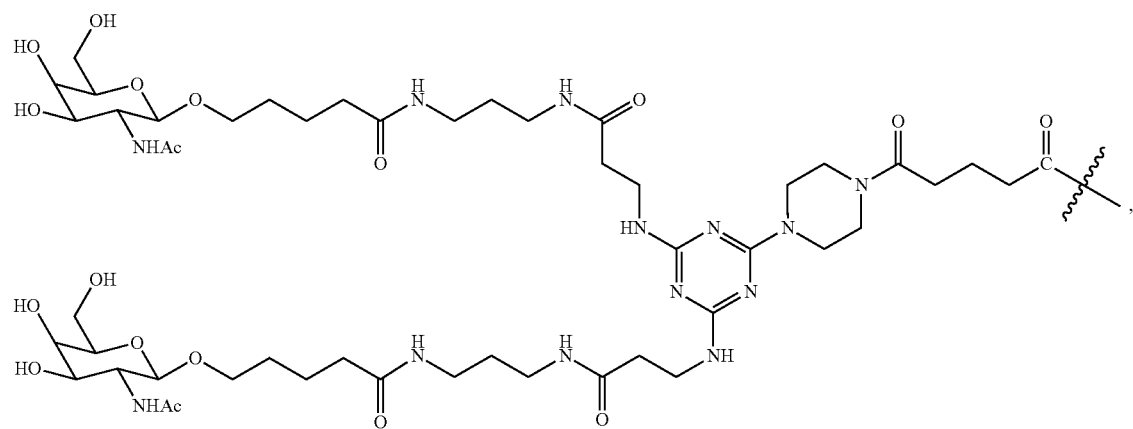

-continued
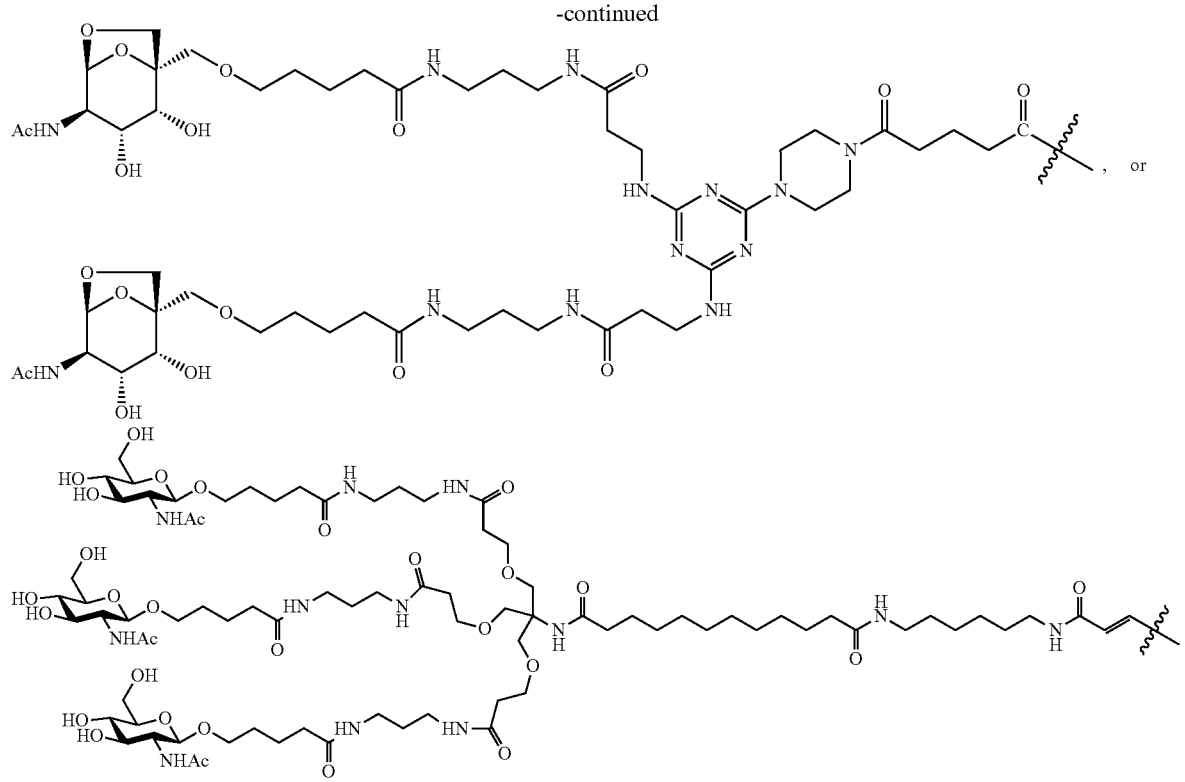
265. The compound of any one of embodiments 239-257, comprising a $R^{CD}$ group which is of such a structure that $R^{CD}$—H is
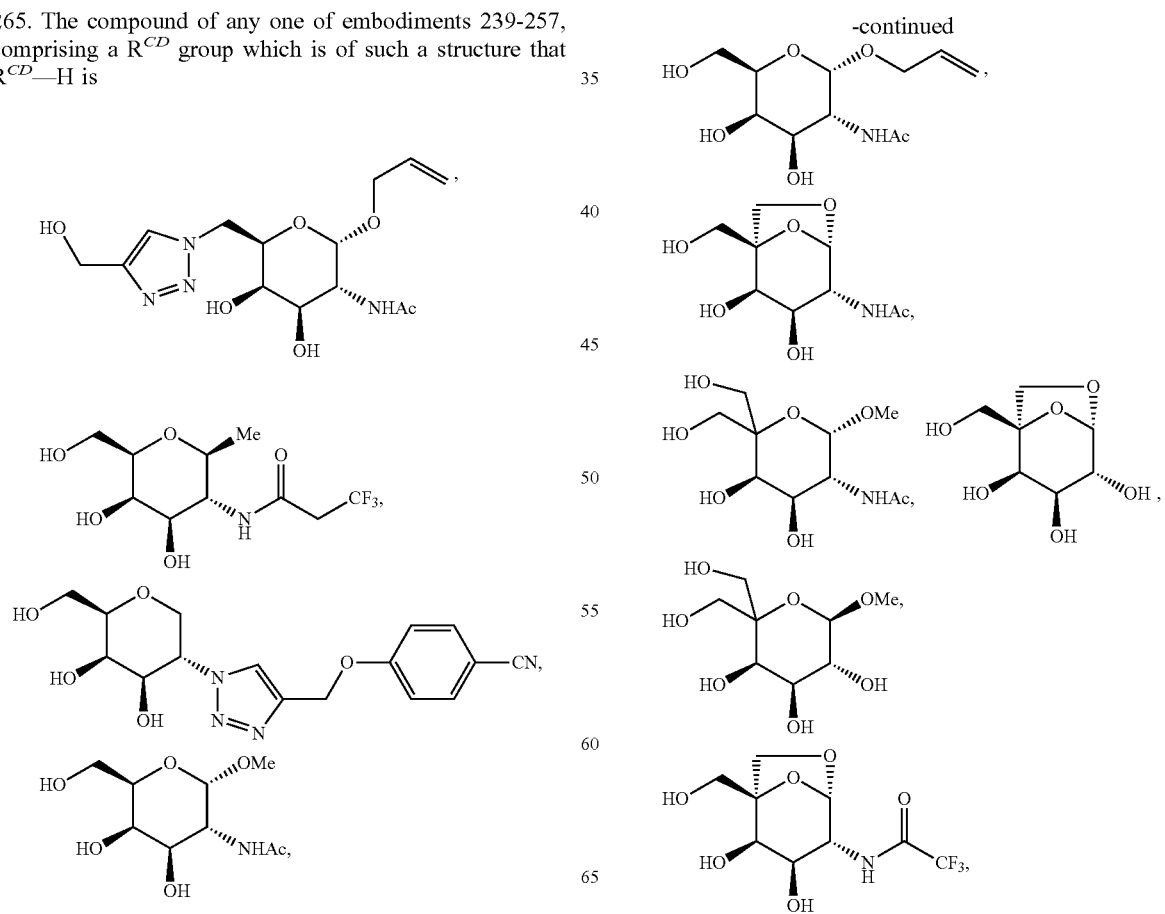

881

-continued

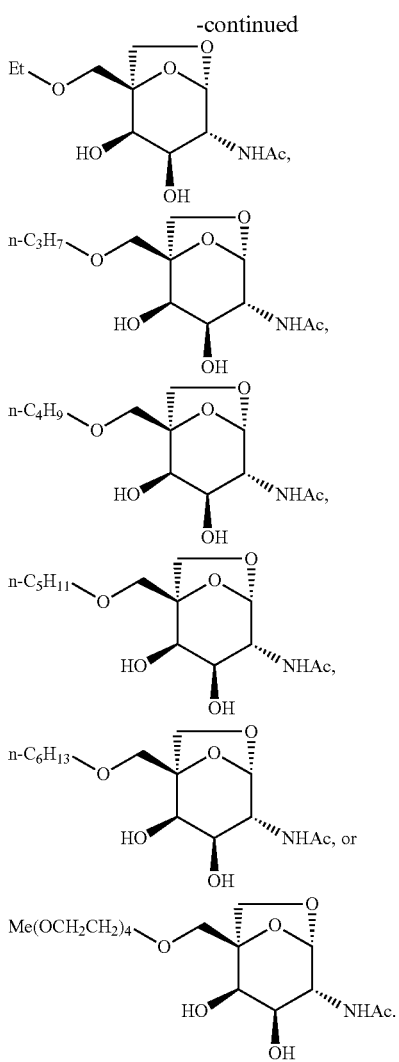

266. The compound of any one of embodiments 239-265, wherein the compound comprises a lipid moiety.

882

267. The compound of any one of embodiments 239-266, wherein the compound comprising a lipid moiety connected to the oligonucleotide at a nucleobase, optionally through a linker.

268. The compound of any one of embodiments 239-266, wherein a lipid moiety is $R^{LD}$.

269. The compound of embodiment 268, wherein $R^{LD}$ is

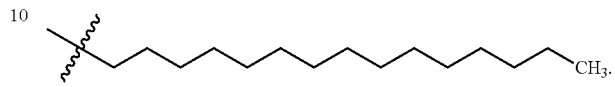

270. The compound of embodiment 268, wherein $R^{LD}$ is

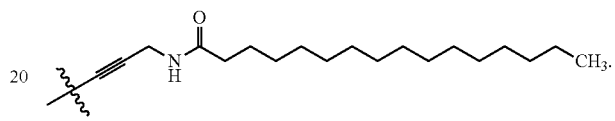

271. The compound of any one of embodiments 239-270, wherein the compound comprises a target moiety.

272. The compound of any one of embodiments 239-270, wherein the compound comprises a target moiety connected to a nucleobase, optionally through a linker.

273. The compound of embodiment 271 or 272, wherein the target moiety is $R^{TD}$.

274. The compound of embodiment 271 or 272, wherein the target moiety is $R^{TD}$, wherein $R^{TD}$ is $R^{CD}$ or $R^{LD}$.

275. The compound of any one of embodiments 239-273, where the moiety is connected to a nucleobase T, optionally through a linker.

276. The compound of embodiment 275, wherein the moiety, optional together with the linker, replaces the methyl group of T.

277. The compound of any one of embodiments 255-276, wherein the linker is $L^M$.

278. The compound of embodiment 277, wherein the linker is a covalent bond, or has the structure of

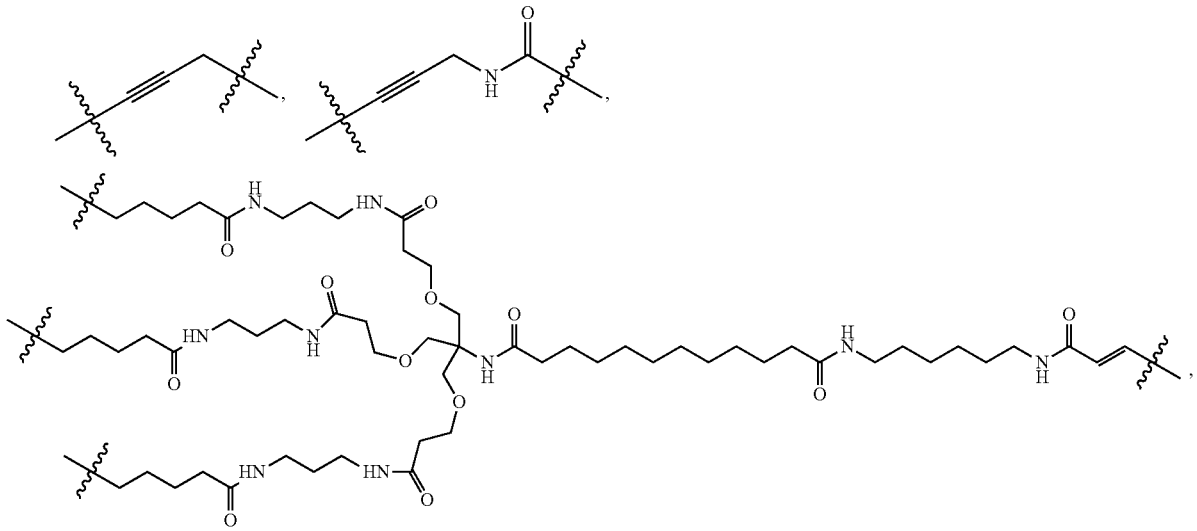

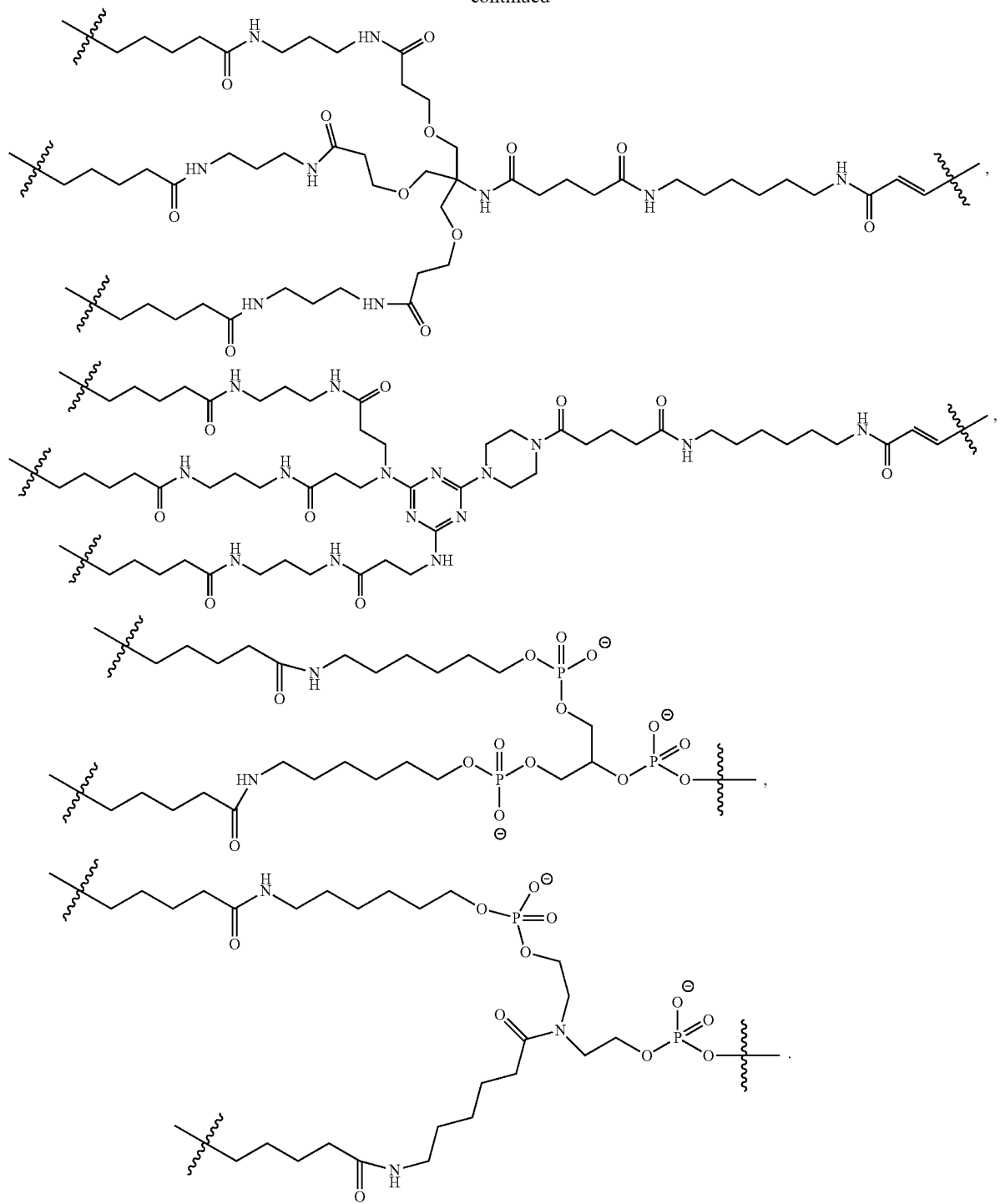

279. The composition of any one of embodiments 1-154, wherein the oligonucleotide is a compound of any one of embodiments 155-278.

280. The composition of embodiment 279, wherein $R^E$ is $-C(R^{5s})_3$, $-L-P^{DB}$, $-C(R^{5s})_2OH$, $-L-R^{5s}$, or $-L-P^{5s}-L-R^{5s}$, or a salt form thereof.

281. The composition of any one of embodiments 77-254, wherein the 5'-end internucleotidic linkage is a non-natural internucleotidic linkage.

282. The composition of any one of embodiments 77-281, wherein the 3'-end internucleotidic linkage is a non-natural internucleotidic linkage.

283. The composition of any one of embodiments 77-282, wherein an internucleotidic linkage immediately 3' of a nucleoside unit comprising a pyrimidine nucleobase is a non-natural internucleotidic linkage.

284. The composition of any one of embodiments 77-283, wherein each internucleotidic linkage immediately 3' of a nucleoside unit comprising a pyrimidine nucleobase is independently a non-natural internucleotidic linkage.

285. The composition of any one of embodiments 77-284, wherein an internucleotidic linkage immediately 5' of a nucleoside unit comprising a pyrimidine nucleobase is a non-natural internucleotidic linkage.

286. The composition of any one of embodiments 77-285, wherein each internucleotidic linkage immediately 5' of a nucleoside unit comprising a pyrimidine nucleobase is independently a non-natural internucleotidic linkage.

287. The composition of any one of embodiments 77-286, wherein an internucleotidic linkage linking two nucleotidic units each of which independently comprises a pyrimidine nucleobase is a non-natural internucleotidic linkage.

288. The composition of any one of embodiments 77-287, wherein each internucleotidic linkage linking two nucleotidic units each of which independently comprises a pyrimidine nucleobase is independently a non-natural internucleotidic linkage.

289. The composition of any one of embodiments 283-288, wherein a pyrimidine nucleobase is an optionally substituted nucleobase selected from cytosine, thymine and uracil.

290. The composition of any one of embodiments 283-289, wherein a pyrimidine nucleobase is selected from cytosine, thymine and uracil.

291. The composition of embodiment 287 or 288, wherein the two nucleotidic units each of which independently comprises a pyrimidine nucleobase are selected from 5'-UU-3', 5'-TU-3', 5'-CU-3', 5'-UT-3', 5'-TT-3', 5'-CT-3', 5'-UC-3', 5'-TC-3', and 5'-CC-3'.

292. The composition of any one of embodiments 77-291, wherein an internucleotidic linkage immediately 3' of the second, third, fourth, fifth, sixth, seventh, or eighth nucleoside units from the 5'-end is a non-natural internucleotidic linkage.

293. The composition of any one of embodiments 77-292, wherein each internucleotidic linkage immediately 3' of the second, third, fourth, fifth, sixth, seventh, and eighth nucleoside units from the 5'-end is independently a non-natural internucleotidic linkage.

294. The composition of any one of embodiments 77-293, wherein an internucleotidic linkage immediately 3' of any one of the ninth to the third last nucleoside units from the 5'-end is a non-natural internucleotidic linkage.

295. The composition of any one of embodiments 77-294, wherein each internucleotidic linkage immediately 3' of any one of the ninth to the third last nucleoside units from the 5'-end is independently a non-natural internucleotidic linkage.

296. The composition of any one of embodiments 281-295, wherein a non-natural internucleotidic linkage is a chiral internucleotidic linkage, optionally chirally controlled.

297. The composition of any one of the preceding embodiments, wherein the oligonucleotide comprises at least 1, 2, 3, 4, 5, 6, 7, 8, 9, 10, 11, 12, 13, 14, 15, 16, 17, 18, 19, 20, or 21 chiral internucleotidic linkages.

298. The composition of any one of the preceding embodiments, wherein the oligonucleotide comprises at least 2, 3, 4, 5, 6, 7, 8, 9, 10, 11, 12, 13, 14, 15, 16, 17, 18, 19, 20, or 21 chiral internucleotidic linkages.

299. The composition of any one of the preceding embodiments, wherein the oligonucleotide comprises at least 3, 4, 5, 6, 7, 8, 9, 10, 11, 12, 13, 14, 15, 16, 17, 18, 19, 20, or 21 chiral internucleotidic linkages.

300. The composition of any one of the preceding embodiments, wherein the oligonucleotide comprises at least 4, 5, 6, 7, 8, 9, 10, 11, 12, 13, 14, 15, 16, 17, 18, 19, 20, or 21 chiral internucleotidic linkages.

301. The composition of any one of the preceding embodiments, wherein the oligonucleotide comprises at least 5, 6, 7, 8, 9, 10, 11, 12, 13, 14, 15, 16, 17, 18, 19, 20, or 21 chiral internucleotidic linkages.

302. The composition of any one of the preceding embodiments, wherein the oligonucleotide comprises at least 6, 7, 8, 9, 10, 11, 12, 13, 14, 15, 16, 17, 18, 19, 20, or 21 chiral internucleotidic linkages.

303. The composition of any one of the preceding embodiments, wherein the oligonucleotide comprises at least 7, 8, 9, 10, 11, 12, 13, 14, 15, 16, 17, 18, 19, 20, or 21 chiral internucleotidic linkages.

304. The composition of any one of the preceding embodiments, wherein the oligonucleotide comprises at least 8, 9, 10, 11, 12, 13, 14, 15, 16, 17, 18, 19, 20, or 21 chiral internucleotidic linkages.

305. The composition of any one of the preceding embodiments, wherein the oligonucleotide comprises at least 9, 10, 11, 12, 13, 14, 15, 16, 17, 18, 19, 20, or 21 chiral internucleotidic linkages.

306. The composition of any one of the preceding embodiments, wherein the oligonucleotide comprises at least 10, 11, 12, 13, 14, 15, 16, 17, 18, 19, 20, or 21 chiral internucleotidic linkages.

307. The composition of any one of the preceding embodiments, wherein the oligonucleotide comprises at least 12, 13, 14, 15, 16, 17, 18, 19, 20, or 21 chiral internucleotidic linkages.

308. The composition of any one of the preceding embodiments, wherein the oligonucleotide comprises at least 13, 14, 15, 16, 17, 18, 19, 20, or 21 chiral internucleotidic linkages.

309. The composition of any one of the preceding embodiments, wherein the oligonucleotide comprises at least 14, 15, 16, 17, 18, 19, 20, or 21 chiral internucleotidic linkages.

310. The composition of any one of the preceding embodiments, wherein the oligonucleotide comprises at least 15, 16, 17, 18, 19, 20, or 21 chiral internucleotidic linkages.

311. The composition of any one of the preceding embodiments, wherein the oligonucleotide comprises at least 16, 17, 18, 19, 20, or 21 chiral internucleotidic linkages.

312. The composition of any one of the preceding embodiments, wherein the oligonucleotide comprises at least 17, 18, 19, 20, or 21 chiral internucleotidic linkages.

313. The composition of any one of the preceding embodiments, wherein the oligonucleotide comprises at least 18, 19, 20, or 21 chiral internucleotidic linkages.

314. The composition of any one of the preceding embodiments, wherein the oligonucleotide comprises at least 19, 20, or 21 chiral internucleotidic linkages.

315. The composition of any one of the preceding embodiments, wherein the oligonucleotide comprises at least 20, or 21 chiral internucleotidic linkages.

316. The composition of any one of the preceding embodiments, wherein at least 10%, 15%, 20%, 25%, 30%, 35%, 40%, 45%, 50%, 55%, 60%, 65%, 70%, 75%, 80%, 85%, 90% or 95% of the internucleotidic linkages of the oligonucleotide are independently chiral internucleotidic linkages.

317. The composition of any one of the preceding embodiments, wherein at least 15%, 20%, 25%, 30%, 35%, 40%, 45%, 50%, 55%, 60%, 65%, 70%, 75%, 80%, 85%, 90% or 95% of the internucleotidic linkages of the oligonucleotide are independently chiral internucleotidic linkages.

318. The composition of any one of the preceding embodiments, wherein at least 20%, 25%, 30%, 35%, 40%, 45%, 50%, 55%, 60%, 65%, 70%, 75%, 80%, 85%, 90% or 95% of the internucleotidic linkages of the oligonucleotide are independently chiral internucleotidic linkages.

319. The composition of any one of the preceding embodiments, wherein at least 25%, 30%, 35%, 40%, 45%, 50%, 55%, 60%, 65%, 70%, 75%, 80%, 85%, 90% or 95% of the internucleotidic linkages of the oligonucleotide are independently chiral internucleotidic linkages.

320. The composition of any one of the preceding embodiments, wherein at least 30%, 35%, 40%, 45%, 50%, 55%, 60%, 65%, 70%, 75%, 80%, 85%, 90% or 95% of the internucleotidic linkages of the oligonucleotide are independently chiral internucleotidic linkages.

321. The composition of any one of the preceding embodiments, wherein at least 35%, 40%, 45%, 50%, 55%, 60%, 65%, 70%, 75%, 80%, 85%, 90% or 95% of the internucleotidic linkages of the oligonucleotide are independently chiral internucleotidic linkages.

322. The composition of any one of the preceding embodiments, wherein at least 40%, 45%, 50%, 55%, 60%, 65%, 70%, 75%, 80%, 85%, 90% or 95% of the internucleotidic linkages of the oligonucleotide are independently chiral internucleotidic linkages.

323. The composition of any one of the preceding embodiments, wherein at least 45%, 50%, 55%, 60%, 65%, 70%, 75%, 80%, 85%, 90% or 95% of the internucleotidic linkages of the oligonucleotide are independently chiral internucleotidic linkages.

324. The composition of any one of the preceding embodiments, wherein at least 50%, 55%, 60%, 65%, 70%, 75%, 80%, 85%, 90% or 95% of the internucleotidic linkages of the oligonucleotide are independently chiral internucleotidic linkages.

325. The composition of any one of the preceding embodiments, wherein at least 55%, 60%, 65%, 70%, 75%, 80%, 85%, 90% or 95% of the internucleotidic linkages of the oligonucleotide are independently chiral internucleotidic linkages.

326. The composition of any one of the preceding embodiments, wherein at least 60%, 65%, 70%, 75%, 80%, 85%, 90% or 95% of the internucleotidic linkages of the oligonucleotide are independently chiral internucleotidic linkages.

327. The composition of any one of the preceding embodiments, wherein the oligonucleotide comprises at least one chirally controlled internucleotidic linkage.

328. The composition of any one of the preceding embodiments, wherein at least 65%, 70%, 75%, 80%, 85%, 90% or 95% of the internucleotidic linkages of the oligonucleotide are independently chiral internucleotidic linkages.

329. The composition of any one of the preceding embodiments, wherein at least 70%, 75%, 80%, 85%, 90% or 95% of the internucleotidic linkages of the oligonucleotide are independently chiral internucleotidic linkages.

330. The composition of any one of the preceding embodiments, wherein at least 75%, 80%, 85%, 90% or 95% of the internucleotidic linkages of the oligonucleotide are independently chiral internucleotidic linkages.

331. The composition of any one of the preceding embodiments, wherein at least 80%, 85%, 90% or 95% of the internucleotidic linkages of the oligonucleotide are independently chiral internucleotidic linkages.

332. The composition of any one of the preceding embodiments, wherein at least 85%, 90% or 95% of the internucleotidic linkages of the oligonucleotide are independently chiral internucleotidic linkages.

333. The composition of any one of the preceding embodiments, wherein at least 90% or 95% of the internucleotidic linkages of the oligonucleotide are independently chiral internucleotidic linkages.

334. The composition of any one of the preceding embodiments, wherein at least 95% of the internucleotidic linkages of the oligonucleotide are independently chiral internucleotidic linkages.

335. The composition of any one of embodiments 297-334, wherein at least one chiral internucleotidic linkage is a chirally controlled internucleotidic linkage.

336. The composition of any one of embodiments 297-334, wherein at least 5% of the chiral internucleotidic linkages are independently chirally controlled internucleotidic linkages.

337. The composition of any one of embodiments 297-334, wherein at least 10% of the chiral internucleotidic linkages are independently chirally controlled internucleotidic linkages.

338. The composition of any one of embodiments 297-334, wherein at least 15% of the chiral internucleotidic linkages are independently chirally controlled internucleotidic linkages.

339. The composition of any one of embodiments 297-334, wherein at least 20% of the chiral internucleotidic linkages are independently chirally controlled internucleotidic linkages.

340. The composition of any one of embodiments 297-334, wherein at least 25% of the chiral internucleotidic linkages are independently chirally controlled internucleotidic linkages.

341. The composition of any one of embodiments 297-334, wherein at least 30% of the chiral internucleotidic linkages are independently chirally controlled internucleotidic linkages.

342. The composition of any one of embodiments 297-334, wherein at least 35% of the chiral internucleotidic linkages are independently chirally controlled internucleotidic linkages.

343. The composition of any one of embodiments 297-334, wherein at least 40% of the chiral internucleotidic linkages are independently chirally controlled internucleotidic linkages.

344. The composition of any one of embodiments 297-334, wherein at least 45% of the chiral internucleotidic linkages are independently chirally controlled internucleotidic linkages.

345. The composition of any one of embodiments 297-334, wherein at least 50% of the chiral internucleotidic linkages are independently chirally controlled internucleotidic linkages.

346. The composition of any one of embodiments 297-334, wherein at least 55% of the chiral internucleotidic linkages are independently chirally controlled internucleotidic linkages.

347. The composition of any one of embodiments 297-334, wherein at least 60% of the chiral internucleotidic linkages are independently chirally controlled internucleotidic linkages.

348. The composition of any one of embodiments 297-334, wherein at least 65% of the chiral internucleotidic linkages are independently chirally controlled internucleotidic linkages.

349. The composition of any one of embodiments 297-334, wherein at least 60% of the chiral internucleotidic linkages are independently chirally controlled internucleotidic linkages.

350. The composition of any one of embodiments 297-334, wherein at least 70% of the chiral internucleotidic linkages are independently chirally controlled internucleotidic linkages.

351. The composition of any one of embodiments 297-334, wherein at least 75% of the chiral internucleotidic linkages are independently chirally controlled internucleotidic linkages.

352. The composition of any one of embodiments 297-334, wherein at least 80% of the chiral internucleotidic linkages are independently chirally controlled internucleotidic linkages.

353. The composition of any one of embodiments 297-334, wherein at least 85% of the chiral internucleotidic linkages are independently chirally controlled internucleotidic linkages.

354. The composition of any one of embodiments 297-334, wherein at least 90% of the chiral internucleotidic linkages are independently chirally controlled internucleotidic linkages.

355. The composition of any one of embodiments 297-334, wherein at least 95% of the chiral internucleotidic linkages are independently chirally controlled internucleotidic linkages.

356. The composition of any one of embodiments 297-334, wherein at least 5 of the chiral internucleotidic linkages are independently chirally controlled internucleotidic linkages.

357. The composition of any one of embodiments 297-334, wherein at least 10 of the chiral internucleotidic linkages are independently chirally controlled internucleotidic linkages.

358. The composition of any one of embodiments 297-334, wherein each chiral internucleotidic linkage is independently a chirally controlled internucleotidic linkage.

359. The composition of any one of the preceding embodiments, wherein the oligonucleotide comprises at least 1, 2, 3, 4, 5, 6, 7, 8, 9, 10, 11, 12, 13, 14, 15, 16, 17, 18, 19, 20 or 21 chirally controlled internucleotidic linkages each of which independently comprises a Sp linkage phosphorus chiral center.

360. The composition of any one of the preceding embodiments, wherein the oligonucleotide comprises at least 2 chirally controlled internucleotidic linkages each of which independently comprises a Sp linkage phosphorus chiral center.

361. The composition of any one of the preceding embodiments, wherein the oligonucleotide comprises at least 3 chirally controlled internucleotidic linkages each of which independently comprises a Sp linkage phosphorus chiral center.

362. The composition of any one of the preceding embodiments, wherein the oligonucleotide comprises at least 4 chirally controlled internucleotidic linkages each of which independently comprises a Sp linkage phosphorus chiral center.

363. The composition of any one of the preceding embodiments, wherein the oligonucleotide comprises at least 5 chirally controlled internucleotidic linkages each of which independently comprises a Sp linkage phosphorus chiral center.

364. The composition of any one of the preceding embodiments, wherein the oligonucleotide comprises at least 6 chirally controlled internucleotidic linkages each of which independently comprises a Sp linkage phosphorus chiral center.

365. The composition of any one of the preceding embodiments, wherein the oligonucleotide comprises at least 7 chirally controlled internucleotidic linkages each of which independently comprises a Sp linkage phosphorus chiral center.

366. The composition of any one of the preceding embodiments, wherein the oligonucleotide comprises at least 8 chirally controlled internucleotidic linkages each of which independently comprises a Sp linkage phosphorus chiral center.

367. The composition of any one of the preceding embodiments, wherein the oligonucleotide comprises at least 9 chirally controlled internucleotidic linkages each of which independently comprises a Sp linkage phosphorus chiral center.

368. The composition of any one of the preceding embodiments, wherein the oligonucleotide comprises at least 10 chirally controlled internucleotidic linkages each of which independently comprises a Sp linkage phosphorus chiral center.

369. The composition of any one of the preceding embodiments, wherein at least 5%, 10%, 15%, 20%, 25%, 30%, 35%, 40%, 45%, 50%, 55%, 60%, 65%, 70% 75%, 80%, 85%, 90%, or 95% of chirally controlled internucleotidic linkages independently comprise a Sp linkage phosphorus chiral center.

370. The composition of any one of the preceding embodiments, wherein at least 50%, 55%, 60%, 65%, 70% 75%, 80%, 85%, 90%, or 95% of chirally controlled internucleotidic linkages independently comprise a Sp linkage phosphorus chiral center.

371. The composition of any one of the preceding embodiments, wherein at least 90%, or 95% of chirally controlled internucleotidic linkages independently comprise a Sp linkage phosphorus chiral center.

372. The composition of any one of the preceding embodiments, wherein each chirally controlled internucleotidic linkage independently comprises a Sp linkage phosphorus chiral center.

373. The composition of any one of embodiments 1-371, wherein the oligonucleotide comprises at least one chirally controlled internucleotidic linkage which comprises a Rp linkage phosphorus chiral center.

374. The composition of any one of embodiments 1-371, wherein at least 5%, 10%, 15%, 20%, 25%, 30%, 35%, 40%, 45%, 50%, 55%, 60%, 65%, 70% 75%, 80%, 85%, 90%, or 95% of chirally controlled internucleotidic linkages independently comprise a Rp linkage phosphorus chiral center.

375. The composition of any one of embodiments 297-374, wherein the 5'-end internucleotidic linkage is a chirally controlled internucleotidic linkage.

376. The composition of any one of embodiments 297-375, wherein the 3'-end internucleotidic linkage is a chirally controlled internucleotidic linkage.

377. The composition of any one of embodiments 297-375, wherein an internucleotidic linkage immediately 3' of a nucleoside unit comprising a pyrimidine nucleobase is a chirally controlled internucleotidic linkage.

378. The composition of any one of embodiments 297-375, wherein each internucleotidic linkage immediately 3' of a nucleoside unit comprising a pyrimidine nucleobase is independently a chirally controlled internucleotidic linkage.

379. The composition of any one of embodiments 297-378, wherein an internucleotidic linkage immediately 5' of a nucleoside unit comprising a pyrimidine nucleobase is a chirally controlled internucleotidic linkage.
380. The composition of any one of embodiments 297-378, wherein each internucleotidic linkage immediately 5' of a nucleoside unit comprising a pyrimidine nucleobase is independently a chirally controlled internucleotidic linkage.
381. The composition of any one of embodiments 297-380, wherein an internucleotidic linkage linking two nucleotidic units each of which independently comprises a pyrimidine nucleobase is a chirally controlled internucleotidic linkage.
382. The composition of any one of embodiments 297-380, wherein each internucleotidic linkage linking two nucleotidic units each of which independently comprises a pyrimidine nucleobase is independently a chirally controlled internucleotidic linkage.
383. The composition of any one of embodiments 377-382, wherein a pyrimidine nucleobase is an optionally substituted nucleobase selected from cytosine, thymine and uracil.
384. The composition of any one of embodiments 377-382, wherein a pyrimidine nucleobase is selected from cytosine, thymine and uracil.
385. The composition of embodiment 381 or 382, wherein the two nucleotidic units each of which independently comprises a pyrimidine nucleobase are selected from 5'-UU-3', 5'-TU-3', 5'-CU-3', 5'-UT-3', 5'-TT-3', 5'-CT-3', 5'-UC-3', 5'-TC-3', and 5'-CC-3'.
386. The composition of any one of embodiments 297-385, wherein an internucleotidic linkage immediately 3' of the second, third, fourth, fifth, sixth, seventh, or eighth nucleoside units from the 5'-end is a chirally controlled internucleotidic linkage.
387. The composition of any one of embodiments 297-385, wherein each internucleotidic linkage immediately 3' of the second, third, fourth, fifth, sixth, seventh, and eighth nucleoside units from the 5'-end is independently a chirally controlled internucleotidic linkage.
388. The composition of any one of embodiments 297-387, wherein an internucleotidic linkage immediately 3' of any one of the ninth to the third last nucleoside units from the 5'-end is a chirally controlled internucleotidic linkage.
389. The composition of any one of embodiments 297-388, wherein each internucleotidic linkage immediately 3' of any one of the ninth to the third last nucleoside units from the 5'-end is independently a chirally controlled internucleotidic linkage.
390. The composition of any one of embodiments 375-389, wherein the chirally controlled internucleotidic linkage comprises a Sp linkage phosphorus chiral center.
391. The composition of any one of embodiments 359-391, wherein the linkage phosphorus chiral center has a diastereopurity of at least 70%, 75%, 80%, 85%, 90%, 91%, 92%, 93%, 94%, 95%, 96%, 97%, 98%, 99% or 99.5% within the composition.
392. The composition of any one of embodiments 359-391, wherein the linkage phosphorus chiral center has a diastereopurity of at least 85%, 90%, 91%, 92%, 93%, 94%, 95%, 96%, 97%, 98%, 99% or 99.5% within the composition.
393. The composition of any one of embodiments 359-391, wherein the linkage phosphorus chiral center has a diastereopurity of at least 90%, 91%, 92%, 93%, 94%, 95%, 96%, 97%, 98%, 99% or 99.5% within the composition.
394. The composition of any one of embodiments 359-391, wherein the linkage phosphorus chiral center has a diastereopurity of at least 95%, 96%, 97%, 98%, 99% or 99.5% within the composition.

395. The composition of any one of the preceding embodiments, wherein each internucleotidic linkage independently has the structure of formula I.

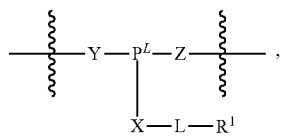

or a salt form thereof, wherein:
$P^L$ is $P(=W)$, P, or $P \rightarrow B(R')_3$;
W is O, S or Se;
$R^1$ is -L-R, halogen, —CN, —NO$_2$, —Si(R)$_3$, —OR, —SR, or —N(R)$_2$;
each of X, Y and Z is independently —O—, —S—, —N(-L-R$^1$), or L;
L is a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with an optionally substituted group selected from $C_{1-6}$ alkylene, $C_{1-6}$ alkenylene, —C≡C—, a bivalent $C_1$-$C_6$ heteroaliphatic group having 1-5 heteroatoms, —C(R')$_2$—, —Si(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]—, and one or more carbon atoms are optionally and independently replaced with Cy$^L$;
Cy$^L$ is an optionally substituted tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;
each R' is independently —R, —C(O)R, —C(O)OR, or —S(O)$_2$R;
each R is independently —H, or an optionally substituted group selected from $C_{1-20}$ aliphatic, $C_{1-20}$ heteroaliphatic having 1-10 heteroatoms, $C_{6-20}$ aryl, $C_{6-20}$ arylaliphatic, $C_{6-20}$ arylheteroaliphatic having 1-10 heteroatoms, 5-20 membered heteroaryl having 1-10 heteroatoms, and 3-20 membered heterocyclyl having 1-10 heteroatoms, or
two R groups on different atoms are optionally and independently taken together to form a covalent bond, or:
two or more R groups on the same atom are optionally and independently taken together with the atom to form an optionally substituted, 3-20 membered monocyclic, bicyclic or polycyclic ring having, in addition to the atom, 0-10 heteroatoms; or
two or more R groups on two or more atoms are optionally and independently taken together with their intervening atoms to form an optionally substituted, 3-20 membered monocyclic, bicyclic or polycyclic ring having, in addition to the intervening atoms, 0-10 heteroatoms.
396. The composition of any one of the preceding embodiments, wherein the oligonucleotide comprises one or more non-natural internucleotidic linkages, wherein each non-natural internucleotidic linkage independently has the structure of formula I:

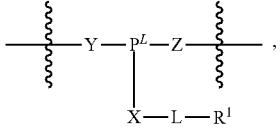

I or a salt form thereof, wherein:
$P^L$ is P(=W), P, or P→B(R')$_3$;
W is O, S or Se;
$R^1$ is -L-R, halogen, —CN, —NO$_2$, —Si(R)$_3$, —OR, —SR, or —N(R)$_2$;
each of X, Y and Z is independently —O—, —S—, —N(-L-R$^1$), or L;
L is a covalent bond, or a bivalent, optionally substituted, linear or branched group selected from a C$_{1-30}$ aliphatic group and a C$_{1-30}$ heteroaliphatic group having 1-10 heteroatoms, wherein one or more methylene units are optionally and independently replaced with an optionally substituted group selected from C$_{1-6}$ alkylene, C$_{1-6}$ alkenylene, —C≡C— a bivalent C$_1$-C$_6$ heteroaliphatic group having 1-5 heteroatoms, —Si(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—, and one or more carbon atoms are optionally and independently replaced with Cy$^L$;

Cy$^L$ is an optionally substituted tetravalent group selected from a C$_{3-20}$ cycloaliphatic ring, a C$_{6-20}$ aryl ring, a 5-20 membered heteroaryl ring having 1-10 heteroatoms, and a 3-20 membered heterocyclyl ring having 1-10 heteroatoms;
each R' is independently —R, —C(O)R, —C(O)OR, or —S(O)$_2$R;
each R is independently —H, or an optionally substituted group selected from C$_{1-20}$ aliphatic, C$_{1-20}$ heteroaliphatic having 1-10 heteroatoms, C$_{6-20}$ aryl, C$_{6-20}$ arylaliphatic, C$_{6-20}$ arylheteroaliphatic having 1-10 heteroatoms, 5-20 membered heteroaryl having 1-10 heteroatoms, and 3-20 membered heterocyclyl having 1-10 heteroatoms, or two R groups are optionally and independently taken together to form a covalent bond, or:

two or more R groups on the same atom are optionally and independently taken together with the atom to form an optionally substituted, 3-20 membered monocyclic, bicyclic or polycyclic ring having, in addition to the atom, 0-10 heteroatoms; or two or more R groups on two or more atoms are optionally and independently taken together with their intervening atoms to form an optionally substituted, 3-20 membered monocyclic, bicyclic or polycyclic ring having, in addition to the intervening atoms, 0-10 heteroatoms;

wherein

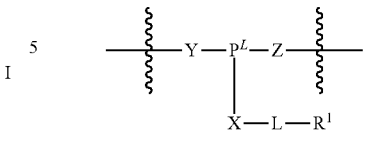

is not —O—P(O)(OH)—O— or a salt form thereof.
397. The composition of any one of the preceding embodiments, wherein the oligonucleotide comprises one or more chiral internucleotidic linkages, each chiral internucleotidic linkage independently has the structure of formula I:

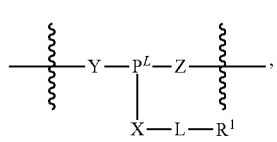

I or a salt form thereof, wherein:
$P^L$ is P(=W), P, or P→B(R')$_3$, wherein the P atom is chiral;
W is O, S or Se;
$R^1$ is -L-R, halogen, —CN, —NO$_2$, —Si(R)$_3$, —OR, —SR, or —N(R)$_2$;
each of X, Y and Z is independently —O—, —S—, —N(-L-R$^1$), or L;
L is a covalent bond, or a bivalent, optionally substituted, linear or branched group selected from a C$_{1-30}$ aliphatic group and a C$_{1-30}$ heteroaliphatic group having 1-10 heteroatoms, wherein one or more methylene units are optionally and independently replaced with an optionally substituted group selected from C$_{1-6}$ alkylene, C$_{1-6}$ alkenylene, a bivalent C$_1$-C$_6$ heteroaliphatic group having 1-5 heteroatoms, —Si(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—, and one or more carbon atoms are optionally and independently replaced with Cy$^L$;

Cy$^L$ is an optionally substituted tetravalent group selected from a C$_{3-20}$ cycloaliphatic ring, a C$_{6-20}$ aryl ring, a 5-20 membered heteroaryl ring having 1-10 heteroatoms, and a 3-20 membered heterocyclyl ring having 1-10 heteroatoms;
each R' is independently —R, —C(O)R, —C(O)OR, or —S(O)$_2$R;
each R is independently —H, or an optionally substituted group selected from C$_{1-20}$ aliphatic, C$_{1-20}$ heteroaliphatic having 1-10 heteroatoms, C$_{6-20}$ aryl, C$_{6-20}$ arylaliphatic, C$_{6-20}$ arylheteroaliphatic having 1-10 heteroatoms, 5-20 membered heteroaryl having 1-10 heteroatoms, and 3-20 membered heterocyclyl having 1-10 heteroatoms, or two R groups are optionally and independently taken together to form a covalent bond, or:

two or more R groups on the same atom are optionally and independently taken together with the atom to form an optionally substituted, 3-20 membered monocyclic, bicyclic or polycyclic ring having, in addition to the atom, 0-10 heteroatoms; or two or more R groups on two or more atoms are optionally and independently taken together with their intervening atoms to form an optionally substituted, 3-20 membered monocyclic, bicyclic or polycyclic ring having, in addition to the intervening atoms, 0-10 heteroatoms.

398. The composition of any one of the preceding embodiments, wherein the oligonucleotide comprises one or more chirally controlled internucleotidic linkages, wherein each chirally controlled internucleotidic linkage independently has the structure of formula I:

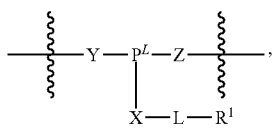

I or a salt form thereof, wherein:
$P^L$ is P(=W), P, or P→B(R')$_3$, wherein the P atom is chiral;
W is O, S or Se;
$R^1$ is -L-R, halogen, —CN, —NO$_2$, —Si(R)$_3$, —OR, —SR, or —N(R)$_2$;
each of X, Y and Z is independently —O—, —S—, —N(-L-R$^1$), or L;
L is a covalent bond, or a bivalent, optionally substituted, linear or branched group selected from a C$_{1-30}$ aliphatic group and a C$_{1-30}$ heteroaliphatic group having 1-10 heteroatoms, wherein one or more methylene units are optionally and independently replaced with an optionally substituted group selected from C$_{1-6}$ alkylene, C$_{1-6}$ alkenylene, —C≡C—, a bivalent C$_1$-C$_6$ heteroaliphatic group having 1-5 heteroatoms, —C(R')$_2$—, —Si(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—, and one or more carbon atoms are optionally and independently replaced with Cy$^L$;
Cy$^L$ is an optionally substituted tetravalent group selected from a C$_{3-20}$ cycloaliphatic ring, a C$_{6-20}$ aryl ring, a 5-20 membered heteroaryl ring having 1-10 heteroatoms, and a 3-20 membered heterocyclyl ring having 1-10 heteroatoms;
each R' is independently —R, —C(O)R, —C(O)OR, or —S(O)$_2$R;
each R is independently —H, or an optionally substituted group selected from C$_{1-20}$ aliphatic, C$_{1-20}$ heteroaliphatic having 1-10 heteroatoms, C$_{6-20}$ aryl, C$_{6-20}$ arylaliphatic, C$_{6-20}$ arylheteroaliphatic having 1-10 heteroatoms, 5-20 membered heteroaryl having 1-10 heteroatoms, and 3-20 membered heterocyclyl having 1-10 heteroatoms, or
two R groups are optionally and independently taken together to form a covalent bond, or:
two or more R groups on the same atom are optionally and independently taken together with the atom to form an optionally substituted, 3-20 membered monocyclic, bicyclic or polycyclic ring having, in addition to the atom, 0-10 heteroatoms; or two or more R groups on two or more atoms are optionally and independently taken together with their intervening atoms to form an optionally substituted, 3-20 membered monocyclic, bicyclic or polycyclic ring having, in addition to the intervening atoms, 0-10 heteroatoms.

399. The composition of any one of embodiments 395-398, wherein for at least one internucleotidic linkage having the structure of formula I, $P^L$ is P(=W), wherein W is O.

400. The composition of any one of embodiments 395-399, wherein for at least one internucleotidic linkage having the structure of formula I, $P^L$ is P(=W), wherein W is S.

401. The composition of any one of embodiments 395-400, wherein for at least one internucleotidic linkage having the structure of formula I, $P^L$ is P.

402. The composition of any one of embodiments 395-401, wherein for at least one internucleotidic linkage having the structure of formula I, $P^L$ P→B(R')$_3$.

403. The composition of any one of embodiments 395-398, wherein for each internucleotidic linkage having the structure of formula I, $P^L$ is P(=W), wherein W is O.

404. The composition of any one of embodiments 395-398, wherein for each internucleotidic linkage having the structure of formula I, $P^L$ is P(=W), wherein W is S.

405. The composition of any one of embodiments 395-398, wherein for each internucleotidic linkage having the structure of formula I, $P^L$ is P.

406. The composition of any one of embodiments 395-398, wherein for each internucleotidic linkage having the structure of formula I, $P^L$ is independently P→B(R')$_3$.

407. The composition of any one of embodiments 395-406, wherein for at least one internucleotidic linkage having the structure of formula I, $R^1$ is optionally substituted 3-20 membered heterocyclyl having 1-10 heteroatoms.

408. The composition of any one of embodiments 395-406, wherein for each internucleotidic linkage having the structure of formula I, $R^1$ is optionally substituted 3-20 membered heterocyclyl having 1-10 heteroatoms.

409. The composition of embodiment 407 or 408, wherein $R^1$ is optionally substituted 3-20 membered heterocyclyl having 1-10 heteroatoms, wherein at least one heteroatom is nitrogen.

410. The composition of embodiment 407 or 408, wherein $R^1$ is optionally substituted 3-6 membered heterocyclyl having 1-10 heteroatoms, wherein at least one heteroatom is nitrogen.

411. The composition of embodiment 407 or 408, wherein $R^1$ is optionally substituted 3-6 membered heterocyclyl having no more than one heteroatom, wherein the heteroatom is nitrogen.

412. The composition of embodiment 407 or 408, wherein $R^1$ is optionally substituted 5-membered heterocyclyl having no more than one heteroatom, wherein the heteroatom is nitrogen.

413. The composition of embodiment 412, wherein $R^1$ is optionally substituted

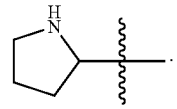 [SMILES: *C1CCCN1]

414. The composition of embodiment 412, wherein R¹ is

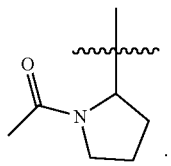 [SMILES: *C1CCCN1C(C)=O]

415. The composition of any one of embodiments 395-406, wherein for at least one internucleotidic linkage having the structure of formula I, R¹ is —Si(R)₃.
416. The composition of any one of embodiments 395-406, wherein for each internucleotidic linkage having the structure of formula I, R¹ is —Si(R)₃.
417. The composition of embodiment 415 or 416, wherein —Si(R)₃ is —SiMe(Ph)₂.
418. The composition of any one of embodiments 395-406, wherein R¹ is R.
419. The composition of any one of embodiments 395-406, wherein R¹ is H.
420. The composition of any one of embodiments 395-417, wherein for at least one internucleotidic linkage having the structure of formula I, Y is O.
421. The composition of any one of embodiments 395-417, wherein for each internucleotidic linkage having the structure of formula I, Y is O.
422. The composition of any one of embodiments 395-421, wherein for at least one internucleotidic linkage having the structure of formula I, Z is O.
423. The composition of any one of embodiments 395-421, wherein for at least one internucleotidic linkage having the structure of formula I, Z is O and Y is O.
424. The composition of any one of embodiments 395-422, wherein for each internucleotidic linkage having the structure of formula I, Z is O.
425. The composition of any one of embodiments 395-424, wherein for at least one internucleotidic linkage having the structure of formula I, X is O.
426. The composition of any one of embodiments 395-425, wherein for at least one internucleotidic linkage having the structure of formula I, X is S.
427. The composition of any one of embodiments 395-424, wherein for each internucleotidic linkage having the structure of formula I, X is O.
428. The composition of any one of embodiments 395-424, wherein for each internucleotidic linkage having the structure of formula I, X is S.
429. The composition of any one of embodiments 395-428, wherein for at least one internucleotidic linkage having the structure of formula I, L is bivalent, optionally substituted, linear or branched $C_{1-30}$ aliphatic group, wherein at least one methylene unit of L is replaced with —N(R')—.
430. The composition of embodiment 429, wherein R' is —C(O)R.
431. The composition of embodiment 429, wherein R' is —C(O)Me.
432. The composition of embodiment 429, wherein R' is —H.
433. The composition of any one of embodiments 429-432, wherein for at least one internucleotidic linkage having the structure of formula I, L is bivalent, optionally substituted, linear or branched $C_{1-30}$ aliphatic group, wherein at least one carbon atom of L is replaced with $Cy^L$.
434. The composition of embodiment 433, wherein $Cy^L$ is an optionally substituted 3-20 membered heterocyclyl ring having 1-10 heteroatoms.
435. The composition of embodiment 433, wherein $Cy^L$ is an optionally substituted 4-6 membered heterocyclyl ring having no more than one heteroatom, wherein the heteroatom is nitrogen.
436. The composition of embodiment 433, wherein $Cy^L$ is an optionally substituted 5-membered heterocyclyl ring having no more than one heteroatom, wherein the heteroatom is nitrogen.
437. The composition of any one of embodiments 433-436, wherein the heterocyclyl ring is saturated.
438. The composition of any one of embodiments 395-437, wherein for at least one internucleotidic linkage having the structure of formula I, L is bivalent, optionally substituted, linear or branched $C_{1-30}$ aliphatic group, wherein at least one methylene unit is replaced with —C(R')₂—, wherein one R' is optionally substituted phenyl.
439. The composition of embodiment 438, wherein R' is phenyl.
440. The composition of any one of embodiments 395-439, wherein for at least one internucleotidic linkage having the structure of formula I, L is bivalent, optionally substituted, linear or branched $C_{1-30}$ aliphatic group, wherein at least one methylene unit is replaced with —Si(R')₂—, wherein one R' is optionally substituted phenyl.
441. The composition of embodiment 440, wherein R' is phenyl.
442. The composition of any one of embodiments 395-440, wherein for at least one internucleotidic linkage having the structure of formula I, L is bivalent, optionally substituted, linear or branched $C_{1-30}$ aliphatic group, wherein at least one methylene unit is replaced with —Si(R')₂—, wherein each R' is independently optionally substituted phenyl.
443. The composition of any one of embodiments 395-440, wherein for at least one internucleotidic linkage having the structure of formula I, L is bivalent, optionally substituted, linear or branched $C_{1-30}$ aliphatic group, wherein at least one methylene unit is replaced with —Si(R')₂—, wherein each R' is phenyl.
444. The composition of any one of embodiments 395-443, wherein for each internucleotidic linkage having the structure of formula I, L is bivalent, optionally substituted, linear or branched $C_{1-30}$ aliphatic group, wherein at least one methylene unit of L is replaced with —N(R')—.
445. The composition of embodiment 444, wherein R' is —C(O)R.
446. The composition of embodiment 444, wherein R' is —C(O)Me.
447. The composition of embodiment 444, wherein R' is —H.
448. The composition of any one of embodiments 395-447, wherein for each internucleotidic linkage having the structure of formula I, L is bivalent, optionally substituted, linear or branched $C_{1-30}$ aliphatic group, wherein at least one carbon atom of L is replaced with $Cy^L$.
449. The composition of embodiment 448, wherein $Cy^L$ is an optionally substituted 3-20 membered heterocyclyl ring having 1-10 heteroatoms.
450. The composition of embodiment 448, wherein $Cy^L$ is an optionally substituted 4-6 membered heterocyclyl ring having no more than one heteroatom, wherein the heteroatom is nitrogen.
451. The composition of embodiment 448, wherein $Cy^L$ is an optionally substituted 5-membered heterocyclyl ring having no more than one heteroatom, wherein the heteroatom is nitrogen.
452. The composition of any one of embodiments 448-451, wherein the heterocyclyl ring is saturated.

453. The composition of any one of embodiments 395-452, wherein for each internucleotidic linkage having the structure of formula I, L is bivalent, optionally substituted, linear or branched $C_{1-30}$ aliphatic group, wherein at least one methylene unit is replaced with —C(R')$_2$—, wherein one R' is optionally substituted phenyl.

454. The composition of embodiment 453, wherein for each internucleotidic linkage having the structure of formula I, L is bivalent, optionally substituted, linear or branched $C_{1-30}$ aliphatic group, wherein at least one methylene unit is replaced with —C(R')$_2$—, wherein one R' is phenyl.

455. The composition of any one of embodiments 395-454, wherein for each internucleotidic linkage having the structure of formula I, L is bivalent, optionally substituted, linear or branched $C_{1-30}$ aliphatic group, wherein at least one methylene unit is replaced with —Si(R')$_2$—, wherein one R' is optionally substituted phenyl.

456. The composition of embodiment 455, wherein for each internucleotidic linkage having the structure of formula I, L is bivalent, optionally substituted, linear or branched $C_{1-30}$ aliphatic group, wherein at least one methylene unit is replaced with —Si(R')$_2$—, wherein one R' is phenyl.

457. The composition of embodiment 455, wherein for each internucleotidic linkage having the structure of formula I, L is bivalent, optionally substituted, linear or branched $C_{1-30}$ aliphatic group, wherein at least one methylene unit is optionally replaced with —Si(R')$_2$—, wherein each R' is independently optionally substituted phenyl.

458. The composition of embodiment 455, wherein for each internucleotidic linkage having the structure of formula I, L is bivalent, optionally substituted, linear or branched $C_{1-30}$ aliphatic group, wherein at least one methylene unit is optionally replaced with —Si(R')$_2$—, wherein each R' is independently phenyl.

459. The composition of any one of embodiments 395-443, wherein for at least one internucleotidic linkage having the structure of formula I, L is a covalent bond.

460. The composition of any one of embodiments 395-428, wherein for each internucleotidic linkage having the structure of formula I, L is a covalent bond.

461. The composition of any one of embodiments 395-443, wherein for at least one internucleotidic linkage having the structure of formula I, L is bivalent, optionally substituted, linear or branched $C_{1-30}$ aliphatic group.

462. The composition of any one of embodiments 395-428, wherein for each internucleotidic linkage having the structure of formula I, L is bivalent, optionally substituted, linear or branched $C_{1-30}$ aliphatic group.

463. The composition of any one of embodiments 395-406, wherein for at least one internucleotidic linkage having the structure of formula I, —X-L-R$^1$ is —SH.

464. The composition of any one of embodiments 395-463, wherein for at least one internucleotidic linkage having the structure of formula I, —X-L-R$^1$ is —SR$^I$, wherein R is not hydrogen.

465. The composition of any one of embodiments 395-406 and 463-464, wherein for at least one internucleotidic linkage having the structure of formula I, —X-L-R$^1$ is —OH.

466. The composition of any one of embodiments 395-406 and 463-465, wherein for at least one internucleotidic linkage having the structure of formula I, —X-L-R' is —O—C(R')$_2$-Cy$^L$-(H)$_3$.

467. The composition of any one of embodiments 395-406 and 463-465, wherein for at least one internucleotidic linkage having the structure of formula I, —X-L-R' is —O—C(R')$_2$-Cy$^L$-(H)$_3$, wherein Cy$^L$ is optionally substituted 3-20 membered heterocyclyl having 1-10 heteroatoms.

468. The composition of embodiment 467, wherein Cy$^L$ is optionally substituted, 3-6 membered, saturated heterocyclyl having no more than one heteroatom, wherein the heteroatom is nitrogen.

469. The composition of embodiment 467, wherein Cy$^L$ is tetravalent, optionally substituted, 5-membered, saturated heterocyclyl having no more than one heteroatom, wherein the heteroatom is nitrogen.

470. The composition of any one of embodiments 395-406 and 463-469, wherein for at least one internucleotidic linkage having the structure of formula I, —X-L-R$^1$ is

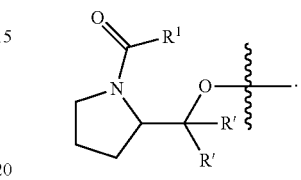

471. The composition of embodiment 470, wherein R$^1$ is R.
472. The composition of embodiment 470, wherein R$^1$ is —CH$_3$.
473. The composition of any one of embodiments 470-472, wherein one R' is —H.
474. The composition of embodiment 473, wherein the other R' is optionally substituted phenyl.
475. The composition of embodiment 473, wherein the other R' is phenyl.
476. The composition of embodiment 473, wherein the other R' is —CH$_2$SiPh$_2$Me.
477. The composition of any one of embodiments 470-472, wherein one R' is optionally substituted $C_{1-6}$ alkyl.
478. The composition of any one of embodiments 470-472, wherein one R' methyl.
479. The composition of embodiment 477 or 478, wherein the other R' is optionally substituted phenyl.
480. The composition of embodiment 479, wherein the other R' is phenyl.
481. The composition of any one of embodiments 395-406 and 463-480, wherein for at least one internucleotidic linkage having the structure of formula I, —X-L-R' is —O—C(R')$_2$—C(R')$_2$—Si(R)$_3$.
482. The composition of embodiment 481, wherein —X-L-R' is —O—CHR'—C(R')$_2$—Si(R)$_3$.
483. The composition of embodiment 481, wherein —X-L-R' is —O—CHR'—CH$_2$—Si(R)$_3$.
484. The composition of any one of embodiments 481 to 483, wherein one R' of —O—C(R')$_2$— is optionally substituted 3-20 membered heterocyclyl having 1-10 heteroatoms.
485. The composition of embodiment 484, wherein one R' of —O—C(R')$_2$— is optionally substituted 4-6 membered heterocyclyl having 1-2 heteroatoms.
486. The composition of embodiment 484, wherein one R' of —O—C(R')$_2$— is optionally substituted 5-membered heterocyclyl having no more than one heteroatom, wherein the heteroatom is nitrogen.
487. The composition of embodiment 484, wherein one R' of —O—C(R')$_2$— is optionally substituted 2'-pyrrolidinyl.
488. The composition of any one of embodiments 481-487, wherein each R of —Si(R)$_3$ is independently an optionally substituted group selected from $C_{1-6}$ aliphatic and phenyl.
489. The composition of embodiment 488, wherein —Si(R)$_3$ is —SiPh$_2$Me.

490. The composition of any one of embodiments 395-406, wherein for each internucleotidic linkage having the structure of formula I, —X-L-R$^1$ is —SH.
491. The composition of any one of embodiments 395-406, wherein for each internucleotidic linkage having the structure of formula I, —X-L-R$^1$ is —SR$^I$, wherein R$^1$ is not hydrogen.
492. The composition of any one of embodiments 395-406, wherein for each internucleotidic linkage having the structure of formula I, —X-L-R$^1$ is —OH.
493. The composition of any one of embodiments 395-406, wherein for each internucleotidic linkage having the structure of formula I, —X-L-R$^1$ is —O—C(R')$_2$-Cy$^L$-(H)$_3$.
494. The composition of any one of embodiments 395-406, wherein for each internucleotidic linkage having the structure of formula I, —X-L-R$^1$ is —O—C(R')$_2$-Cy$^L$-(H)$_3$, wherein Cy$^L$ is optionally substituted 3-20 membered heterocyclyl having 1-10 heteroatoms.
495. The composition of embodiment 494, wherein Cy$^L$ is optionally substituted, 3-6 membered, saturated heterocyclyl having no more than one heteroatom, wherein the heteroatom is nitrogen.
496. The composition of embodiment 494, wherein Cy$^L$ is optionally substituted, 5-membered, saturated heterocyclyl having no more than one heteroatom, wherein the heteroatom is nitrogen.
497. The composition of any one of embodiments 395-406, wherein for each internucleotidic linkage having the structure of formula I, —X-L-R$^1$ is

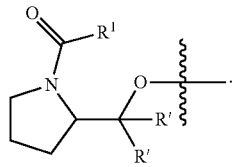

498. The composition of embodiment 497, wherein R$^1$ is R.
499. The composition of embodiment 497, wherein R$^1$ is —CH$_3$.
500. The composition of any one of embodiments 497-499, wherein one R' is —H.
501. The composition of embodiment 500, wherein the other R' is optionally substituted phenyl.
502. The composition of embodiment 500, wherein the other R' is phenyl.
503. The composition of embodiment 500, wherein the other R' is —CH$_2$SiPh$_2$Me.
504. The composition of any one of embodiments 470-499, wherein one R' is optionally substituted C$_{1-6}$ alkyl.
505. The composition of any one of embodiments 470-499, wherein one R' methyl.
506. The composition of embodiment 504 or 505, wherein the other R' is optionally substituted phenyl.
507. The composition of embodiment 506, wherein the other R' is phenyl.
508. The composition of any one of embodiments 395-406, wherein for each internucleotidic linkage having the structure of formula I, —X-L-R$^1$ is —O—C(R')$_2$—C(R')$_2$—Si(R)$_3$.
509. The composition of embodiment 508, wherein —X-L-R$^1$ is —O—CHR'—C(R')$_2$—Si(R)$_3$.
510. The composition of embodiment 508, wherein —X-L-R$^1$ is —O—CHR'—CH$_2$—Si(R)$_3$.
511. The composition of any one of embodiments 508 to 510, wherein one R' of —O—C(R')$_2$— is optionally substituted 3-20 membered heterocyclyl having 1-10 heteroatoms.
512. The composition of embodiment 511, wherein one R' of —O—C(R')$_2$— is optionally substituted 4-6 membered heterocyclyl having 1-2 heteroatoms.
513. The composition of embodiment 511, wherein one R' of —O—C(R')$_2$— is optionally substituted 5-membered heterocyclyl having no more than one heteroatom, wherein the heteroatom is nitrogen.
514. The composition of embodiment 511, wherein one R' of —O—C(R')$_2$— is optionally substituted 2'-pyrrolidinyl.
515. The composition of any one of embodiments 508-514, wherein each R of —Si(R)$_3$ is independently an optionally substituted group selected from C$_{1-6}$ aliphatic and phenyl.
516. The composition of embodiment 515, wherein —Si(R)$_3$ is —SiPh$_2$Me.
517. The composition of any one of embodiments 395-398, wherein the structure of formula I is —O—P(O)(SH)—O— or a salt form thereof.
518. The composition of any one of embodiments 395-517, wherein each internucleotidic linkage of the oligonucleotide is independently a non-natural internucleotidic linkage.
519. The composition of any one of embodiments 397-517, wherein each internucleotidic linkage of the oligonucleotide is independently a chiral internucleotidic linkage.
520. The composition of any one of embodiments 398-517, wherein each internucleotidic linkage of the oligonucleotide is independently a chirally controlled internucleotidic linkage.
521. The composition of any one of embodiments 77-517, wherein the oligonucleotide further comprises at least 1, 2, 3, 4, 5, 6, 7, 8, 9, 10, 11, 12, 13, 14, or 15 natural phosphate linkages.
522. The composition of embodiment 521, wherein the oligonucleotide further comprises at least 2, 3, 4, 5, 6, 7, 8, 9, 10, 11, 12, 13, 14, or 15 natural phosphate linkages.
523. The composition of embodiment 521, wherein the oligonucleotide further comprises at least 3, 4, 5, 6, 7, 8, 9, 10, 11, 12, 13, 14, or 15 natural phosphate linkages.
524. The composition of embodiment 521, wherein the oligonucleotide further comprises at least 4, 5, 6, 7, 8, 9, 10, 11, 12, 13, 14, or 15 natural phosphate linkages.
525. The composition of embodiment 521, wherein the oligonucleotide further comprises at least 5, 6, 7, 8, 9, 10, 11, 12, 13, 14, or 15 natural phosphate linkages.
526. The composition of embodiment 521, wherein the oligonucleotide further comprises at least 6, 7, 8, 9, 10, 11, 12, 13, 14, or 15 natural phosphate linkages.
527. The composition of embodiment 521, wherein the oligonucleotide further comprises at least 7, 8, 9, 10, 11, 12, 13, 14, or 15 natural phosphate linkages.
528. The composition of embodiment 521, wherein the oligonucleotide further comprises at least 8, 9, 10, 11, 12, 13, 14, or 15 natural phosphate linkages.
529. The composition of embodiment 521, wherein the oligonucleotide further comprises at least 8, 9, 10, 11, 12, 13, 14, or 15 natural phosphate linkages.
530. The composition of embodiment 521, wherein the oligonucleotide further comprises at least 10, 11, 12, 13, 14, or 15 natural phosphate linkages.
531. The composition of embodiment 521, wherein the oligonucleotide further comprises at least 11, 12, 13, 14, or 15 natural phosphate linkages.
532. The composition of embodiment 521, wherein the oligonucleotide further comprises at least 12, 13, 14, or 15 natural phosphate linkages.

533. The composition of embodiment 521, wherein the oligonucleotide further comprises at least 13, 14, or 15 natural phosphate linkages.
534. The composition of embodiment 521, wherein the oligonucleotide further comprises at least 14, or 15 natural phosphate linkages.
535. The composition of embodiment 521, wherein the oligonucleotide further comprises at least 15 natural phosphate linkages.
536. The composition of embodiment 521, wherein the oligonucleotide further comprises at least 2, 3, 4, 5, 6, 7, 8, 9, 10, 11, 12, 13, 14, or 15 consecutive natural phosphate linkages.
537. The composition of embodiment 521, wherein the oligonucleotide further comprises at least 3, 4, 5, 6, 7, 8, 9, 10, 11, 12, 13, 14, or 15 consecutive natural phosphate linkages.
538. The composition of embodiment 521, wherein the oligonucleotide further comprises at least 4, 5, 6, 7, 8, 9, 10, 11, 12, 13, 14, or 15 consecutive natural phosphate linkages.
539. The composition of embodiment 521, wherein the oligonucleotide further comprises at least 5, 6, 7, 8, 9, 10, 11, 12, 13, 14, or 15 consecutive natural phosphate linkages.
540. The composition of embodiment 521, wherein the oligonucleotide further comprises at least 6, 7, 8, 9, 10, 11, 12, 13, 14, or 15 consecutive natural phosphate linkages.
541. The composition of embodiment 521, wherein the oligonucleotide further comprises at least 7, 8, 9, 10, 11, 12, 13, 14, or 15 consecutive natural phosphate linkages.
542. The composition of embodiment 521, wherein the oligonucleotide further comprises at least 8, 9, 10, 11, 12, 13, 14, or 15 consecutive natural phosphate linkages.
543. The composition of embodiment 521, wherein the oligonucleotide further comprises at least 8, 9, 10, 11, 12, 13, 14, or 15 consecutive natural phosphate linkages.
544. The composition of embodiment 521, wherein the oligonucleotide further comprises at least 10, 11, 12, 13, 14, or 15 consecutive natural phosphate linkages.
545. The composition of embodiment 521, wherein the oligonucleotide further comprises at least 11, 12, 13, 14, or 15 consecutive natural phosphate linkages.
546. The composition of embodiment 521, wherein the oligonucleotide further comprises at least 12, 13, 14, or 15 consecutive natural phosphate linkages.
547. The composition of embodiment 521, wherein the oligonucleotide further comprises at least 13, 14, or 15 consecutive natural phosphate linkages.
548. The composition of embodiment 521, wherein the oligonucleotide further comprises at least 14, or 15 consecutive natural phosphate linkages.
549. The composition of embodiment 521, wherein the oligonucleotide further comprises at least 15 consecutive natural phosphate linkages.
550. The composition of any one of the preceding embodiments, wherein at least 1, 2, 3, 4, 5, 6, 7, 8, 9, 10, 11, 12, 13, 14, 15, 16, 17, 18, 19, 20, 21, 22, 23, 24, or 25 nucleotidic units of the oligonucleotide independently comprise a 2'-substitution.
551. The composition of any one of the preceding embodiments, wherein at least 2 nucleotidic units of the oligonucleotide independently comprise a 2'-substitution.
552. The composition of any one of the preceding embodiments, wherein at least 3 nucleotidic units of the oligonucleotide independently comprise a 2'-substitution.
553. The composition of any one of the preceding embodiments, wherein at least 4 nucleotidic units of the oligonucleotide independently comprise a 2'-substitution.
554. The composition of any one of the preceding embodiments, wherein at least 5 nucleotidic units of the oligonucleotide independently comprise a 2'-substitution.
555. The composition of any one of the preceding embodiments, wherein at least 6 the nucleotidic units of the oligonucleotide independently comprise a 2'-substitution.
556. The composition of any one of the preceding embodiments, wherein at least 7 nucleotidic units of the oligonucleotide independently comprise a 2'-substitution.
557. The composition of any one of the preceding embodiments, wherein at least 8 nucleotidic units of the oligonucleotide independently comprise a 2'-substitution.
558. The composition of any one of the preceding embodiments, wherein at least 9 nucleotidic units of the oligonucleotide independently comprise a 2'-substitution.
559. The composition of any one of the preceding embodiments, wherein at least 10 nucleotidic units of the oligonucleotide independently comprise a 2'-substitution.
560. The composition of any one of the preceding embodiments, wherein at least 11 the nucleotidic units of the oligonucleotide independently comprise a 2'-substitution.
561. The composition of any one of the preceding embodiments, wherein at least 12 the nucleotidic units of the oligonucleotide independently comprise a 2'-substitution.
562. The composition of any one of the preceding embodiments, wherein at least 13 nucleotidic units of the oligonucleotide independently comprise a 2'-substitution.
563. The composition of any one of the preceding embodiments, wherein at least 14 nucleotidic units of the oligonucleotide independently comprise a 2'-substitution.
564. The composition of any one of the preceding embodiments, wherein at least 15 nucleotidic units of the oligonucleotide independently comprise a 2'-substitution.
565. The composition of any one of the preceding embodiments, wherein at least 16 nucleotidic units of the oligonucleotide independently comprise a 2'-substitution.
566. The composition of any one of the preceding embodiments, wherein at least 17 the nucleotidic units of the oligonucleotide independently comprise a 2'-substitution.
567. The composition of any one of the preceding embodiments, wherein at least 18 the nucleotidic units of the oligonucleotide independently comprise a 2'-substitution.
568. The composition of any one of the preceding embodiments, wherein at least 19 nucleotidic units of the oligonucleotide independently comprise a 2'-substitution.
569. The composition of any one of the preceding embodiments, wherein at least 20 the nucleotidic units of the oligonucleotide independently comprise a 2'-substitution.
570. The composition of any one of the preceding embodiments, wherein at least 3%, 5%, 10%, 15%, 20%, 25%, 30%, 35%, 40%, 45%, 50%, 55%, 60%, 65%, 70%, 75%, 80%, 85%, 90%, 95%, or 97% of the nucleotidic units of the oligonucleotide independently comprise a 2'-substitution.
571. The composition of any one of the preceding embodiments, wherein at least 10% of the nucleotidic units of the oligonucleotide independently comprise a 2'-substitution.
572. The composition of any one of the preceding embodiments, wherein at least 15% of the nucleotidic units of the oligonucleotide independently comprise a 2'-substitution.
573. The composition of any one of the preceding embodiments, wherein at least 20% of the nucleotidic units of the oligonucleotide independently comprise a 2'-substitution.
574. The composition of any one of the preceding embodiments, wherein at least 25% of the nucleotidic units of the oligonucleotide independently comprise a 2'-substitution.

575. The composition of any one of the preceding embodiments, wherein at least 30% of the nucleotidic units of the oligonucleotide independently comprise a 2'-substitution.
576. The composition of any one of the preceding embodiments, wherein at least 35% of the nucleotidic units of the oligonucleotide independently comprise a 2'-substitution.
577. The composition of any one of the preceding embodiments, wherein at least 40% of the nucleotidic units of the oligonucleotide independently comprise a 2'-substitution.
578. The composition of any one of the preceding embodiments, wherein at least 45% of the nucleotidic units of the oligonucleotide independently comprise a 2'-substitution.
579. The composition of any one of the preceding embodiments, wherein at least 50% of the nucleotidic units of the oligonucleotide independently comprise a 2'-substitution.
580. The composition of any one of the preceding embodiments, wherein at least 55% of the nucleotidic units of the oligonucleotide independently comprise a 2'-substitution.
581. The composition of any one of the preceding embodiments, wherein at least 60% of the nucleotidic units of the oligonucleotide independently comprise a 2'-substitution.
582. The composition of any one of the preceding embodiments, wherein at least 65% of the nucleotidic units of the oligonucleotide independently comprise a 2'-substitution.
583. The composition of any one of the preceding embodiments, wherein at least 70% of the nucleotidic units of the oligonucleotide independently comprise a 2'-substitution.
584. The composition of any one of the preceding embodiments, wherein at least 75% of the nucleotidic units of the oligonucleotide independently comprise a 2'-substitution.
585. The composition of any one of the preceding embodiments, wherein at least 80% of the nucleotidic units of the oligonucleotide independently comprise a 2'-substitution.
586. The composition of any one of the preceding embodiments, wherein at least 85% of the nucleotidic units of the oligonucleotide independently comprise a 2'-substitution.
587. The composition of any one of the preceding embodiments, wherein at least 90% of the nucleotidic units of the oligonucleotide independently comprise a 2'-substitution.
588. The composition of any one of the preceding embodiments, wherein at least 95% of the nucleotidic units of the oligonucleotide independently comprise a 2'-substitution.
589. The composition of any one of the preceding embodiments, wherein at least 97% of the nucleotidic units of the oligonucleotide independently comprise a 2'-substitution.
590. The composition of any one of the preceding embodiments, wherein a 2'-substitution of the oligonucleotide is 2'-R'.
591. The composition of any one of the preceding embodiments, wherein a 2'-substitution of the oligonucleotide is 2'-F.
592. The composition of any one of the preceding embodiments, wherein a 2'-substitution of the oligonucleotide is 2'—OR'.
593. The composition of any one of the preceding embodiments, wherein a 2'-substitution of the oligonucleotide is 2'—$OR^1$, wherein $R^1$ is optionally substituted $C_{1-6}$ aliphatic.
594. The composition of any one of the preceding embodiments, wherein a 2'-substitution of the oligonucleotide is 2'—$OR^1$, wherein $R^1$ is optionally substituted $C_{1-6}$ alkyl.
595. The composition of any one of the preceding embodiments, wherein a 2'-substitution of the oligonucleotide is 2'—$OR^1$, wherein $R^1$ is Me.
596. The composition of any one of the preceding embodiments, wherein a 2'-substitution of the oligonucleotide is 2'—$OR^1$, wherein $R^1$ is —$CH_2CH_2OMe$.
597. The composition of any one of the preceding embodiments, wherein a 2'-substitution of the oligonucleotide is -L-, wherein L connects $C_2$ and another carbon of the sugar unit.
598. The composition of any one of the preceding embodiments, wherein a 2'-substitution of the oligonucleotide is -L-, wherein L connects $C_2$ and $C_4$ of the sugar unit.
599. The composition of embodiment 597 or 598, wherein -L-is optionally substituted $C_{1-6}$ alkylene.
600. The composition of embodiment 597 or 598, wherein -L-is optionally substituted —$CH_2CH_2$—.
601. The composition of embodiment 597 or 598, wherein -L- is —$CH_2CH_2$—.
602. The composition of embodiment 597 or 598, wherein -L- is —$CH(Me)CH_2$—.
603. The composition of embodiment 597 or 598, wherein -L- is —(S)—$CH(Me)CH_2$—.
604. The composition of embodiment 597 or 598, wherein -L- is —(R)—$CH(Me)CH_2$—.
605. The composition of any one of the preceding embodiments, wherein the oligonucleotide comprises two or more types of 2'-substitution.
606. The composition of any one of the preceding embodiments, wherein the oligonucleotide comprises two and no more than two types of 2'-substitution.
607. The composition of any one of the preceding embodiments, wherein the oligonucleotide comprises two and no more than two types of 2'-substitution, wherein one type is 2'-F, and the other type is 2'—$OR^1$, wherein $R^1$ is optionally substituted $C_{1-6}$ aliphatic.
608. The composition of any one of the preceding embodiments, wherein the oligonucleotide comprises two and no more than two types of 2'-substitution, wherein one type is 2'-F, and the other type is 2'—$OR^1$, wherein $R^1$ is optionally substituted $C_{1-6}$ alkyl.
609. The composition of any one of the preceding embodiments, wherein the oligonucleotide comprises two and no more than two types of 2'-substitution, wherein one type is 2'-F, and the other type is 2'-OMe.
610. The composition of any one of the preceding embodiments, wherein the oligonucleotide comprises two or more nucleotidic units, each independently comprising a different type of 2'-substitution.
611. The composition of any one of the preceding embodiments, wherein the nucleotidic units comprising a 2'-substitution are consecutive.
612. The composition of any one of the preceding embodiments, wherein at least 1, 2, 3, 4, 5, 6, 7, 8, 9, 10, 11, 12, 13, 14, 15, 16, 17, 18, 19, 20, 21, 22, 23, 24, or 25 nucleotidic units of the oligonucleotide comprise no 2'-substitution.
613. The composition of any one of the preceding embodiments, wherein at least 2 nucleotidic units of the oligonucleotide comprise no 2'-substitution.
614. The composition of any one of the preceding embodiments, wherein at least 3 nucleotidic units of the oligonucleotide comprise no 2'-substitution.
615. The composition of any one of the preceding embodiments, wherein at least 4 nucleotidic units of the oligonucleotide comprise no 2'-substitution.
616. The composition of any one of the preceding embodiments, wherein at least 5 nucleotidic units of the oligonucleotide comprise no 2'-substitution.
617. The composition of any one of the preceding embodiments, wherein at least 6 the nucleotidic units of the oligonucleotide comprise no 2'-substitution.

618. The composition of any one of the preceding embodiments, wherein at least 7 nucleotidic units of the oligonucleotide comprise no 2'-substitution.

619. The composition of any one of the preceding embodiments, wherein at least 8 nucleotidic units of the oligonucleotide comprise no 2'-substitution.

620. The composition of any one of the preceding embodiments, wherein at least 9 nucleotidic units of the oligonucleotide comprise no 2'-substitution.

621. The composition of any one of the preceding embodiments, wherein at least 10 nucleotidic units of the oligonucleotide comprise no 2'-substitution.

622. The composition of any one of the preceding embodiments, wherein at least 11 the nucleotidic units of the oligonucleotide comprise no 2'-substitution.

623. The composition of any one of the preceding embodiments, wherein at least 12 the nucleotidic units of the oligonucleotide comprise no 2'-substitution.

624. The composition of any one of the preceding embodiments, wherein at least 13 nucleotidic units of the oligonucleotide comprise no 2'-substitution.

625. The composition of any one of the preceding embodiments, wherein at least 14 nucleotidic units of the oligonucleotide comprise no 2'-substitution.

626. The composition of any one of the preceding embodiments, wherein at least 15 nucleotidic units of the oligonucleotide comprise no 2'-substitution.

627. The composition of any one of the preceding embodiments, wherein at least 16 nucleotidic units of the oligonucleotide comprise no 2'-substitution.

628. The composition of any one of the preceding embodiments, wherein at least 17 the nucleotidic units of the oligonucleotide comprise no 2'-substitution.

629. The composition of any one of the preceding embodiments, wherein at least 18 the nucleotidic units of the oligonucleotide comprise no 2'-substitution.

630. The composition of any one of the preceding embodiments, wherein at least 19 nucleotidic units of the oligonucleotide comprise no 2'-substitution.

631. The composition of any one of the preceding embodiments, wherein at least 20 the nucleotidic units of the oligonucleotide comprise no 2'-substitution.

632. The composition of any one of the preceding embodiments, wherein at least 3%, 5%, 10%, 15%, 20%, 25%, 30%, 35%, 40%, 45%, 50%, 55%, 60%, 65%, 70%, 75%, 80%, 85%, 90%, 95%, or 97% of the nucleotidic units of the oligonucleotide comprise no 2'-substitution.

633. The composition of any one of the preceding embodiments, wherein the nucleotidic units comprising no 2'-substitution are consecutive.

634. The composition of any one of the preceding embodiments, wherein a nucleotidic unit comprising no 2'-substitution independently comprises a modified internucleotidic linkage having the structure of formula I.

635. The composition of any one of the preceding embodiments, wherein each nucleotidic unit comprising no 2'-substitution independently comprises a modified internucleotidic linkage having the structure of formula I.

636. The composition of embodiment 634 or 635, wherein a modified internucleotidic linkage having the structure of formula I is —O—P(O)(SH)— or a salt form thereof.

637. The composition of embodiment 634 or 635, wherein each modified internucleotidic linkage having the structure of formula I is —O—P(O)(SH)—O— or a salt form thereof.

638. The composition of any one of embodiments 633-637, wherein the pattern of backbone chiral centers of the oligonucleotide comprises (Sp)t(Rp)m(Sp)n, wherein each of t, m, and n is independently 1-50.

639. The composition of any one of embodiments 633-637, wherein the pattern of backbone chiral centers of the consecutive nucleotidic units comprising no 2'-substitution comprises (Sp)t(Rp)m(Sp)n, wherein each of t, m, and n is independently 1-50.

640. The composition of embodiment 638 or 639, wherein m is 1.

641. The composition of embodiment 638, 639 or 640, wherein t is at least 2, and m is at least 2.

642. The composition of any one of embodiments 638-641, wherein t is 2, 3, 4, 5, 6, 7, 8, 9, or 10.

643. The composition of any one of embodiments 638-641, wherein t is 2, wherein t is 2.

644. The composition of any one of embodiments 638-641, wherein t is 3.

645. The composition of any one of embodiments 638-641, wherein t is 4.

646. The composition of any one of embodiments 638-641, wherein t is 5.

647. The composition of any one of embodiments 638-646, wherein n is 2, 3, 4, 5, 6, 7, 8, 9, or 10.

648. The composition of any one of embodiments 638-646, wherein n is 2.

649. The composition of any one of embodiments 638-646, wherein n is 3.

650. The composition of any one of embodiments 638-646, wherein n is 4.

651. The composition of any one of embodiments 638-646, wherein n is 5.

652. The composition of embodiment 641, wherein t+m+n is at least 8.

653. The composition of embodiment 641, wherein t+m+n is at least 9.

654. The composition of embodiment 641, wherein t+m+n is at least 10.

655. The composition of any one of embodiments 633-654, wherein the consecutive nucleotidic units comprising no 2'-substitution are flanked at the 5'-end a bock of consecutive nucleotidic units each independently comprising a 2'-substitution.

656. The composition of embodiment 655, wherein the 5'-end block comprises at least 2, 3, 4, 5, 6, or 7 nucleotidic units.

657. The composition of embodiment 655, wherein the 5'-end block comprises at least 3, 4, 5, 6, or 7 nucleotidic units.

658. The composition of embodiment 655, wherein the 5'-end block comprises at least 4, 5, 6, or 7 nucleotidic units.

659. The composition of embodiment 655, wherein the 5'-end block comprises at least 5, 6, or 7 nucleotidic units.

660. The composition of embodiment 655, wherein the 5'-end block comprises 5 and no more than 5 nucleotidic units.

661. The composition of any one of embodiment 655-660, wherein each nucleotidic units of the 5'-end independently comprises 2'—$OR^1$.

662. The composition of embodiment 660, wherein $R^1$ is optionally substituted $C_{1-6}$ aliphatic.

663. The composition of embodiment 660, wherein $R^1$ is optionally substituted $C_{1-6}$ alkyl.

664. The composition of embodiment 660, wherein $R^1$ is methyl.

665. The composition of any one of embodiments 655-664, wherein the 5'-end block comprises at least one chiral internucleotidic linkage having the structure of formula I.
666. The composition of any one of embodiments 655-664, wherein the 5'-end block comprises at least one chiral internucleotidic linkage having the structure of formula I, wherein X is S.
667. The composition of any one of embodiments 655-666, wherein the 5'-nucleotidic unit of the 5'-end block comprises a chiral internucleotidic linkage having the structure of formula I.
668. The composition of any one of embodiments 655-666, wherein the 5'-nucleotidic unit of the 5'-end block comprises a chiral internucleotidic linkage having the structure of formula I, wherein X is S.
669. The composition of any one of embodiments 655-668, wherein the 3'-nucleotidic unit of the 5'-end block comprises a chiral internucleotidic linkage having the structure of formula I.
670. The composition of any one of embodiments 655-668, wherein the 3'-nucleotidic unit of the 5'-end block comprises a chiral internucleotidic linkage having the structure of formula I, wherein X is S.
671. The composition of any one of embodiments 655-670, wherein the 5'-end block comprises at least one chirally controlled internucleotidic linkage having the structure of formula I.
672. The composition of any one of embodiments 655-670, wherein the 5'-end block comprises at least one chirally controlled internucleotidic linkage having the structure of formula I, wherein X is S.
673. The composition of any one of embodiments 655-672, wherein the 5'-nucleotidic unit of the 5'-end block comprises a chirally controlled internucleotidic linkage having the structure of formula I.
674. The composition of any one of embodiments 655-672, wherein the 5'-nucleotidic unit of the 5'-end block comprises a chirally controlled internucleotidic linkage having the structure of formula I, wherein X is S.
675. The composition of any one of embodiments 655-674, wherein the 3'-nucleotidic unit of the 5'-end block comprises a chirally controlled internucleotidic linkage having the structure of formula I.
676. The composition of any one of embodiments 655-674, wherein the 3'-nucleotidic unit of the 5'-end block comprises a chirally controlled internucleotidic linkage having the structure of formula I, wherein X is S.
677. The composition of any one of embodiments 655-676, wherein the 5'-end block comprises at least one Sp chirally controlled internucleotidic linkage having the structure of formula I.
678. The composition of any one of embodiments 655-676, wherein the 5'-end block comprises at least one Sp chirally controlled internucleotidic linkage having the structure of formula I, wherein X is S.
679. The composition of any one of embodiments 655-678, wherein the 5'-nucleotidic unit of the 5'-end block comprises a Sp chirally controlled internucleotidic linkage having the structure of formula I.
680. The composition of any one of embodiments 655-678, wherein the 5'-nucleotidic unit of the 5'-end block comprises a Sp chirally controlled internucleotidic linkage having the structure of formula I, wherein X is S.
681. The composition of any one of embodiments 655-680, wherein the 3'-nucleotidic unit of the 5'-end block comprises a Sp chirally controlled internucleotidic linkage having the structure of formula I.
682. The composition of any one of embodiments 655-680, wherein the 3'-nucleotidic unit of the 5'-end block comprises a Sp chirally controlled internucleotidic linkage having the structure of formula I, wherein X is S.
683. The composition of any one of embodiments 665-682, wherein the internucleotidic linkage having the structure of formula I is —O—P(O)(SH)—O— or a salt form thereof.
684. The composition of any one of embodiments 655-683, wherein the 5'-end block comprises one or more natural phosphate linkages.
685. The composition of any one of embodiments 655-683, wherein the 5'-end block comprises two or more natural phosphate linkages.
686. The composition of any one of embodiments 655-685, wherein each nucleotidic unit of the 5'-block that is not the 5'-nucleotidic unit or the 3'-nucleotidic unit comprises a natural phosphate linkage.
687. The composition of any one of embodiments 633-686, wherein the consecutive nucleotidic units comprising no 2'-substitution are flanked at the 3'-end a bock of consecutive nucleotidic units each independently comprising a 2'-substitution.
688. The composition of embodiment 687, wherein the 3'-end block comprises at least 2, 3, 4, 5, 6, or 7 nucleotidic units.
689. The composition of embodiment 687, wherein the 3'-end block comprises at least 3, 4, 5, 6, or 7 nucleotidic units.
690. The composition of embodiment 687, wherein the 3'-end block comprises at least 4, 5, 6, or 7 nucleotidic units.
691. The composition of embodiment 687, wherein the 3'-end block comprises at least 5, 6, or 7 nucleotidic units.
692. The composition of embodiment 687, wherein the 3'-end block comprises 5 and no more than 5 nucleotidic units.
693. The composition of any one of embodiment 687-692, wherein each nucleotidic units of the 3'-end independently comprises 2'—OR$^1$.
694. The composition of embodiment 692, wherein R$^1$ is optionally substituted C$_{1-6}$ aliphatic.
695. The composition of embodiment 692, wherein R$^1$ is optionally substituted C$_{1-6}$ alkyl.
696. The composition of embodiment 692, wherein R$^1$ is methyl.
697. The composition of any one of embodiments 687-696, wherein the 3'-end block comprises at least one chiral internucleotidic linkage having the structure of formula I.
698. The composition of any one of embodiments 687-696, wherein the 3'-end block comprises at least one chiral internucleotidic linkage having the structure of formula I, wherein X is S.
699. The composition of any one of embodiments 687-698, wherein the 5'-nucleotidic unit of the 3'-end block comprises a chiral internucleotidic linkage having the structure of formula I.
700. The composition of any one of embodiments 687-698, wherein the 5'-nucleotidic unit of the 3'-end block comprises a chiral internucleotidic linkage having the structure of formula I, wherein X is S.
701. The composition of any one of embodiments 687-700, wherein last internucleotidic linkage of the 3'-end block comprises a chiral internucleotidic linkage having the structure of formula I.
702. The composition of any one of embodiments 687-700, wherein last internucleotidic linkage of the 3'-end block comprises a chiral internucleotidic linkage having the structure of formula I, wherein X is S.

703. The composition of any one of embodiments 687-702, wherein the 3'-end block comprises at least one chirally controlled internucleotidic linkage having the structure of formula I.
704. The composition of any one of embodiments 687-702, wherein the 3'-end block comprises at least one chirally controlled internucleotidic linkage having the structure of formula I, wherein X is S.
705. The composition of any one of embodiments 687-704, wherein the 3'-nucleotidic unit of the 3'-end block comprises a chirally controlled internucleotidic linkage having the structure of formula I.
706. The composition of any one of embodiments 687-704, wherein the 3'-nucleotidic unit of the 3'-end block comprises a chirally controlled internucleotidic linkage having the structure of formula I, wherein X is S.
707. The composition of any one of embodiments 687-706, wherein the last internucleotidic linkage of the 3'-end block comprises a chirally controlled internucleotidic linkage having the structure of formula I.
708. The composition of any one of embodiments 687-706, wherein the last internucleotidic linkage of the 3'-end block comprises a chirally controlled internucleotidic linkage having the structure of formula I, wherein X is S.
709. The composition of any one of embodiments 687-708, wherein the 3'-end block comprises at least one Sp chirally controlled internucleotidic linkage having the structure of formula I.
710. The composition of any one of embodiments 687-708, wherein the 3'-end block comprises at least one Sp chirally controlled internucleotidic linkage having the structure of formula I, wherein X is S.
711. The composition of any one of embodiments 687-710, wherein the 5'-nucleotidic unit of the 3'-end block comprises a Sp chirally controlled internucleotidic linkage having the structure of formula I.
712. The composition of any one of embodiments 687-710, wherein the 5'-nucleotidic unit of the 3'-end block comprises a Sp chirally controlled internucleotidic linkage having the structure of formula I, wherein X is S.
713. The composition of any one of embodiments 687-712, wherein the last internucleotidic linkage of the 3'-end block comprises a Sp chirally controlled internucleotidic linkage having the structure of formula I.
714. The composition of any one of embodiments 687-712, wherein the last internucleotidic linkage of the 3'-end block comprises a Sp chirally controlled internucleotidic linkage having the structure of formula I, wherein X is S.
715. The composition of any one of embodiments 687-714, wherein the internucleotidic linkage having the structure of formula I is —O—P(O)(SH)—O— or a salt form thereof.
716. The composition of any one of embodiments 687-715, wherein the 5'-end block comprises one or more natural phosphate linkages.
717. The composition of any one of embodiments 687-715, wherein the 5'-end block comprises two or more natural phosphate linkages.
718. The composition of any one of embodiments 687-717, wherein each internucleotidic linkage of the 3'-end block that is not the first or the last internucleotidic linkage of the 3'-end block is a natural phosphate linkage.
719. The composition of any one of the preceding embodiments, wherein the oligonucleotide is connected to a solid support.
720. The composition of any one of the preceding embodiments, wherein the oligonucleotide is connected to a solid support suitable for oligonucleotide synthesis.
721. The composition of any one of the preceding embodiments, wherein the oligonucleotide is not connected to a solid support.
722. The composition of any one of the preceding embodiments, wherein the oligonucleotide is a single strand oligonucleotide.
723. The composition of any one of embodiments 77-632, wherein the oligonucleotide contains no element of 4, 5, 6, 7, 8, 9, or 10 or more consecutive nucleotidic units, wherein each of the consecutive nucleotidic units comprises no 2'-substituents.
724. The composition of any one of embodiments 77-632, wherein the oligonucleotide contains a first element of 4, 5, 6, 7, 8, 9, or 10 or more consecutive nucleotidic units, wherein each of the consecutive nucleotidic units independently comprises a 2'-substituents, and a second element of 4, 5, 6, 7, 8, 9, or 10 or more consecutive nucleotidic units, wherein each of the consecutive nucleotidic units comprises no 2'-substituents.
725. The composition of any one of embodiments 77-632, wherein the oligonucleotide contains a first element of 8, 9, or 10 or more consecutive nucleotidic units, wherein each of the consecutive nucleotidic units independently comprises a 2'-substituents, and a second element of 8, 9, or 10 or more consecutive nucleotidic units, wherein each of the consecutive nucleotidic units comprises no 2'-substituents.
726. The composition of any one of the preceding embodiments, wherein when the oligonucleotide is contacted with a system including a target RNA and an Ago2 enzyme, level of a target RNA or of a protein encoded thereby is significantly lower when the oligonucleotide is present than when it is absent.
727. The composition of any one of the preceding embodiments, wherein when the oligonucleotide is contacted with a system including a target RNA and RISC, level of a target RNA or of a protein encoded thereby is significantly lower when the oligonucleotide is present than when it is absent.
728. The composition of embodiment 726, wherein the system is an in vitro Ago2 RNAi assay.
729. The composition of embodiment 726, wherein the system is a cell.
730. The composition of embodiment 726, wherein the system is a tissue.
731. The composition of embodiment 726, wherein the system is an organ.
732. The composition of embodiment 726, wherein the system is a subject.
733. The composition of any one of embodiments 726-732, wherein level of a target RNA or a protein encoded thereby is at least 50%, 55%, 60%, 65%, 70%, 75%, 80%, 85%, 90%, or 95% lower.
734. The composition of any one of embodiments 726-733, wherein the oligonucleotide hybridizes with the target RNA.
735. The composition of any one of embodiments 726-733, wherein the base sequence of the oligonucleotide is at least 75%, 80%, 85%, 90%, or 95% complimentary to a base sequence in the target RNA.
736. The composition of embodiment 735, wherein the 5'-nucleobase of the oligonucleotide is a mismatch.
737. The composition of embodiment 735 or 736, wherein one or both of the last two nucleobases at the 3'-end of the oligonucleotide are mismatches.
738. The composition of any one of embodiments 733-737, wherein the base sequence of an element of at least 5, 6, 7, 8, 9, 10, 11, 12, 13, 14, 15, 16, 17, 18, 19, 20, or 21 consecutive nucleotidic units are 100% complementary to a base sequence in the target RNA.

739. The composition of any one of the preceding embodiments, wherein the oligonucleotide are characterized in that, when contacted with a system including a target RNA and a RNase H enzyme, level of a target RNA or of a protein encoded thereby is significantly lower when the oligonucleotide is present than when it is absent.
740. The composition of embodiment 739, wherein the system is an in vitro RNase H assay.
741. The composition of embodiment 739, wherein the system is a cell.
742. The composition of embodiment 739, wherein the system is a tissue.
743. The composition of embodiment 739, wherein the system is an organ.
744. The composition of embodiment 739, wherein the system is a subject.
745. The composition of any one of embodiments 739-744, wherein level of a target RNA or a protein encoded thereby is at least 50%, 55%, 60%, 65%, 70%, 75%, 80%, 85%, 90%, or 95% lower.
746. The composition of any one of embodiments 739-745, wherein the oligonucleotide hybridizes with the target RNA.
747. The composition of any one of embodiments 726-745, wherein the base sequence of the oligonucleotide is at least 75%, 80%, 85%, 90%, or 95% complimentary to a base sequence in the target RNA.
748. The composition of any one of embodiments 726-745, wherein the base sequence of the oligonucleotide is 100% complimentary to a base sequence in the target RNA.
749. The composition of any one of the preceding embodiments, wherein the oligonucleotide has a GC content greater than about 50%, 55%, 60%, 65%, 70%, 75%, or 80%.
750. The composition of any one of the preceding embodiments, wherein each nucleotidic unit independently comprises a nucleobase, which is optionally substituted or protected adenine, cytosine, guanosine, thymine, or uracil.
751. The composition of any one of the preceding embodiments, wherein the oligonucleotide comprises a target-binding sequence that is completely complementary to a target sequence.
752. The composition of any one of the preceding embodiments, wherein the oligonucleotide comprises a target-binding sequence that is completely complementary to a target sequence, wherein the target-binding sequence is or comprise a sequence, or a portion of a sequence, in Table 1A.
753. The composition of any one of the preceding embodiments, wherein the oligonucleotide comprises a target-binding sequence that is completely complementary to a target sequence, which target sequence is a sequence of ApoC3 pre-mRNA or RNA.
754. The composition of any one of the preceding embodiments, wherein the oligonucleotide comprises a target-binding sequence that is completely complementary to a target sequence, which target sequence is a sequence of PNPLA3 pre-mRNA or RNA.
755. The composition of any one of the preceding embodiments, wherein the target-binding sequence has a length of 1-20 nucleobases.
756. The composition of any one of the preceding embodiments, wherein the target-binding sequence has a length of at least 2, 3, 4, 5, 6, 7, 8, 9, 10, 11, 12, 13, 14, 15, 16, 17, 18, 19 or 20 bases.
757. The composition of any one of the preceding embodiments, wherein the target-binding sequence has a length of at least 5, 6, 7, 8, 9, 10, 11, 12, 13, 14, 15, 16, 17, 18, 19 or 20 bases, wherein each base is optionally substituted adenine, cytosine, guanosine, thymine, or uracil.
758. The composition of any one of the preceding embodiments, wherein the target-binding sequence has a length of at least 10, 11, 12, 13, 14, 15, 16, 17, 18, 19 or 20 bases, wherein each base is optionally substituted adenine, cytosine, guanosine, thymine, or uracil.
759. The composition of any one of the preceding embodiments, wherein the target sequence comprises one or more allelic sites.
760. The composition of embodiment 759, wherein an allelic site is a SNP.
761. The composition of embodiment 759, wherein an allelic site is SNP rs738409.
762. The composition of embodiment 759, wherein an allelic site is a mutation.
763. The composition of any one of the preceding embodiments, wherein the target sequence comprises two SNPs.
764. The composition of any one of the preceding embodiments, wherein the target sequence comprises an allelic site and the target-binding sequence is completely complementary to the target sequence of a disease-associated allele but not that of an allele less associated with the disease.
765. The composition of any one of the preceding embodiments, wherein the oligonucleotide is an oligonucleotide that binds with a transcript of a target nucleic acid sequence for which a plurality of alleles exist within a population, each of which contains a specific nucleotide characteristic sequence element that defines the allele relative to other alleles of the same target nucleic acid sequence,
wherein the base sequence of the oligonucleotide is or comprises a sequence that is complementary to the characteristic sequence element that defines a particular allele,
the oligonucleotide being characterized in that, when it is contacted with a system comprising transcripts of target nucleic acid sequence, it shows suppression of transcripts of the particular allele, or a protein encoded thereby, at a level that is greater than a level of suppression observed for another allele of the same nucleic acid sequence.
766. The composition of embodiment 764, wherein the oligonucleotide is characterized in that, when it is contacted with a system comprising transcripts of target nucleic acid sequence, it shows suppression of transcripts of the particular allele at a level that is greater than a level of suppression observed for another allele of the same nucleic acid sequence.
767. The composition of any one of the preceding embodiments, wherein the oligonucleotide is an oligonucleotide that binds with a transcript of a target nucleic acid sequence for which a plurality of alleles exist within a population, each of which contains a specific nucleotide characteristic sequence element that defines the allele relative to other alleles of the same target nucleic acid sequence,
wherein the base sequence of the oligonucleotide is or comprises a target-binding sequence that is completely complementary to target sequences of transcripts comprising the characteristic sequence element that defines a particular allele,
wherein when the oligonucleotide is contacted with a system comprising transcripts of the target nucleic acid sequence, the oligonucleotide shows suppression of transcripts of the particular allele, or a protein encoded thereby, at a level that is greater than a level of suppression observed for another allele of the same nucleic acid sequence.
768. The composition of any one of embodiments 764-767, wherein a system is a cell.
769. The composition of any one of embodiments 764-767, wherein a system is a tissue.

770. The composition of any one of embodiments 764-767, wherein a system is an organ.

771. The composition of any one of embodiments 764-767, wherein a system is an organism.

772. The composition of any one of embodiments 764-771, wherein the system comprises Ago2.

773. The composition of any one of embodiments 764-772, wherein the system comprises RNase H.

774. The composition of any one of embodiments 764-773, wherein the characteristic sequence element comprises one or more SNPs and/or mutations.

775. The composition of any one of embodiments 764-773, wherein the characteristic sequence element comprises one or more SNPs.

776. The composition of any one of embodiments 764-773, wherein the characteristic sequence element comprises two SNPs.

777. The composition of any one of embodiments 764-773, wherein the characteristic sequence element comprises SNP rs738409.

778. The composition of any one of the preceding embodiments, wherein the base sequence of the oligonucleotide is or comprises the sequence of any oligonucleotide disclosed herein, e.g., in Table 1A.

779. The composition of any one of the preceding embodiments, wherein the oligonucleotide hybridizes specifically with a target sequence of the sequence of any oligonucleotide disclosed herein, e.g., in Table 1A.

780. The composition of embodiment 779, wherein there are no more than 1, 2, 3, 4, 5, 6, 7, 8, 9, or 10 mismatches.

781. The composition of embodiment 779 or 780, wherein there are no more than 1, 2, 3, 4, 5, 6, 7, 8, 9, or 10 mismatches within the sequence of any oligonucleotide disclosed herein, e.g., in Table 1A.

782. The composition of embodiment 779 or 780, wherein there are no more than 1 mismatches within the sequence of any oligonucleotide disclosed herein, e.g., in Table 1A.

783. A method for reducing level and/or activity of a transcript or a protein encoded thereby, comprising contacting the transcript with an oligonucleotide or a composition of any one of the preceding embodiments, wherein the oligonucleotide or oligonucleotide of the composition comprises a targeting-binding sequence that is completely complementary to a target sequence of the transcript.

784. A method for reducing level or activity of a nucleic acid sequence, comprising administering to a system comprising the nucleic acid sequence an oligonucleotide or a composition of any one of the preceding embodiments, wherein the oligonucleotide or oligonucleotide of the composition comprises a targeting-binding sequence that is identical or completely complementary to a target sequence in the nucleic acid sequence.

785. A method for reducing level and/or activity of a transcript or a protein encoded thereby, comprising administering to a system expressing the transcript an oligonucleotide or a composition of any one of the preceding embodiments, wherein the oligonucleotide or oligonucleotide of the composition comprises a targeting-binding sequence that is completely complementary to a target sequence in the transcript.

786. A method for allele-specific suppression of a transcript from a nucleic acid sequence for which a plurality of alleles exist within a population, each of which contains a specific nucleotide characteristic sequence element that defines the allele relative to other alleles of the same target nucleic acid sequence, the method comprising steps of:

contacting a sample comprising transcripts of the target nucleic acid sequence with an oligonucleotide or a composition of any one of the preceding embodiments, wherein the oligonucleotide or oligonucleotide of the composition comprises a targeting-binding sequence that is identical or completely complementary to a target sequence in the nucleic acid sequence, which target sequence comprises a characteristic sequence element that defines a particular allele, wherein when the oligonucleotide or oligonucleotide of the composition is contacted with a system comprising transcripts of both the target allele and another allele of the same nucleic acid sequence, transcripts of the particular allele are suppressed at a greater level than a level of suppression observed for another allele of the same nucleic acid sequence.

787. A method for allele-specific suppression of a transcript from a nucleic acid sequence for which a plurality of alleles exist within a population, each of which contains a specific nucleotide characteristic sequence element that defines the allele relative to other alleles of the same target nucleic acid sequence, the method comprising steps of:

administering to a subject comprising transcripts of the target nucleic acid sequence with an oligonucleotide or a composition of any one of the preceding embodiments, wherein the oligonucleotide or oligonucleotide of the composition comprises a targeting-binding sequence that is identical or completely complementary to a target sequence in the nucleic acid sequence, which target sequence comprises a characteristic sequence element that defines a particular allele, wherein when the oligonucleotide or oligonucleotide of the composition is contacted with a system comprising transcripts of both the target allele and another allele of the same nucleic acid sequence, transcripts of the particular allele are suppressed at a greater level than a level of suppression observed for another allele of the same nucleic acid sequence.

788. The method of any one of embodiments 786-787, wherein the contacting is performed under conditions determined to permit the composition to suppress transcripts of the particular allele.

789. The method of any one of embodiments 786-788, wherein when the oligonucleotide or oligonucleotide of the composition is contacted with a system comprising transcripts of both the target allele and another allele of the same nucleic acid sequence, it shows suppression of transcripts of the particular allele at a level that is:

a) greater than when the composition is absent;

b) greater than a level of suppression observed for another allele of the same nucleic acid sequence; or c) both greater than when the composition is absent, and greater than a level of suppression observed for another allele of the same nucleic acid sequence.

790. The method of any one of embodiments 786-789, wherein suppression of transcripts of the particular allele is at a level that is both greater than when the composition is absent, and greater than a level of suppression observed for another allele of the same nucleic acid sequence.

791. The method of any one of embodiments 786-790, wherein suppression of transcripts of the particular allele is at a level that is both greater than when the composition is absent, and at least 2, 3, 4, 5, 6, 7, 8, 9, or 10-fold greater than a level of suppression observed for another allele of the same nucleic acid sequence.

792. The method of any one of embodiments 786-791, wherein suppression of transcripts of the particular allele is at a level that is both greater than when the composition is absent, and at least 5, 6, 7, 8, 9, or 10-fold greater than a level of suppression observed for another allele of the same nucleic acid sequence.

793. The composition of any of the preceding embodiments, wherein the oligonucleotide has or comprises the structure of:

5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz-(N26-PX26-N27-PX27)yz-(CAP)zz-3' wherein the oligonucleotide comprises multiple nucleosides (each independently represented by any of N1 to N27) and multiple internucleotidic linkages (each independently represented by any of PX0 to PX12).

794. The composition of any of the preceding embodiments, wherein the oligonucleotide has or comprises the structure of:

5'-PX0-N1-PX1-N2-PX2-N3-PX3-N4-PX4-N5-PX5-N6-PX6-N7-PX7-N8-PX8-N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz-(N26-PX26-N27-PX27)yz-(CAP)zz-3' or a salt thereof,
wherein:
each of N1 to N27 is independently a nucleoside residue;
each of PX1 to PX26 is independently an internucleotidic linkage;
PX0 is —H, —OH, -$L^{PX}$-H, or -L-H;
$L^{PX}$ has the structure of an internucleotidic linkage;
L is as described in the present disclosure;
PX27 is —H, —OH, -$L^{PX}$-H, or -L-H when zz is 0, and is —O—, -$L^{PX}$-, or -L- when zz is not 0;
mz, nz, pz, rz, sz, tz, vz, and wz are independently 0 to 10;
wherein N26-PX26-N27-PX27 is 3'-terminal dinucleotide;
CAP is a 3'-end cap;
yz and zz are independently 0 or 1.

795. The composition of any preceding embodiments, wherein the seed region of the structure of a single-stranded RNAi agent is represented by N2-PX2-N3-PX3-N4-PX4-N5-PX5-N6-PX6-N7-PX7-, -N3-PX3-N4-PX4-N5-PX5-N6-PX6-N7-PX7-, or N4-PX4-N5-PX5-N6-PX6-N7-PX7-N8-PX8-.

796. The composition of any of the preceding embodiments, wherein -N7-PX7-N8-PX8-N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz-, -N8-PX8-N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz-, or -N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz- represents a post-seed region.

797. The composition of any preceding embodiments, wherein the internucleotidic linkage is a modified internucleotidic linkage.

798. The composition of any preceding embodiments, wherein the provided single-stranded RNAi agent comprises a 3'-terminal dinucleotide (N26-PX26-N27-PX27)yz, and does not comprise a 3'-end cap, wherein yz=1 and zz=0.

799. The composition of any preceding embodiments, wherein the provided single-stranded RNAi agent comprises a 3'-end cap (CAP)zz, and does not comprise a 3'-terminal dinucleotide (N26-PX26-N27-PX27)yz, and yz=0 and zz=1.

800. The composition of any of the preceding embodiments, wherein 5'-PX0-N1-PX1- represents a 5'-end region; -N2-PX2-N3-PX3-N4-PX4-N5-PX5-N6-PX6-N7- represents a seed region; -PX7-N8-PX8-N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz- represents a post-seed region; and -(N26-PX26-N27-PX27)yz-(CAP)zz-3' represents a 3'-end (or 3'-end region).

801. The composition of any of the preceding embodiments, wherein 5'-PX0-N1-PX1- represents a 5'-end region; -N2-PX2-N3-PX3-N4-PX4-N5-PX5-N6-PX6- represents a seed region; -N7-PX7-N8-PX8-N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz represents a post-seed region; and -(N26-PX26-N27-PX27)yz-(CAP)zz-3' represents a 3'-end (or 3'-end region).

802. The composition of any of the preceding embodiments, wherein 5'-PX0-N1-PX1-N2-PX2-represents a 5'-end region; -N3-PX3-N4-PX4-N5-PX5-N6-PX6-N7-PX7- represents a seed region; -N8-PX8-N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz represents a post-seed region; and -(N26-PX26-N27-PX27)yz-(CAP)zz-3' represents a 3'-end (or 3'-end region).

803. The composition of any of the preceding embodiments, wherein 5'-PX0-N1-PX1-N2-PX2-represents a 5'-end region; -N3-PX3-N4-PX4-N5-PX5-N6-PX6-N7-PX7-N8-PX8- represents a seed region; -N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz represents a post-seed region; and -(N26-PX26-N27-PX27)yz-(CAP)zz-3' represents a 3'-end (or 3'-end region).

804. The composition of any of the preceding embodiments, wherein 5'-PX0-N1-PX1- represents a 5'-end region; -N2-PX2-N3-PX3-N4-PX4-N5-PX5-N6-PX6-N7-PX7-N8- represents a seed region; -PX8-N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24) vz-(N25-PX25)wz represents a post-seed region; and -(N26-PX26-N27-PX27)yz-(CAP)zz-3' represents a 3'-end (or 3'-end region).

805. The composition of any of the preceding embodiments, wherein 5'-PX0-N1-PX1-N2-PX2-represents a 5'-end region; -N3-PX3-N4-PX4-N5-PX5-N6-PX6- represents a seed region; -N7-PX7-N8-PX8-N9-PX9-N10-PX10-N11-PX11-N12-PX12-N13-PX13-N14-PX14-N15-PX15-N16-PX16-N17-PX17-(N18-PX18)mz-(N19-PX19)nz-(N20-PX20)pz-(N21-PX21)rz-(N22-PX22)sz-(N23-PX23)tz-(N24-PX24)vz-(N25-PX25)wz represents a post-seed region; and -(N26-PX26-N27-PX27)yz-(CAP)zz-3' represents a 3'-end (or 3'-end region).

806. The composition of any of the preceding embodiments, wherein the total of mz+nz+pz is an integer from 8 to 20.

807. The composition of any of the preceding embodiments, wherein a post-seed region which comprises a span of sugars having a pattern of modifications of any of: mfmfmfmfmfmfm, mfmfmfmfmfm, mfmfmfmfm, mfmfmfm, mfmfm, mfm, fmfmfmfmfmfm, fmfmfmmm, fmfmfmfm, fmfmfm, and fmfm, wherein m is 2'-OMe and f is 2'-F.

808. The composition of any of the preceding embodiments, wherein a post-seed region which comprises a span of sugars having a pattern of modifications of any of: dddfdfdfdfdfd, dddfdfdfdfd, dddfdfdfd, dddfdfd, dddfd, dfdfdfdfdfdfd, fdfdfdfdfdfd, fdfdfdfdfd, fdfdfdfd, fdfdfd, and fdfd, wherein d is 2'-deoxy and f is 2'-F.

809. The composition of any of the preceding embodiments, wherein the post-seed region comprises a span of internucleotidic linkages having a pattern of any of: OOO, OOOO, OOOOO, OOOOOO, OOOOOOO, OOOOOOOOX, OOOOOOOOXX, OOOOOOOOXXX, OOOOOOOOXXXX, OOOOOOOOXXXXX, OOOOOOOOXXXXXX, OOOOOOOXXX, OOOOOOOXXXX, OOOOOOOXXXXX, OOOOOOOXXXXXX, OOOOOOX, OOOOOOXX, OOOOOOXXXXX, OOOOOOXXXXXX, OOOOOX, OOOOOXXX, OOOOOXXXX, OOOOOXXXXX, OOOOOXXXXXX, OOOOX, OOOOXXX, OOOOXXXX, OOOOXXXXXX, OOOX, OOOXO, OOOXOOXXXXX, OOOXOX, OOOXOXO, OOOXOXOXXX, OOOXXX, OOOXXXX, OOOXXXXX, OOOXXXXXX, OOXOOXXXXX, OOXOXOXXX, OOXXXXX, OOXXXXXX, OXOOOXOXOX, OXOOOXOXOXX, OXOOOXOXOXXX, OXOOXXXXX, OXOXOOO, OXOXOOOO, OXOXOXOO, OXOXOXOOOO, OXOXOXXX, OXOXOXXX, OXOXOXXXXXX, OXOXXXXXX, OXXXXXX, OXXXXXX, XOOOXO, XOOOXOO, XOOOXOOX, XOOOXOOXX, XOOOXOOXXX, XOOOXOOXXXX, XOOOXOOXXXXX, XOOOXOX, XOOOXOXO, XOOOXOXOX, XOOOXOXOX, XOOOXOXOXX, XOOOXOXOXXX, XOOOXOXOXXX, XOOOXOXOXXX, XOOXXXXX, XOXOOO, XOXOOOX, XOXOOOXO, XOXOOOXOX, XOXOOOXOXO, XOXOOOXOXOX, XOXOOOXOXOXX, XOXOOOXOXOXXX, XOXOXOOO, XOXOXOOOO, XOXOXOX, XOXOXOXOO, XOXOXOXOOO, XOXOXOXOOOO, XOXOXOXX, XOXOXOXXX, XOXOXOXXXX, XOXOXOXXXXX, XOXOXOXXXXXX, XOXOXXX, XOXOXXXXXX, XOXXXXXX, XXOOOXOXOX, XXOOOXOXOXX, XXOOOXOXOXXX, XXXOOOXO, XXXOOOXOX, XXXOOOXOXO, XXXOOOXOXOX, XXXOOOXOXOXX, and XXXOOOXOXOXXX, wherein O is phosphodiester and X is a stereorandom phosphorothioate.

810. The composition of any of the preceding embodiments, wherein the post-seed region comprises a span of internucleotidic linkages having a pattern of any of: OOOOOOS, OOOOOSO, OOOOSOO, OOOSOOO, OOSOOOO, OSOOOOO, OSOOOOOS, OSOSOOOOS, OSOSO-SOOOOOS, OSOSOSOSOOOOS, OSOSOSOSS, OSOSOSOSSS, OSOSOSOSSSS, OSOSOSOSSSSS, OSOSOSOSSSSSS, OSOSOSOSSSSSSS, OSOSSSSSSSS, OSSSO, OSSSOS, OSSSOSS, OSSSOSSS, OSSSOSSSS, OSSSOSSSSS, OSSSOSSSSSS, OSSSOSSSSSSS, OSSSOSSSSSSSS, OSSSOSSSSSSSSS, OSSSOSSSSSSSSSS, OSSSOSSSSSSSSSSS, OSSSS, OSSSSS, OSSSSSO, OSSSSSSSS, SOOOOOO, SOSOOOOOOS, SOSO-SOOOOOOS, SOSOSOSOOOOOS, SOSOSOSOSO, SOSOSOSOSOOO, SOSOSOSOSOOOO, SOSOSOSO-SOOOOO, SOSOSOSOSOOOOOO, SOSOSOSO-SOOOOOOS, SOSOSOSSS, SOSOSOSSSS, SOSOSOSSSSS, SOSOSOSSSSSS, SOSOSOSSSSSSS, SOSOSOSSSSSSSS, SOSOSSSSSSSS, SOSSSSSSSS, SS, SSS, SSSO, SSSS, SSSSO, SSSSS, SSSSSO, SSSSSS, SSSSSSS, and SSSSSSSS, wherein O is phosphodiester and S is a phosphorothioate in the Sp configuration.

811. The composition of any of the preceding embodiments, wherein the post-seed region comprises at least 1 2'-deoxy.

812. The composition of any of the preceding embodiments, wherein the post-seed region comprises at least 1 2'-deoxy, wherein at least 1 2'-deoxy is at the most 3' position of a post-seed region.

813. The composition of any of the preceding embodiments, wherein the post-seed region comprises at least 1 2'-deoxy, wherein at least 1 2'-deoxy is at the most 3' position of a post-seed region, wherein the 2'-deoxy can be further modified to comprise an additional chemical moiety which is a GalNAc moiety.

814. The composition of any of the preceding embodiments, wherein the post-seed region comprises at least 1 2'-deoxy, wherein at least 1 2'-deoxy is at the most 3' position of a post-seed region, wherein the 2'-deoxy can be further modified to comprise a linker.

815. The composition of any of the preceding embodiments, wherein the post-seed region comprises at least 1 2'-deoxy, wherein at least 1 2'-deoxy is at the most 3' position of a post-seed region, wherein the 2'-deoxy can be further modified to comprise a linker and an additional chemical moiety which is a GalNAc moiety.

816. The composition of any of the preceding embodiments, wherein the post-seed region comprises an additional chemical moiety which is a GalNAc moiety.

817. The composition of any of the preceding embodiments, wherein the post-seed region comprises an additional chemical moiety which is a GalNAc moiety selected from a targeting moiety, a carbohydrate, a GalNAc moiety, and a lipid.

818. The composition of any of the preceding embodiments, wherein the post-seed region comprises a GalNAc moiety.

819. The composition of any of the preceding embodiments, wherein the oligonucleotide comprises a 3'-terminal dinucleotide represented by: -(N26-PX26-N27-PX27)yz, wherein yz=1 and wherein the RNAi agent does not comprise a 3'-end cap.

820. The composition of any of the preceding embodiments, wherein the oligonucleotide comprises a 3'-terminal dinucleotide represented by: -(N26-PX26-N27-PX27)yz, wherein yz=1 and wherein the RNAi agent does not comprise a 3'-end cap and wherein N26 is a 2'-OMe.

821. The composition of any of the preceding embodiments, wherein the oligonucleotide comprises a 3'-terminal dinucleotide represented by: -(N26-PX26-N27-PX27)yz, wherein yz=1 and wherein the RNAi agent does not comprise a 3'-end cap and wherein N27 is a 2'-OMe.

822. The composition of any of the preceding embodiments, wherein the oligonucleotide comprises a 3'-terminal dinucleotide represented by: -(N26-PX26-N27-PX27)yz, wherein yz=1 and wherein the RNAi agent does not comprise a 3'-end cap and wherein each of N26 and N27 is a 2'-OMe.

823. The composition of any of the preceding embodiments, wherein the oligonucleotide comprises a 3'-terminal dinucleotide represented by: -(N26-PX26-N27-PX27)yz, wherein yz=1 and wherein the RNAi agent does not comprise a 3'-end cap and wherein N26 is a 2'-deoxy.

824. The composition of any of the preceding embodiments, wherein the oligonucleotide comprises a 3'-terminal dinucleotide represented by: -(N26-PX26-N27-PX27)yz, wherein yz=1 and wherein the RNAi agent does not comprise a 3'-end cap and wherein N26 is a 2'-deoxy T.

825. The composition of any of the preceding embodiments, wherein the oligonucleotide comprises a 3'-terminal dinucleotide represented by: -(N26-PX26-N27-PX27)yz, wherein yz=1 and wherein the RNAi agent does not comprise a 3'-end cap and wherein N26 is a 2'-deoxy T further comprising a linker, a GalNAc moiety, or a linker and a GalNAc moiety.

826. The composition of any of the preceding embodiments, wherein the oligonucleotide comprises a 3'-terminal dinucleotide represented by: -(N26-PX26-N27-PX27)yz, wherein yz=1 and wherein the RNAi agent does not comprise a 3'-end cap and wherein N26 is a 2'-deoxy T further comprising a non-cleavable linker, a GalNAc moiety, or a non-cleavable linker and a GalNAc moiety.

827. The composition of any of the preceding embodiments, wherein the penultimate nucleotide of the oligonucleotide, counting from the 5'-end to the 3'-end, comprises a linker, a GalNAc moiety, or a linker and a GalNAc moiety.

828. The composition of any of the preceding embodiments, wherein the penultimate nucleotide of the oligonucleotide, counting from the 5'-end to the 3'-end, comprises a linker conjugated to the base of the nucleotide, a GalNAc moiety conjugated to the base, or a linker and a GalNAc moiety conjugated to the base.

829. The composition of any of the preceding embodiments, wherein a nucleotide of the oligonucleotide comprises a linker conjugated to the base of the nucleotide, a GalNAc moiety conjugated to the base, or a linker and a GalNAc moiety conjugated to the base.

830. The composition of any of the preceding embodiments, wherein the penultimate nucleotide of the oligonucleotide, counting from the 5'-end to the 3'-end, comprises a non-cleavable linker conjugated to the base of the nucleotide, a GalNAc moiety conjugated to the base, or a non-cleavable linker and a GalNAc moiety conjugated to the base.

831. The composition of any of the preceding embodiments, wherein a nucleotide of the oligonucleotide comprises a non-cleavable linker conjugated to the base of the nucleotide, a GalNAc moiety conjugated to the base, or a non-cleavable linker and a GalNAc moiety conjugated to the base.

832. The composition of any of the preceding embodiments, wherein the oligonucleotide comprises a 3'-terminal dinucleotide represented by: -(N26-PX26-N27-PX27)yz, wherein yz=1 and wherein the RNAi agent does not comprise a 3'-end cap and wherein N26 is a 2'-deoxy T further comprising a linker, a carbohydrate, or a linker and a carbohydrate.

833. The composition of any of the preceding embodiments, wherein the oligonucleotide comprises a 3'-terminal dinucleotide represented by: -(N26-PX26-N27-PX27)yz, wherein yz=1 and wherein the RNAi agent does not comprise a 3'-end cap and wherein N26 is a 2'-deoxy T further comprising a non-cleavable linker, a carbohydrate, or a non-cleavable linker and a carbohydrate.

834. The composition of any of the preceding embodiments, wherein the penultimate nucleotide of the oligonucleotide, counting from the 5'-end to the 3'-end, comprises a linker, a carbohydrate, or a linker and a carbohydrate.

835. The composition of any of the preceding embodiments, wherein the penultimate nucleotide of the oligonucleotide, counting from the 5'-end to the 3'-end, comprises a linker conjugated to the base of the nucleotide, a carbohydrate conjugated to the base, or a linker and a carbohydrate conjugated to the base.

836. The composition of any of the preceding embodiments, wherein a nucleotide of the oligonucleotide comprises a linker conjugated to the base of the nucleotide, a carbohydrate conjugated to the base, or a linker and a carbohydrate conjugated to the base.

837. The composition of any of the preceding embodiments, wherein the penultimate nucleotide of the oligonucleotide, counting from the 5'-end to the 3'-end, comprises a non-cleavable linker conjugated to the base of the nucleotide, a carbohydrate conjugated to the base, or a non-cleavable linker and a carbohydrate conjugated to the base.

838. The composition of any of the preceding embodiments, wherein a nucleotide of the oligonucleotide comprises a non-cleavable linker conjugated to the base of the nucleotide, a carbohydrate conjugated to the base, or a non-cleavable linker and a carbohydrate conjugated to the base.

839. The composition of any of the preceding embodiments, wherein the oligonucleotide comprises a 3'-terminal dinucleotide represented by: -(N26-PX26-N27-PX27)yz, wherein yz=1 and wherein the RNAi agent does not comprise a 3'-end cap and wherein N26 is a 2'-deoxy T further comprising a linker, a carbohydrate, or a linker and a carbohydrate.

840. The composition of any of the preceding embodiments, wherein the oligonucleotide comprises a 3'-terminal dinucleotide represented by: -(N26-PX26-N27-PX27)yz, wherein yz=1 and wherein the RNAi agent does not comprise a 3'-end cap and wherein N26 is a 2'-deoxy T further comprising a non-cleavable linker, a carbohydrate, or a non-cleavable linker and a carbohydrate.

841. The composition of any of the preceding embodiments, wherein the penultimate nucleotide of the oligonucleotide, counting from the 5'-end to the 3'-end, comprises a linker, a carbohydrate, or a linker and a carbohydrate.

842. The composition of any of the preceding embodiments, wherein the penultimate nucleotide of the oligonucleotide, counting from the 5'-end to the 3'-end, comprises a linker conjugated to an internucleotidic linkage of the nucleotide, a carbohydrate conjugated to an internucleotidic linkage, or a linker and a carbohydrate conjugated to an internucleotidic linkage.

843. The composition of any of the preceding embodiments, wherein a nucleotide of the oligonucleotide comprises a linker conjugated to an internucleotidic linkage of the nucleotide, a carbohydrate conjugated to an internucleotidic linkage, or a linker and a carbohydrate conjugated to an internucleotidic linkage.

844. The composition of any of the preceding embodiments, wherein the penultimate nucleotide of the oligonucleotide, counting from the 5'-end to the 3'-end, comprises a non-cleavable linker conjugated to an internucleotidic linkage of the nucleotide, a carbohydrate conjugated to an internucleotidic linkage, or a non-cleavable linker and a carbohydrate conjugated to an internucleotidic linkage.

845. The composition of any of the preceding embodiments, wherein a nucleotide of the oligonucleotide comprises a non-cleavable linker conjugated to an internucleotidic linkage of the nucleotide, a carbohydrate conjugated to an internucleotidic linkage, or a non-cleavable linker and a carbohydrate conjugated to an internucleotidic linkage.

846. The composition of any of the preceding embodiments, wherein the penultimate nucleotide of the oligonucleotide, counting from the 5'-end to the 3'-end, comprises a linker conjugated to an internucleotidic linkage of the nucleotide, a carbohydrate conjugated to an internucleotidic linkage, or a linker and a carbohydrate conjugated to an internucleotidic linkage, wherein the internucleotidic linkage is a phosphodiester.

847. The composition of any of the preceding embodiments, wherein a nucleotide of the oligonucleotide comprises a linker conjugated to an internucleotidic linkage of the nucleotide, a carbohydrate conjugated to an internucleotidic linkage, or a linker and a carbohydrate conjugated to an internucleotidic linkage, wherein the internucleotidic linkage is a phosphodiester.

848. The composition of any of the preceding embodiments, wherein the penultimate nucleotide of the oligonucleotide, counting from the 5'-end to the 3'-end, comprises a non-cleavable linker conjugated to an internucleotidic linkage of the nucleotide, a carbohydrate conjugated to an internucleotidic linkage, or a non-cleavable linker and a carbohydrate conjugated to an internucleotidic linkage, wherein the internucleotidic linkage is a phosphodiester.

849. The composition of any of the preceding embodiments, wherein a nucleotide of the oligonucleotide comprises a non-cleavable linker conjugated to an internucleotidic linkage of the nucleotide, a carbohydrate conjugated to an internucleotidic linkage, or a non-cleavable linker and a carbohydrate conjugated to an internucleotidic linkage, wherein the internucleotidic linkage is a phosphodiester.

850. The composition of any of the preceding embodiments, wherein the penultimate nucleotide of the oligonucleotide, counting from the 5'-end to the 3'-end, comprises a linker conjugated to an internucleotidic linkage of the nucleotide, a carbohydrate conjugated to an internucleotidic linkage, or a linker and a carbohydrate conjugated to an internucleotidic linkage, wherein the internucleotidic linkage is a phosphorothioate.

851. The composition of any of the preceding embodiments, wherein a nucleotide of the oligonucleotide comprises a linker conjugated to an internucleotidic linkage of the nucleotide, a carbohydrate conjugated to an internucleotidic linkage, or a linker and a carbohydrate conjugated to an internucleotidic linkage, wherein the internucleotidic linkage is a phosphorothioate.

852. The composition of any of the preceding embodiments, wherein the penultimate nucleotide of the oligonucleotide, counting from the 5'-end to the 3'-end, comprises a non-cleavable linker conjugated to an internucleotidic linkage of the nucleotide, a carbohydrate conjugated to an internucleotidic linkage, or a non-cleavable linker and a carbohydrate conjugated to an internucleotidic linkage, wherein the internucleotidic linkage is a phosphorothioate.

853. The composition of any of the preceding embodiments, wherein a nucleotide of the oligonucleotide comprises a non-cleavable linker conjugated to an internucleotidic linkage of the nucleotide, a carbohydrate conjugated to an internucleotidic linkage, or a non-cleavable linker and a carbohydrate conjugated to an internucleotidic linkage, wherein the internucleotidic linkage is a phosphorothioate.

854. The composition of any of the preceding embodiments, wherein the oligonucleotide comprises GaNC6T.

855. The composition of any of the preceding embodiments, wherein the penultimate nucleotide, counting from the 5'-end to the 3'-end, comprises GaNC6T.

856. The composition of any of the preceding embodiments, wherein the oligonucleotide further comprises a lipid.

857. The composition of any of the preceding embodiments, wherein the oligonucleotide further comprises a lipid conjugated to a base directly or via a linker.

858. The composition of any of the preceding embodiments, wherein the oligonucleotide further comprises a lipid conjugated to a base directly or via a linker, wherein the base is T.

859. The composition of any of the preceding embodiments, wherein the oligonucleotide further comprises a lipid conjugated to a base directly, wherein the base is T.

860. The composition of any of the preceding embodiments, wherein the oligonucleotide further comprises a lipid conjugated to a base via a linker, wherein the base is T.

861. The composition of any of the preceding embodiments, wherein the oligonucleotide comprises lmU.

862. The composition of any of the preceding embodiments, wherein the oligonucleotide further comprises a GalNAc moiety and a lipid.

863. The composition of any of the preceding embodiments, wherein the oligonucleotide further comprises a GalNAc moiety and lmU.

864. The composition of any of the preceding embodiments, wherein the oligonucleotide further comprises GaNC6T and lmU.

865. The composition of any of the preceding embodiments, wherein the oligonucleotide comprises a 3'-terminal dinucleotide represented by: -(N26-PX26-N27-PX27)yz, wherein yz=1 and wherein the RNAi agent does not comprise a 3'-end cap and wherein (N26-PX26-N27-PX27)yz is represented by a structure of formula VI-a or VI-b, wherein yz=1, and Th and Ur=nucleobases Thymine or Uracil.

866. The composition of any of the preceding embodiments, wherein the oligonucleotide comprises a 3'-terminal nucleotide represented by (N26-PX26-N27-PX27)yz, wherein yz=1, N26 is 2'-OMe and N27 is 2'-OMe.

867. The composition of any of the preceding embodiments, wherein the oligonucleotide comprises a 3'-terminal nucleotide represented by (N26-PX26-N27-PX27)yz, wherein yz=1, N26 is 2'-deoxy and N27 is 2'-OMe.

868. The composition of any of the preceding embodiments, wherein the oligonucleotide comprises a 3'-terminal nucleotide represented by (N26-PX26-N27-PX27)yz, wherein yz=1, N26 is 2'-deoxy and N27 is 2'-OMe, and wherein N26 comprises a linker.

869. The composition of any of the preceding embodiments, wherein the oligonucleotide comprises a 3'-terminal nucleotide represented by (N26-PX26-N27-PX27)yz, wherein yz=1, and wherein N26 comprises a linker.

870. The composition of any of the preceding embodiments, wherein the oligonucleotide comprises a 3'-terminal nucleotide represented by (N26-PX26-N27-PX27)yz, wherein yz=1, N26 is 2'-deoxy and N27 is 2'-OMe, and wherein N26 comprises a linker conjugated to an additional chemical moiety.

871. The composition of any of the preceding embodiments, wherein the oligonucleotide comprises a 3'-terminal nucleotide represented by (N26-PX26-N27-PX27)yz, wherein yz=1, N26 is 2'-deoxy T and N27 is 2'-OMe U, and wherein N26 comprises a linker conjugated to an additional chemical moiety.

872. The composition of any of the preceding embodiments, wherein the oligonucleotide comprises a 3'-terminal nucleotide represented by (N26-PX26-N27-PX27)yz, wherein yz=1, and wherein N26 comprises a linker conjugated to an additional chemical moiety selected from: a targeting moiety, a lipid, a carbohydrate, and a GalNAc moiety.

873. The composition of any of the preceding embodiments, wherein the oligonucleotide comprises a 3'-terminal nucleotide represented by (N26-PX26-N27-PX27)yz, wherein yz=1, N26 is 2'-deoxy and N27 is 2'-OMe, and wherein N26 comprises a linker conjugated to an additional chemical moiety selected from: a targeting moiety, a lipid, a carbohydrate, and a GalNAc moiety.

874. The composition of any of the preceding embodiments, wherein the oligonucleotide comprises a 3'-terminal nucleotide represented by (N26-PX26-N27-PX27)yz, wherein yz=1, N26 is 2'-deoxy T and N27 is 2'-OMe U, and wherein N26 comprises a linker conjugated to an additional chemical moiety selected from: a targeting moiety, a lipid, a carbohydrate, and a GalNAc moiety.

875. The composition of any one of the preceding embodiments, further comprising at least one pharmaceutically acceptable excipient.

876. The composition of any one of the preceding embodiments, wherein the composition is formulated for parenteral administration.

877. The composition of any one of the preceding embodiments, wherein the composition is a liquid.

878. The composition of any one of the preceding embodiments, wherein the composition is a liquid having a pH of about 5-8.

879. The composition of any one of the preceding embodiments, wherein the composition is a liquid suitable for delivery to a subject.

880. The composition of any one of the preceding embodiments, wherein the composition is a solid.

881. The composition of any one of the preceding embodiments, wherein the composition is a powder.

882. The composition of any one of the preceding embodiments, wherein the composition is a cake.

883. The composition of any one of the preceding embodiments, wherein the composition further comprises a lyoprotectant.

884. The composition of any one of the preceding embodiments, wherein the composition is disposed within a container.

885. The composition of any of the preceding embodiments, wherein the oligonucleotide comprises a GalNAc moiety linked to a base.

886. The composition of any of the preceding embodiments, wherein the oligonucleotide comprises a GalNAc moiety linked to a base via a linker.

887. The composition of any of the preceding embodiments, wherein the oligonucleotide comprises a GalNAc moiety linked to a base via a non-cleavable linker.

888. The composition of any of the preceding embodiments, wherein the oligonucleotide comprises a GalNAc moiety linked to a base via an aminomodifier linker.

889. The composition of any of the preceding embodiments, wherein the oligonucleotide comprises a GalNAc moiety linked to a base at the penultimate nucleotide (counting 5 to 3') of an oligonucleotide via a linker.

890. The composition of any of the preceding embodiments, wherein the oligonucleotide comprises a GalNAc moiety linked to a base at the penultimate nucleotide (counting 5 to 3') of an oligonucleotide via a non-cleavable linker.

891. The composition of any of the preceding embodiments, wherein the oligonucleotide comprises a GalNAc moiety linked to a base at the penultimate nucleotide (counting 5 to 3') of an oligonucleotide via an aminomodifier linker.

892. The composition of any of the preceding embodiments, wherein the oligonucleotide comprises a GalNAc moiety linked to a base at the antepenultimate nucleotide (counting 5 to 3') of an oligonucleotide via a linker.

893. The composition of any of the preceding embodiments, wherein the oligonucleotide comprises a GalNAc moiety linked to a base at the antepenultimate nucleotide (counting 5 to 3') of an oligonucleotide via a non-cleavable linker.

894. The composition of any of the preceding embodiments, wherein the oligonucleotide comprises a GalNAc moiety linked to a base at the antepenultimate nucleotide (counting 5 to 3') of an oligonucleotide via an aminomodifier linker.

895. The composition of any of the preceding embodiments, wherein the oligonucleotide is conjugated to a second oligonucleotide.

896. The composition of any of the preceding embodiments, wherein the oligonucleotide is capable of directing RNA interference and is conjugated to a second oligonucleotide, which is also capable of directing RNA interference.

897. The composition of any of the preceding embodiments, wherein the oligonucleotide is capable of directing RNA interference and is conjugated to a second oligonucleotide, which is capable of directing RNase H-mediated knockdown.

898. The composition of any of the preceding embodiments, wherein the oligonucleotide is capable of directing RNase H-mediated knockdown and is conjugated to a second oligonucleotide, which is capable of directing RNA interference.

899. The composition of any of the preceding embodiments, wherein the oligonucleotide is capable of directing RNase H-mediated knockdown and/or RNA interference and is conjugated to a second oligonucleotide, which is capable of directing RNase H-mediated knockdown and/or RNA interference.

900. The composition of any of the preceding embodiments, wherein the oligonucleotide is conjugated via a linker to a second oligonucleotide.

901. The composition of any of the preceding embodiments, wherein the oligonucleotide is capable of directing RNA interference and is conjugated via a linker to a second oligonucleotide, which is also capable of directing RNA interference.

902. The composition of any of the preceding embodiments, wherein the oligonucleotide is capable of directing RNA interference and is conjugated via a linker to a second oligonucleotide, which is capable of directing RNase H-mediated knockdown.

903. The composition of any of the preceding embodiments, wherein the oligonucleotide is capable of directing RNase H-mediated knockdown and is conjugated via a linker to a second oligonucleotide, which is capable of directing RNA interference.

904. The composition of any of the preceding embodiments, wherein the oligonucleotide is capable of directing RNase H-mediated knockdown and/or RNA interference and is conjugated via a linker to a second oligonucleotide, which is capable of directing RNase H-mediated knockdown and/or RNA interference.

905. The composition of any of the preceding embodiments, wherein the oligonucleotide comprises a 5'-Me OH, 5'-Me PO, 5'-Me PS or 5'-Me PH.

906. The composition of any of the preceding embodiments, wherein the oligonucleotide comprises a 5'-end region comprising 5'-Me OH, 5'-Me PO, 5'-Me PS or 5'-Me PH.

907. The composition of any of the preceding embodiments, wherein the oligonucleotide comprises a 5'-Me OH DNA T, 5'-Me PO DNA T, 5'-Me PS DNA T or 5'-Me PH DNA T.

908. The composition of any of the preceding embodiments, wherein the oligonucleotide comprises a 5'-end region comprising 5'-Me OH DNA T, 5'-Me PO DNA T, 5'-Me PS DNA T or 5'-Me PH DNA T.
909. The composition of any of the preceding embodiments, wherein PX0-N1- is any of: 5'-Me OH DNA T, 5'-Me PO DNA T, 5'-Me PS DNA T or 5'-Me PH DNA T.
910. The composition of any of the preceding embodiments, wherein the oligonucleotide comprises a 5'-(R)-Me OH, 5'-(R)-Me PO, 5'-(R)-Me PS or 5'-(R)-Me PH.
911. The composition of any of the preceding embodiments, wherein the oligonucleotide comprises a 5'-end region comprising 5'-(R)-Me OH, 5'-(R)-Me PO, 5'-(R)-Me PS or 5'-(R)-Me PH.
912. The composition of any of the preceding embodiments, wherein the oligonucleotide comprises a 5'-(R)-Me OH DNA T, 5'-(R)-Me PO DNA T, 5'-(R)-Me PS DNA T or 5'-(R)-Me PH DNA T.
913. The composition of any of the preceding embodiments, wherein the oligonucleotide comprises a 5'-end region comprising 5'-(R)-Me OH DNA T, 5'-(R)-Me PO DNA T, 5'-(R)-Me PS DNA T or 5'-(R)-Me PH DNA T.
914. The composition of any of the preceding embodiments, wherein PX0-N1- is any of: 5'-(R)-Me OH DNA T, 5'-(R)-Me PO DNA T, 5'-(R)-Me PS DNA T or 5'-(R)-Me PH DNA T.
915. The composition of any of the preceding embodiments, wherein the oligonucleotide comprises a 5'-(S)-Me OH, 5'-(S)-Me PO, 5'-(S)-Me PS or 5'-(S)-Me PH.
916. The composition of any of the preceding embodiments, wherein the oligonucleotide comprises a 5'-end region comprising 5'-(S)-Me OH, 5'-(S)-Me PO, 5'-(S)-Me PS or 5'-(S)-Me PH.
917. The composition of any of the preceding embodiments, wherein the oligonucleotide comprises a 5'-(S)-Me OH DNA T, 5'-(S)-Me PO DNA T, 5'-(S)-Me PS DNA T or 5'-(S)-Me PH DNA T.
918. The composition of any of the preceding embodiments, wherein the oligonucleotide comprises a 5'-end region comprising 5'-(S)-Me OH DNA T, 5'-(S)-Me PO DNA T, 5'-(S)-Me PS DNA T or 5'-(S)-Me PH DNA T.
919. The composition of any of the preceding embodiments, wherein PX0-N1- is any of: 5'-(S)-Me OH DNA T, 5'-(S)-Me PO DNA T, 5'-(S)-Me PS DNA T or 5'-(S)-Me PH DNA T.
920. The composition of any of the preceding embodiments, wherein the oligonucleotide comprises a 5'-end region comprising a structure which is any of: C3PO, Mod022, POMod023, PXMod023, PHMod023, any of V-a to V-e, any of II-a to II-1 or any of III-a to III-1.
921. The composition of any of the preceding embodiments, wherein the oligonucleotide comprises a a structure which is any of: C3PO, Mod022, POMod023, PXMod023, PHMod023, any of V-a to V-e, any of II-a to II-1 or any of III-a to III-1.
922. The composition of any of the preceding embodiments, wherein the oligonucleotide comprises a 5'-end region comprising a structure which is any of: C3PO, Mod022, POMod023, PXMod023, PHMod023, any of V-a to V-e, any of II-a to II-1 or any of III-a to III-1.
923. The composition of any of the preceding embodiments, wherein PX0-N1- is any of: a structure which is any of: C3PO, Mod022, POMod023, PXMod023, PHMod023, any of V-a to V-e, any of II-a to II-1 or any of III-a to III-1.
924. The composition of any of the preceding embodiments, wherein the 5'-end nucleotide (the nucleotide at the 5'-end) of the oligonucleotide is DNA.
925. The composition of any of the preceding embodiments, wherein the 5'-end nucleotide (the nucleotide at the 5'-end) of the oligonucleotide is DNA T.
926. The composition of any of the preceding embodiments, wherein the 5'-end nucleotide (the nucleotide at the 5'-end) of the oligonucleotide is 2'-OMe.
927. The composition of any of the preceding embodiments, wherein the 5'-end nucleotide (the nucleotide at the 5'-end) of the oligonucleotide is 2'-F.
928. The composition of any of the preceding embodiments, wherein the oligonucleotide comprises a a structure which is any of: 5'-OH DNA, 5'-OH DNA T, 5'-PO DNA, 5'-PO DNA T, 5'-PO 2'OMe, 5'OH 2'-OMe, 5'-OH 2'-F, 5'-PO 2'-F.
929. The composition of any of the preceding embodiments, wherein the oligonucleotide comprises a 5'-end region comprising a structure which is any of: 5'-OH DNA, 5'-OH DNA T, 5'-PO DNA, 5'-PO DNA T, 5'-PO 2'OMe, 5'OH 2'-OMe, 5'-OH 2'-F, 5'-PO 2'-F.
930. The composition of any of the preceding embodiments, wherein PX0-N1- is any of: a structure which is any of: 5'-OH DNA, 5'-OH DNA T, 5'-PO DNA, 5'-PO DNA T, 5'-PO 2'OMe, 5'OH 2'-OMe, 5'-OH 2'-F, 5'-PO 2'-F.
931. The composition of any of the preceding embodiments, wherein the oligonucleotide comprises two 2'-F.
932. The composition of any of the preceding embodiments, wherein the oligonucleotide comprises a 2'-F at position 2 and a 2'-F at position 14, counting from the 5' end.
933. The composition of any of the preceding embodiments, wherein the oligonucleotide comprises a lipid.
934. The composition of any of the preceding embodiments, wherein the oligonucleotide comprises a lipid conjugated to a base.
935. The composition of any of the preceding embodiments, wherein the oligonucleotide comprises a lipid conjugated to a base via a linker.
936. The composition of any of the preceding embodiments, wherein the oligonucleotide comprises a lipid conjugated to a base via a linker at position 9 and/or 11, counting from the 5' end.
937. The composition of any of the preceding embodiments, wherein the oligonucleotide is capable of mediating allele-specific suppression.
938. The composition of any of the preceding embodiments, wherein the oligonucleotide is capable of mediating allele-specific suppression and has a base sequence which comprises a position which has a match to a mutant sequence which is related to or associated with a disorder, which position does not match a wild-type sequence which is not related or associated with the disorder.
939. The composition of any of the preceding embodiments, wherein the oligonucleotide is capable of mediating allele-specific suppression and has a base sequence which comprises a position which has a match to a mutant sequence which is related to or associated with a disorder, which position does not match a wild-type sequence which is not related or associated with the disorder, wherein the position is at position 14 or 17 counting from the 5' end.
940. The composition of any of the preceding embodiments, wherein the oligonucleotide is capable of mediating allele-specific suppression and has a base sequence which comprises two positions which have a match to a mutant sequence which is related to or associated with a disorder, which two positions do not match a wild-type sequence which is not related or associated with the disorder, wherein the positions are at position 14 or 17 counting from the 5' end.

941. The composition of any of the preceding embodiments, wherein the oligonucleotide is capable of mediating allele-specific suppression of PNPLA3.

942. The composition of any of the preceding embodiments, wherein the oligonucleotide has a GC content of about 74% or lower.

943. The composition of any of the preceding embodiments, wherein the oligonucleotide has a GC content of about 52% to about 74%.

944. The composition of any of the preceding embodiments, wherein the oligonucleotide has a GC content of about 55% to about 74%.

945. The composition of any of the preceding embodiments, wherein the oligonucleotide comprises a continuous GC span of at least 10 nucleotides.

946. The composition of any of the preceding embodiments, wherein the oligonucleotide comprises a continuous GC span of at least 11 nucleotides.

947. The composition of any of the preceding embodiments, wherein the oligonucleotide is capable of directing both RNA interference and RNaseH-mediated knockdown.

948. The composition of any of the preceding embodiments, wherein the oligonucleotide is capable of directing both RNA interference and RNaseH-mediated knockdown, and wherein the oligonucleotide comprises a span of continuous 2'-deoxy nucleotides.

949. The composition of any of the preceding embodiments, wherein the oligonucleotide is capable of directing both RNA interference and RNaseH-mediated knockdown, and wherein the oligonucleotide comprises a span of at least 5 continuous 2'-deoxy nucleotides.

950. The composition of any of the preceding embodiments, wherein the oligonucleotide is capable of directing both RNA interference and RNaseH-mediated knockdown, and wherein the oligonucleotide comprises a span of at least 6 continuous 2'-deoxy nucleotides.

951. The composition of any of the preceding embodiments, wherein the oligonucleotide is capable of directing both RNA interference and RNaseH-mediated knockdown, and wherein the oligonucleotide comprises a span of at least 7 continuous 2'-deoxy nucleotides.

952. The composition of any of the preceding embodiments, wherein the oligonucleotide is capable of directing both RNA interference and RNaseH-mediated knockdown, and wherein the oligonucleotide comprises a span of at least 8 continuous 2'-deoxy nucleotides.

953. The composition of any of the preceding embodiments, wherein the oligonucleotide is capable of directing both RNA interference and RNaseH-mediated knockdown, and wherein the oligonucleotide comprises a span of at least 9 continuous 2'-deoxy nucleotides.

954. The composition of any of the preceding embodiments, wherein the oligonucleotide is capable of directing both RNA interference and RNaseH-mediated knockdown, and wherein the oligonucleotide comprises a span of at least 10 continuous 2'-deoxy nucleotides.

955. The composition of any of the preceding embodiments, wherein the oligonucleotide is capable of directing both RNA interference and RNaseH-mediated knockdown, and wherein the post-seed region comprises a span of continuous 2'-deoxy nucleotides.

956. The composition of any of the preceding embodiments, wherein the oligonucleotide is capable of directing both RNA interference and RNaseH-mediated knockdown, and wherein the post-seed region comprises a span of at least 5 continuous 2'-deoxy nucleotides.

957. The composition of any of the preceding embodiments, wherein the oligonucleotide is capable of directing both RNA interference and RNaseH-mediated knockdown, and wherein the post-seed region comprises a span of at least 6 continuous 2'-deoxy nucleotides.

958. The composition of any of the preceding embodiments, wherein the oligonucleotide is capable of directing both RNA interference and RNaseH-mediated knockdown, and wherein the post-seed region comprises a span of at least 7 continuous 2'-deoxy nucleotides.

959. The composition of any of the preceding embodiments, wherein the oligonucleotide is capable of directing both RNA interference and RNaseH-mediated knockdown, and wherein the post-seed region comprises a span of at least 8 continuous 2'-deoxy nucleotides.

960. The composition of any of the preceding embodiments, wherein the oligonucleotide is capable of directing both RNA interference and RNaseH-mediated knockdown, and wherein the post-seed region comprises a span of at least 9 continuous 2'-deoxy nucleotides.

961. The composition of any of the preceding embodiments, wherein the oligonucleotide is capable of directing both RNA interference and RNaseH-mediated knockdown, and wherein the post-seed region comprises a span of at least 10 continuous 2'-deoxy nucleotides.

962. The composition of any of the preceding embodiments, wherein the oligonucleotide comprises a LNA.

963. The composition of any of the preceding embodiments, wherein the oligonucleotide comprises a LNA and an internucleotidic linkage which is chirally controlled.

964. The composition of any of the preceding embodiments, wherein the oligonucleotide comprises a LNA and a phosphorothioate in the Sp configuration.

965. The composition of any of the preceding embodiments, wherein the oligonucleotide comprises a LNA and a phosphorothioate in the Rp configuration.

966. The composition of any of the preceding embodiments, wherein the oligonucleotide comprises a LNA and a phosphorothioate in the Rp configuration and a phosphorothioate in the Sp configuration.

967. The composition or compound of any one of the preceding embodiments, wherein oligonucleotides of the composition or the compound comprises 1, 2, 3, 4, 5, 6, 7, 8, 9, 10 or more non-negatively charged internucleotidic linkages.

968. The composition or compound of any one of the preceding embodiments, wherein a neutral internucleotidic linkage is a chiral internucleotidic linkage.

969. The composition or compound of any one of the preceding embodiments, wherein a neutral internucleotidic linkage is a chirally controlled internucleotidic linkage independently of Rp or Sp at its linkage phosphorus.

970. The composition or compound of any one of the preceding embodiments, wherein a non-negatively charged internucleotidic linkage is a phosphoramidate linkage.

971. The composition or compound of any one of the preceding embodiments, wherein a non-negatively charged internucleotidic linkage comprises a guanidine moiety.

972. The composition or compound of any one of the preceding embodiments, wherein a non-negatively charged internucleotidic linkage has the structure of formula I or a salt form thereof.

973. The composition or compound of any one of the preceding embodiments, wherein each non-negatively charged internucleotidic linkage independently has the structure of formula I or a salt form thereof.

974. The composition or compound of any one of the preceding embodiments, wherein a non-negatively charged internucleotidic linkage has the structure of formula I-n-1 or a salt form thereof.

975. The composition or compound of any one of the preceding embodiments, wherein each non-negatively charged internucleotidic linkage independently has the structure of formula I-n-1 or a salt form thereof.

976. The composition or compound of any one of the preceding embodiments, wherein a non-negatively charged internucleotidic linkage has the structure of formula I-n-2 or a salt form thereof.

977. The composition or compound of any one of the preceding embodiments, wherein each non-negatively charged internucleotidic linkage has the structure of formula I-n-2 or a salt form thereof.

978. The composition or compound of any one of the preceding embodiments, wherein a non-negatively charged internucleotidic linkage has the structure of formula I-n-3 or a salt form thereof.

979. The composition or compound of any one of the preceding embodiments, each non-negatively charged internucleotidic linkage independently has the structure of formula I-n-3 or a salt form thereof.

980. The composition or compound of any one of the preceding embodiments, wherein a non-negatively charged internucleotidic linkage has the structure of formula I-n-3 or a salt form thereof, wherein one R' from one —N(R')$_2$ and one R' from the other —N(R')$_2$ are taken together with their intervening atoms to form an optionally substituted, 3-30 membered, monocyclic, bicyclic or polycyclic ring having, in addition to the intervening atoms, 0-10 heteroatoms.

981. The composition or compound of any one of the preceding embodiments, wherein each non-negatively charged internucleotidic linkage independently has the structure of formula I-n-3 or a salt form thereof, wherein one R' from one —N(R')$_2$ and one R' from the other —N(R')$_2$ are taken together with their intervening atoms to form an optionally substituted, 3-30 membered, monocyclic, bicyclic or polycyclic ring having, in addition to the intervening atoms, 0-10 heteroatoms.

982. The composition or compound of any one of the preceding embodiments, wherein a non-negatively charged internucleotidic linkage has the structure of formula I-n-3 or a salt form thereof, wherein one R' from one —N(R')$_2$ and one R' from the other —N(R')$_2$ are taken together with their intervening atoms to form an optionally substituted 5-membered monocyclic ring having no more than two nitrogen atoms.

983. The composition or compound of any one of the preceding embodiments, wherein each non-negatively charged internucleotidic linkage independently has the structure of formula I-n-3 or a salt form thereof, wherein one R' from one —N(R')$_2$ and one R' from the other —N(R')$_2$ are taken together with their intervening atoms to form an optionally substituted 5-membered monocyclic ring having no more than two nitrogen atoms.

984. The composition or compound of any one of the preceding embodiments, wherein the ring formed is a saturated ring.

985. The composition or compound of any one of the preceding embodiments, wherein the ring formed is a partially unsaturated ring.

986. The composition or compound of any one of the preceding embodiments, wherein a non-negatively charged internucleotidic linkage has the structure of formula II or a salt form thereof.

987. The composition or compound of any one of the preceding embodiments, wherein each non-negatively charged internucleotidic linkage independently has the structure of formula II, or a salt form thereof.

988. The composition or compound of any one of the preceding embodiments, wherein a non-negatively charged internucleotidic linkage has the structure of formula II-a-1 or a salt form thereof.

989. The composition or compound of any one of the preceding embodiments, wherein each non-negatively charged internucleotidic linkage independently has the structure of formula II-a-1, or a salt form thereof.

990. The composition or compound of any one of the preceding embodiments, wherein a non-negatively charged internucleotidic linkage has the structure of formula II-a-2 or a salt form thereof.

991. The composition or compound of any one of the preceding embodiments, wherein each non-negatively charged internucleotidic linkage independently has the structure of formula II-a-2, or a salt form thereof.

992. The composition or compound of any one of the preceding embodiments, wherein a non-negatively charged internucleotidic linkage has the structure of formula II-b-1 or a salt form thereof.

993. The composition or compound of any one of the preceding embodiments, wherein each non-negatively charged internucleotidic linkage independently has the structure of formula II-b-1, or a salt form thereof.

994. The composition or compound of any one of the preceding embodiments, wherein a non-negatively charged internucleotidic linkage has the structure of formula II-b-2 or a salt form thereof.

995. The composition or compound of any one of the preceding embodiments, wherein each non-negatively charged internucleotidic linkage independently has the structure of formula II-b-2, or a salt form thereof.

996. The composition or compound of any one of the preceding embodiments, wherein a non-negatively charged internucleotidic linkage has the structure of formula II-c-1 or a salt form thereof.

997. The composition or compound of any one of the preceding embodiments, wherein each non-negatively charged internucleotidic linkage independently has the structure of formula II-c-1, or a salt form thereof.

998. The composition or compound of any one of the preceding embodiments, wherein a non-negatively charged internucleotidic linkage has the structure of formula II-c-2 or a salt form thereof.

999. The composition or compound of any one of the preceding embodiments, wherein each non-negatively charged internucleotidic linkage independently has the structure of formula II-c-2, or a salt form thereof.

1000. The composition or compound of any one of the preceding embodiments, wherein a non-negatively charged internucleotidic linkage has the structure of formula II-d-1 or a salt form thereof.

1001. The composition or compound of any one of the preceding embodiments, wherein each non-negatively charged internucleotidic linkage independently has the structure of formula II-d-1, or a salt form thereof.

1002. The composition or compound of any one of the preceding embodiments, wherein a non-negatively charged internucleotidic linkage has the structure of formula II-d-2 or a salt form thereof.

1003. The composition or compound of any one of the preceding embodiments, wherein each non-negatively charged internucleotidic linkage independently has the structure of formula II-d-2, or a salt form thereof.

1004. The composition or compound of any one of the preceding embodiments, wherein each non-negatively charged internucleotidic linkage has the same structure.

1005. The composition or compound of any one of the preceding embodiments, wherein, if applicable, each internucleotidic linkage in the oligonucleotides of the plurality that is not a non-negatively charged internucleotidic linkage independently has the structure of formula I.

1006. The composition or compound of any one of the preceding embodiments, wherein each internucleotidic linkage in the oligonucleotides of the plurality independently has the structure of formula I.

1007. The composition or compound of any one of the preceding embodiments, wherein a non-negatively charged internucleotidic linkage has the structure of

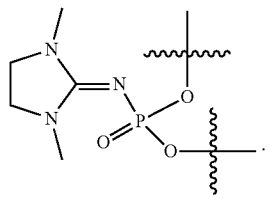

1008. The composition or compound of any one of the preceding embodiments, wherein a non-negatively charged internucleotidic linkage has the structure of

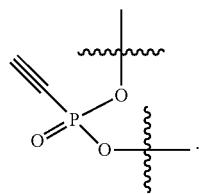

1009. The composition or compound of any one of the preceding embodiments, wherein a non-negatively charged internucleotidic linkage has the structure of

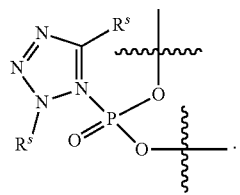

1010. The composition or compound of any one of the preceding embodiments, wherein for each internucleotidic linkage of formula I or a salt fore thereof that is not a non-negatively charged internucleotidic linkage, X is independently O or S, and -L$^s$-R$^5$ is —H (natural phosphate linkage or phosphorothioate linkage, respectively).

1011. The composition or compound of any one of the preceding embodiments, wherein each phosphorothioate linkage, if any, in the oligonucleotides of the plurality is independently a chirally controlled internucleotidic linkage.

1012. The composition or compound of any one of the preceding embodiments, wherein at least one non-negatively charged internucleotidic linkage is a chirally controlled oligonucleotide composition.

1013. The composition or compound of any one of the preceding embodiments, wherein at least one non-negatively charged internucleotidic linkage is a chirally controlled oligonucleotide composition.

1014. The composition or compound of any one of the preceding embodiments, wherein oligonucleotides of the plurality exist as salts, wherein one or more non-neutral internucleotidic linkages at the condition of the composition independently exist as a salt form.

1015. The composition or compound of any one of the preceding embodiments, wherein oligonucleotides of the plurality exist as salts, wherein one or more negatively-charged internucleotidic linkages at the condition of the composition independently exist as a salt form.

1016. The composition or compound of any one of the preceding embodiments, wherein oligonucleotides of the plurality exist as salts, wherein one or more negatively-charged internucleotidic linkages at the condition of the composition independently exist as a metal salt.

1017. The composition or compound of any one of the preceding embodiments, wherein oligonucleotides of the plurality exist as salts, wherein each negatively-charged internucleotidic linkage at the condition of the composition independently exists as a metal salt.

1018. The composition or compound of any one of the preceding embodiments, wherein oligonucleotides of the plurality exist as salts, wherein each negatively-charged internucleotidic linkage at the condition of the composition independently exists as sodium salt.

1019. The composition or compound of any one of the preceding embodiments, wherein oligonucleotides of the plurality exist as salts, wherein each negatively-charged internucleotidic linkage is independently a natural phosphate linkage (the neutral form of which is —O—P(O)(OH)—O) or phosphorothioate internucleotidic linkage (the neutral form of which is —O—P(O)(SH)—O).

1020. The composition or compound of any one of the preceding embodiments, wherein Z is -L$^3$-G-.

1021. The composition or compound of embodiment 1020, wherein G is connected to P$^L$.

1022. The composition or compound of any one of embodiments 1020-1021, wherein G is —O—.

1023. The composition or compound of any one of embodiments 1020-1021, wherein G is —S—.

1024. The composition or compound of any one of embodiments 1020-1021, wherein G is —N(R')—.

1025. The composition or compound of any one of embodiments 1020-1021, wherein G is —NH—.

1026. The composition or compound of any one of embodiments 1020-1025, wherein L$^3$ is optionally substituted methylene.

1027. The composition or compound of any one of embodiments 1020-1025, wherein L$^3$ is —C(R')$_2$—.

1028. The composition or compound of any one of embodiments 1020-1025, wherein L$^3$ is —CH$_2$—.

1029. The composition of any of the preceding embodiments, wherein the oligonucleotide comprises any sequence, structure or format (or portion thereof) disclosed herein.

1030. The composition of any of the preceding embodiments, wherein the oligonucleotide comprises any sequence, structure or format (or portion thereof) disclosed herein, wherein a structure is any 5'-end structure; 5'-end region; a first region; a second region; and a 3'-end region (which can be a 3'-terminal dinucleotide and/or a 3'-end cap); an optional additional chemical moiety (including but not limited to a targeting moiety, a carbohydrate, a GalNAc moiety and a lipid); stereochemistry or patterns of stereochemistry; modification or pattern of modification; internucleotidic linkage or pattern of internucleotidic linkages; modification of sugar(s) or pattern of modifications of sugars; modification of base(s) or patterns of modifications of bases disclosed herein.

1031. The composition of any of the preceding embodiments, wherein the oligonucleotide comprises two or more of any structure disclosed herein, wherein a structure is any 5'-end structure; 5'-end region; a first region; a second region; and a 3'-end region (which can be a 3'-terminal dinucleotide and/or a 3'-end cap); an optional additional chemical moiety (including but not limited to a targeting moiety, a carbohydrate, a GalNAc moiety and a lipid); stereochemistry or patterns of stereochemistry; modification or pattern of modification; internucleotidic linkage or pattern of internucleotidic linkages; modification of sugar(s) or pattern of modifications of sugars; modification of base(s) or patterns of modifications of bases disclosed herein.

1032. The composition of any of the preceding embodiments, wherein the oligonucleotide comprises three or more of any structure disclosed herein, wherein a structure is any 5'-end structure; 5'-end region; a first region; a second region; and a 3'-end region (which can be a 3'-terminal dinucleotide and/or a 3'-end cap); an optional additional chemical moiety (including but not limited to a targeting moiety, a carbohydrate, a GalNAc moiety and a lipid); stereochemistry or patterns of stereochemistry; modification or pattern of modification; internucleotidic linkage or pattern of internucleotidic linkages; modification of sugar(s) or pattern of modifications of sugars; modification of base(s) or patterns of modifications of bases disclosed herein.

1033. The composition of any of the preceding embodiments, wherein the oligonucleotide comprises four or more of any structure disclosed herein, wherein a structure is any 5'-end structure; 5'-end region; a first region; a second region; and a 3'-end region (which can be a 3'-terminal dinucleotide and/or a 3'-end cap); an optional additional chemical moiety (including but not limited to a targeting moiety, a carbohydrate, a GalNAc moiety and a lipid); stereochemistry or patterns of stereochemistry; modification or pattern of modification; internucleotidic linkage or pattern of internucleotidic linkages; modification of sugar(s) or pattern of modifications of sugars; modification of base(s) or patterns of modifications of bases disclosed herein.

1034. The composition of any of the preceding embodiments, wherein the oligonucleotide comprises five or more of any structure disclosed herein, wherein a structure is any 5'-end structure; 5'-end region; a first region; a second region; and a 3'-end region (which can be a 3'-terminal dinucleotide and/or a 3'-end cap); an optional additional chemical moiety (including but not limited to a targeting moiety, a carbohydrate, a GalNAc moiety and a lipid); stereochemistry or patterns of stereochemistry; modification or pattern of modification; internucleotidic linkage or pattern of internucleotidic linkages; modification of sugar(s) or pattern of modifications of sugars; modification of base(s) or patterns of modifications of bases disclosed herein.

1035. The composition of any of the preceding embodiments, wherein the oligonucleotide comprises any sequence disclosed herein and any structure disclosed herein, wherein a structure is any 5'-end structure; 5'-end region; a first region; a second region; and a 3'-end region (which can be a 3'-terminal dinucleotide and/or a 3'-end cap); an optional additional chemical moiety (including but not limited to a targeting moiety, a carbohydrate, a GalNAc moiety and a lipid); stereochemistry or patterns of stereochemistry; modification or pattern of modification; internucleotidic linkage or pattern of internucleotidic linkages; modification of sugar(s) or pattern of modifications of sugars; modification of base(s) or patterns of modifications of bases disclosed herein.

1036. The composition of any of the preceding embodiments, wherein the oligonucleotide comprises any sequence disclosed herein and two or more of any structure disclosed herein, wherein a structure is any 5'-end structure; 5'-end region; a first region; a second region; and a 3'-end region (which can be a 3'-terminal dinucleotide and/or a 3'-end cap); an optional additional chemical moiety (including but not limited to a targeting moiety, a carbohydrate, a GalNAc moiety and a lipid); stereochemistry or patterns of stereochemistry; modification or pattern of modification; internucleotidic linkage or pattern of internucleotidic linkages; modification of sugar(s) or pattern of modifications of sugars; modification of base(s) or patterns of modifications of bases disclosed herein.

1037. The composition of any of the preceding embodiments, wherein the oligonucleotide comprises any sequence disclosed herein and three or more of any structure disclosed herein, wherein a structure is any 5'-end structure; 5'-end region; a first region; a second region; and a 3'-end region (which can be a 3'-terminal dinucleotide and/or a 3'-end cap); an optional additional chemical moiety (including but not limited to a targeting moiety, a carbohydrate, a GalNAc moiety and a lipid); stereochemistry or patterns of stereochemistry; modification or pattern of modification; internucleotidic linkage or pattern of internucleotidic linkages; modification of sugar(s) or pattern of modifications of sugars; modification of base(s) or patterns of modifications of bases disclosed herein.

1038. The composition of any of the preceding embodiments, wherein the oligonucleotide comprises any sequence disclosed herein and four or more of any structure disclosed herein, wherein a structure is any 5'-end structure; 5'-end region; a first region; a second region; and a 3'-end region (which can be a 3'-terminal dinucleotide and/or a 3'-end cap); an optional additional chemical moiety (including but not limited to a targeting moiety, a carbohydrate, a GalNAc moiety and a lipid); stereochemistry or patterns of stereochemistry; modification or pattern of modification; internucleotidic linkage or pattern of internucleotidic linkages; modification of sugar(s) or pattern of modifications of sugars; modification of base(s) or patterns of modifications of bases disclosed herein.

1039. The composition of any of the preceding embodiments, wherein the oligonucleotide comprises any sequence disclosed herein and five or more of any structure disclosed herein, wherein a structure is any 5'-end structure; 5'-end region; a first region; a second region; and a 3'-end region (which can be a 3'-terminal dinucleotide and/or a 3'-end cap); an optional additional chemical moiety (including but not limited to a targeting moiety, a carbohydrate, a GalNAc moiety and a lipid); stereochemistry or patterns of stereochemistry; modification or pattern of modification; internucleotidic linkage or pattern of internucleotidic linkages; modification of sugar(s) or pattern of modifications of sugars; modification of base(s) or patterns of modifications of bases disclosed herein.

1040. The composition of any of the preceding embodiments, wherein the oligonucleotide is at least partially complementary to a second oligonucleotide further comprised in the composition, and where the oligonucleotide and the second oligonucleotide form at least partially form a duplex.

1041. The composition of any of the preceding embodiments, wherein the oligonucleotide is at least partially complementary to a second oligonucleotide further comprised in the composition, and where the oligonucleotide and the second oligonucleotide form at least partially form a double-stranded oligonucleotide.

1042. The composition of any of the preceding embodiments, wherein the oligonucleotide is complementary to a second oligonucleotide further comprised in the composition, and where the oligonucleotide and the second oligonucleotide form a duplex.

1043. The composition of any of the preceding embodiments, wherein the oligonucleotide is complementary to a second oligonucleotide further comprised in the composition, and where the oligonucleotide and the second oligonucleotide form a double-stranded oligonucleotide.

1044. The composition of any one of the preceding embodiments, wherein the composition is disposed within a container, wherein the container is a vial.

1045. The composition of any one of the preceding embodiments, wherein the composition is disposed within a container, wherein the container is a syringe.

1046. An oligonucleotide as described in any one of the previous embodiments.

1047. A method for treating a ACVR2B-related disorder in a subject, comprising the step of administering to the subject a therapeutically effective amount of a composition of any of preceding embodiments, wherein the oligonucleotide specifically targets ACVR2B.

1048. The method of any of the preceding embodiments, wherein the ACVR2B-related disorder is selected from: musculoskeletal disease or disorder; muscle atrophy or dystrophy; muscle atrophy as a result of or associated with any of: treatment with a glucocorticoid such as cortisol, dexamethasone, betamethasone, prednisone, methylprednisolone, or prednisolone, denervation due to nerve trauma or a result of degenerative, metabolic, or inflammatory neuropathy (e.g., Guillian-Barre syndrome, peripheral neuropathy, or exposure to environmental toxins or drugs), or myopathy, such as myotonia; a congenital myopathy, including nemalene myopathy, multi/minicore myopathy and myotubular (centronuclear) myopathy; mitochondrial myopathy; familial periodic paralysis; inflammatory myopathy; metabolic myopathy, such as caused by a glycogen or lipid storage disease; dermatomyositisis; polymyositis; inclusion body myositis; myositis ossificans; rhabdomyolysis and myoglobinurias; a muscular dystrophy syndrome, such as Duchenne, Becker, myotonic, fascioscapulohumeral, Emery-Dreifuss, oculopharyngeal, scapulohumeral, limb girdle, Fukuyama, a congenital muscular dystrophy, or hereditary distal myopathy; osteoporosis, a bone fracture, short stature, or dwarfism; muscle atrophy as a result of or associated with an adult motor neuron disease, infantile spinal muscular atrophy, amyotrophic lateral sclerosis, juvenile spinal muscular atrophy, autoimmune motor neuropathy with multifocal conductor block, paralysis due to stroke or spinal cord injury, skeletal immobilization due to trauma, prolonged bed rest, voluntary inactivity, involuntary inactivity, metabolic stress or nutritional insufficiency, cancer, AIDS, fasting, a thyroid gland disorder, diabetes, benign congenital hypotonia, central core disease, burn injury, chronic obstructive pulmonary disease, liver diseases (examples such as fibrosis, cirrhosis), sepsis, renal failure, congestive heart failure, ageing, space travel or time spent in a zero gravity environment; sarcopenia, skin atrophy, muscle wasting, brain atrophy, atherosclerosis, arteriosclerosis, pulmonary emphysema, osteoporosis, osteoarthritis, immunologic incompetence, high blood pressure, dementia, Huntington's disease, Alzheimer's disease, cataracts, age-related macular degeneration, prostate cancer, stroke, diminished life expectancy, frailty, memory loss, wrinkles, impaired kidney function, and age-related hearing loss; metabolic disorders, including Type II Diabetes, Metabolic Syndrome, hyperglycemia, and obesity; or acute and/or chronic renal disease or failure, liver fibrosis or cirrhosis, cancer such as breast cancer, Parkinson's Disease; cachexia, cachexia associated with a rheumatoid arthritis and cachexia associated with cancer; conditions associated with neuronal death, such as ALS, brain atrophy, or dementia and anemia; and a disorder which causes or is associated with muscle atrophy.

1049. The method of any of the preceding embodiments, wherein the composition further comprises a pharmaceutically acceptable carrier.

1050. The method of any of the preceding embodiments, wherein the method further comprises a step of administering a second agent to treat the ACVR2B-related disorder.

1051. The method of any of the preceding embodiments, wherein the second agent comprises an oligonucleotide which specifically targets ACVR2B.

1052. The method of any of the preceding embodiments, wherein the steps of administering the composition and the second agent are simultaneously, concurrent, separate or sequential.

1053. A method of decreasing the expression and/or level of a target gene or its gene product in a subject comprising the step of administering to the subject a therapeutically effective amount of a composition of any of preceding embodiments, comprising the step of administering to the subject a therapeutically effective amount of a composition of any of preceding embodiments, wherein the oligonucleotide specifically targets ACVR2B.

1054. The method of any of the preceding embodiments, wherein the ACVR2B-related disorder is selected from: musculoskeletal disease or disorder; muscle atrophy or dystrophy; muscle atrophy as a result of or associated with any of: treatment with a glucocorticoid such as cortisol, dexamethasone, betamethasone, prednisone, methylprednisolone, or prednisolone, denervation due to nerve trauma or a result of degenerative, metabolic, or inflammatory neuropathy (e.g., Guillian-Barre syndrome, peripheral neuropathy, or exposure to environmental toxins or drugs), or myopathy, such as myotonia; a congenital myopathy, including nemalene myopathy, multi/minicore myopathy and myotubular (centronuclear) myopathy; mitochondrial myopathy; familial periodic paralysis; inflammatory myopathy; metabolic myopathy, such as caused by a glycogen or lipid storage disease; dermatomyositisis; polymyositis; inclusion body myositis; myositis ossificans; rhabdomyolysis and myoglobinurias; a muscular dystrophy syndrome, such as Duchenne, Becker, myotonic, fascioscapulohumeral, Emery-Dreifuss, oculopharyngeal, scapulohumeral, limb girdle, Fukuyama, a congenital muscular dystrophy, or hereditary distal myopathy; osteoporosis, a bone fracture, short stature, or dwarfism; muscle atrophy as a result of or associated with an adult motor neuron disease, infantile spinal muscular atrophy, amyotrophic lateral sclerosis, juvenile spinal muscular atrophy, autoimmune motor neuropathy with multifocal conductor block, paralysis due to stroke or spinal cord injury, skeletal immobilization due to trauma, prolonged bed rest, voluntary inactivity, involuntary inactivity, metabolic stress or nutritional insufficiency, cancer, AIDS, fasting, a thyroid gland disorder, diabetes, benign congenital hypotonia, central core disease, burn injury, chronic obstructive pulmonary disease, liver diseases (examples such as fibrosis, cirrhosis), sepsis, renal failure, congestive heart failure, ageing, space travel or time spent in a zero gravity environment; sarcopenia, skin atrophy, muscle wasting, brain atrophy, atherosclerosis, arteriosclerosis, pulmonary emphysema, osteoporosis, osteoarthritis, immunologic incompetence, high blood pressure, dementia, Huntington's disease, Alzheimer's disease, cataracts, age-related macular degeneration, prostate cancer, stroke, diminished life expectancy, frailty, memory loss, wrinkles, impaired kidney function, and age-related hearing loss; metabolic disorders, including Type II Diabetes, Metabolic Syndrome, hyperglycemia, and obesity; or acute and/or chronic renal disease or failure, liver fibrosis or cirrhosis, cancer such as breast cancer, Parkinson's Disease; cachexia, cachexia associated with a rheumatoid arthritis and cachexia associated with cancer; conditions associated with neuronal death, such as ALS, brain atrophy, or dementia and anemia; and a disorder which causes or is associated with muscle atrophy.

1055. The method of any of the preceding embodiments, wherein the composition further comprises a pharmaceutically acceptable carrier.

1056. The method of any of the preceding embodiments, wherein the method further comprises a step of administering a second agent to treat the ACVR2B-related disorder.

1057. The method of any of the preceding embodiments, wherein the second agent comprises an oligonucleotide which specifically targets ACVR2B.

1058. The method of any of the preceding embodiments, wherein the steps of administering the composition and the second agent are simultaneously, concurrent, separate or sequential.

1059. A method of decreasing the expression and/or level of a target gene or its gene product in a cell, comprising the step of administering to the cell a composition of any of preceding embodiments, wherein the target gene is ACVR2B and the oligonucleotide specifically targets ACVR2B.

1060. The use of a composition of any of the preceding embodiments or a pharmaceutically acceptable salt thereof for the preparation of a pharmaceutical composition for treating a ACVR2B-related disorder.

1061. The use of a composition of any of the preceding embodiments or a pharmaceutically acceptable salt thereof for the preparation or manufacture of a pharmaceutical composition or medicament for treating a ACVR2B-related disorder.

1062. A method for treating a APOB-related disorder in a subject, comprising the step of administering to the subject a therapeutically effective amount of a composition of any of preceding embodiments, wherein the oligonucleotide specifically targets APOB.

1063. The method of any of the preceding embodiments, wherein the APOB-related disorder is selected from: a metabolic disorder, cardiovascular disease, atherosclerosis, stroke, heart disease, coronary artery disease (CAD), coronary heart disease (CHD), dyslipidemia, HDL/LDL cholesterol imbalance, hyperlipidemia, familial hyperlipidemia (FCHL), acquired hyperlipidemia, statin-resistant hypercholesterolemia, hypobetalipoproteinemia, hypercholesterolemia, lipid-induced endoplasmic reticulum stress, diabetes and insulin resistance.

1064. The method of any of the preceding embodiments, wherein the composition further comprises a pharmaceutically acceptable carrier.

1065. The method of any of the preceding embodiments, wherein the method further comprises a step of administering a second agent to treat the APOB-related disorder.

1066. The method of any of the preceding embodiments, wherein the second agent comprises an oligonucleotide which specifically targets APOB.

1067. The method of any of the preceding embodiments, wherein the steps of administering the composition and the second agent are simultaneously, concurrent, separate or sequential.

1068. A method of decreasing the expression and/or level of a target gene or its gene product in a subject comprising the step of administering to the subject a therapeutically effective amount of a composition of any of preceding embodiments, comprising the step of administering to the subject a therapeutically effective amount of a composition of any of preceding embodiments, wherein the oligonucleotide specifically targets APOB.

1069. The method of any of the preceding embodiments, wherein the APOB-related disorder is selected from: a metabolic disorder, cardiovascular disease, atherosclerosis, stroke, heart disease, coronary artery disease (CAD), coronary heart disease (CHD), dyslipidemia, HDL/LDL cholesterol imbalance, hyperlipidemia, familial hyperlipidemia (FCHL), acquired hyperlipidemia, statin-resistant hypercholesterolemia, hypobetalipoproteinemia, hypercholesterolemia, lipid-induced endoplasmic reticulum stress, diabetes and insulin resistance.

1070. The method of any of the preceding embodiments, wherein the composition further comprises a pharmaceutically acceptable carrier.

1071. The method of any of the preceding embodiments, wherein the method further comprises a step of administering a second agent to treat the APOB-related disorder.

1072. The method of any of the preceding embodiments, wherein the second agent comprises an oligonucleotide which specifically targets APOB.

1073. The method of any of the preceding embodiments, wherein the steps of administering the composition and the second agent are simultaneously, concurrent, separate or sequential.

1074. A method of decreasing the expression and/or level of a target gene or its gene product in a cell, comprising the step of administering to the cell a composition of any of preceding embodiments, wherein the target gene is APOB and the oligonucleotide specifically targets APOB.

1075. The use of a composition of any of the preceding embodiments or a pharmaceutically acceptable salt thereof for the preparation of a pharmaceutical composition for treating a APOB-related disorder.

1076. The use of a composition of any of the preceding embodiments or a pharmaceutically acceptable salt thereof for the preparation or manufacture of a pharmaceutical composition or medicament for treating a APOB-related disorder.

1077. A method for treating a APOC3-related disorder in a subject, comprising the step of administering to the subject a therapeutically effective amount of a composition of any of preceding embodiments, wherein the oligonucleotide specifically targets APOC3.

1078. The method of any of the preceding embodiments, wherein the APOC3-related disorder is selected from: atherosclerosis or dyslipidemia, elevated triglyceride levels, elevated cholesterol levels, elevated free fatty acids, and diabetes.

1079. The method of any of the preceding embodiments, wherein the composition further comprises a pharmaceutically acceptable carrier.
1080. The method of any of the preceding embodiments, wherein the method further comprises a step of administering a second agent to treat the APOC3-related disorder.
1081. The method of any of the preceding embodiments, wherein the second agent comprises an oligonucleotide which specifically targets APOC3.
1082. The method of any of the preceding embodiments, wherein the steps of administering the composition and the second agent are simultaneously, concurrent, separate or sequential.
1083. A method of decreasing the expression and/or level of a target gene or its gene product in a subject comprising the step of administering to the subject a therapeutically effective amount of a composition of any of preceding embodiments, comprising the step of administering to the subject a therapeutically effective amount of a composition of any of preceding embodiments, wherein the oligonucleotide specifically targets APOC3.
1084. The method of any of the preceding embodiments, wherein the APOC3-related disorder is selected from: atherosclerosis or dyslipidemia, elevated triglyceride levels, elevated cholesterol levels, elevated free fatty acids, and diabetes.
1085. The method of any of the preceding embodiments, wherein the composition further comprises a pharmaceutically acceptable carrier.
1086. The method of any of the preceding embodiments, wherein the method further comprises a step of administering a second agent to treat the APOC3-related disorder.
1087. The method of any of the preceding embodiments, wherein the second agent comprises an oligonucleotide which specifically targets APOC3.
1088. The method of any of the preceding embodiments, wherein the steps of administering the composition and the second agent are simultaneously, concurrent, separate or sequential.
1089. A method of decreasing the expression and/or level of a target gene or its gene product in a cell, comprising the step of administering to the cell a composition of any of preceding embodiments, wherein the target gene is APOC3 and the oligonucleotide specifically targets APOC3.
1090. The use of a composition of any of the preceding embodiments or a pharmaceutically acceptable salt thereof for the preparation of a pharmaceutical composition for treating a APOC3-related disorder.
1091. The use of a composition of any of the preceding embodiments or a pharmaceutically acceptable salt thereof for the preparation or manufacture of a pharmaceutical composition or medicament for treating a APOC3-related disorder.
1092. A method for treating a KRT14-related disorder in a subject, comprising the step of administering to the subject a therapeutically effective amount of a composition of any of preceding embodiments, wherein the oligonucleotide specifically targets KRT.
1093. The method of any of the preceding embodiments, wherein the KRT14-related disorder is selected from: epidermolysis bullosa simplex and Dermatopathia pigmentosa reticularis.
1094. The method of any of the preceding embodiments, wherein the composition further comprises a pharmaceutically acceptable carrier.
1095. The method of any of the preceding embodiments, wherein the method further comprises a step of administering a second agent to treat the KRT14-related disorder.
1096. The method of any of the preceding embodiments, wherein the second agent comprises an oligonucleotide which specifically targets KRT.
1097. The method of any of the preceding embodiments, wherein the steps of administering the composition and the second agent are simultaneously, concurrent, separate or sequential.
1098. A method of decreasing the expression and/or level of a target gene or its gene product in a subject comprising the step of administering to the subject a therapeutically effective amount of a composition of any of preceding embodiments, comprising the step of administering to the subject a therapeutically effective amount of a composition of any of preceding embodiments, wherein the oligonucleotide specifically targets KRT.
1099. The method of any of the preceding embodiments, wherein the KRT14-related disorder is selected from: epidermolysis bullosa simplex and Dermatopathia pigmentosa reticularis.
1100. The method of any of the preceding embodiments, wherein the composition further comprises a pharmaceutically acceptable carrier.
1101. The method of any of the preceding embodiments, wherein the method further comprises a step of administering a second agent to treat the KRT14-related disorder.
1102. The method of any of the preceding embodiments, wherein the second agent comprises an oligonucleotide which specifically targets KRT.
1103. The method of any of the preceding embodiments, wherein the steps of administering the composition and the second agent are simultaneously, concurrent, separate or sequential.
1104. A method of decreasing the expression and/or level of a target gene or its gene product in a cell, comprising the step of administering to the cell a composition of any of preceding embodiments, wherein the target gene is KRT14 and the oligonucleotide specifically targets KRT.
1105. The use of a composition of any of the preceding embodiments or a pharmaceutically acceptable salt thereof for the preparation of a pharmaceutical composition for treating a KRT14-related disorder.
1106. The use of a composition of any of the preceding embodiments or a pharmaceutically acceptable salt thereof for the preparation or manufacture of a pharmaceutical composition or medicament for treating a KRT14-related disorder.
1107. A method for treating a Myostatin-related disorder in a subject, comprising the step of administering to the subject a therapeutically effective amount of a composition of any of preceding embodiments, wherein the oligonucleotide specifically targets Myostatin.
1108. The method of any of the preceding embodiments, wherein the Myostatin-related disorder is selected from: musculoskeletal disease or disorder; muscle atrophy or dystrophy; muscle atrophy as a result of or associated with any of: treatment with a glucocorticoid such as cortisol, dexamethasone, betamethasone, prednisone, methylprednisolone, or prednisolone, denervation due to nerve trauma or a result of degenerative, metabolic, or inflammatory neuropathy (e.g., Guillian-Barre syndrome, peripheral neuropathy, or exposure to environmental toxins or drugs), or myopathy, such as myotonia; a congenital myopathy, including nemalene myopathy, multi/minicore myopathy and myotubular (centronuclear) myopathy; mitochondrial myopathy;

familial periodic paralysis; inflammatory myopathy; metabolic myopathy, such as caused by a glycogen or lipid storage disease; dermatomyositisis; polymyositis; inclusion body myositis; myositis ossificans; rhabdomyolysis and myoglobinurias; a muscular dystrophy syndrome, such as Duchenne, Becker, myotonic, fascioscapulohumeral, Emery-Dreifuss, oculopharyngeal, scapulohumeral, limb girdle, Fukuyama, a congenital muscular dystrophy, or hereditary distal myopathy; osteoporosis, a bone fracture, short stature, or dwarfism; muscle atrophy as a result of or associated with an adult motor neuron disease, infantile spinal muscular atrophy, amyotrophic lateral sclerosis, juvenile spinal muscular atrophy, autoimmune motor neuropathy with multifocal conductor block, paralysis due to stroke or spinal cord injury, skeletal immobilization due to trauma, prolonged bed rest, voluntary inactivity, involuntary inactivity, metabolic stress or nutritional insufficiency, cancer, AIDS, fasting, a thyroid gland disorder, diabetes, benign congenital hypotonia, central core disease, burn injury, chronic obstructive pulmonary disease, liver diseases (examples such as fibrosis, cirrhosis), sepsis, renal failure, congestive heart failure, ageing, space travel or time spent in a zero gravity environment; sarcopenia, skin atrophy, muscle wasting, brain atrophy, atherosclerosis, arteriosclerosis, pulmonary emphysema, osteoporosis, osteoarthritis, immunologic incompetence, high blood pressure, dementia, Huntington's disease, Alzheimer's disease, cataracts, age-related macular degeneration, prostate cancer, stroke, diminished life expectancy, frailty, memory loss, wrinkles, impaired kidney function, and age-related hearing loss; metabolic disorders, including Type II Diabetes, Metabolic Syndrome, hyperglycemia, and obesity; or acute and/or chronic renal disease or failure, liver fibrosis or cirrhosis, cancer such as breast cancer, Parkinson's Disease; cachexia, cachexia associated with a rheumatoid arthritis and cachexia associated with cancer; conditions associated with neuronal death, such as ALS, brain atrophy, or dementia and anemia; and a disorder which causes or is associated with muscle atrophy.

1109. The method of any of the preceding embodiments, wherein the composition further comprises a pharmaceutically acceptable carrier.

1110. The method of any of the preceding embodiments, wherein the method further comprises a step of administering a second agent to treat the Myostatin-related disorder.

1111. The method of any of the preceding embodiments, wherein the second agent comprises an oligonucleotide which specifically targets Myostatin.

1112. The method of any of the preceding embodiments, wherein the steps of administering the composition and the second agent are simultaneously, concurrent, separate or sequential.

1113. A method of decreasing the expression and/or level of a target gene or its gene product in a subject comprising the step of administering to the subject a therapeutically effective amount of a composition of any of preceding embodiments, comprising the step of administering to the subject a therapeutically effective amount of a composition of any of preceding embodiments, wherein the oligonucleotide specifically targets Myostatin.

1114. The method of any of the preceding embodiments, wherein the Myostatin-related disorder is selected from: musculoskeletal disease or disorder; muscle atrophy or dystrophy; muscle atrophy as a result of or associated with any of: treatment with a glucocorticoid such as cortisol, dexamethasone, betamethasone, prednisone, methylprednisolone, or prednisolone, denervation due to nerve trauma or a result of degenerative, metabolic, or inflammatory neuropathy (e.g., Guillian-Barre syndrome, peripheral neuropathy, or exposure to environmental toxins or drugs), or myopathy, such as myotonia; a congenital myopathy, including nemalene myopathy, multi/minicore myopathy and myotubular (centronuclear) myopathy; mitochondrial myopathy; familial periodic paralysis; inflammatory myopathy; metabolic myopathy, such as caused by a glycogen or lipid storage disease; dermatomyositisis; polymyositis; inclusion body myositis; myositis ossificans; rhabdomyolysis and myoglobinurias; a muscular dystrophy syndrome, such as Duchenne, Becker, myotonic, fascioscapulohumeral, Emery-Dreifuss, oculopharyngeal, scapulohumeral, limb girdle, Fukuyama, a congenital muscular dystrophy, or hereditary distal myopathy; osteoporosis, a bone fracture, short stature, or dwarfism; muscle atrophy as a result of or associated with an adult motor neuron disease, infantile spinal muscular atrophy, amyotrophic lateral sclerosis, juvenile spinal muscular atrophy, autoimmune motor neuropathy with multifocal conductor block, paralysis due to stroke or spinal cord injury, skeletal immobilization due to trauma, prolonged bed rest, voluntary inactivity, involuntary inactivity, metabolic stress or nutritional insufficiency, cancer, AIDS, fasting, a thyroid gland disorder, diabetes, benign congenital hypotonia, central core disease, burn injury, chronic obstructive pulmonary disease, liver diseases (examples such as fibrosis, cirrhosis), sepsis, renal failure, congestive heart failure, ageing, space travel or time spent in a zero gravity environment; sarcopenia, skin atrophy, muscle wasting, brain atrophy, atherosclerosis, arteriosclerosis, pulmonary emphysema, osteoporosis, osteoarthritis, immunologic incompetence, high blood pressure, dementia, Huntington's disease, Alzheimer's disease, cataracts, age-related macular degeneration, prostate cancer, stroke, diminished life expectancy, frailty, memory loss, wrinkles, impaired kidney function, and age-related hearing loss; metabolic disorders, including Type II Diabetes, Metabolic Syndrome, hyperglycemia, and obesity; or acute and/or chronic renal disease or failure, liver fibrosis or cirrhosis, cancer such as breast cancer, Parkinson's Disease; cachexia, cachexia associated with a rheumatoid arthritis and cachexia associated with cancer; conditions associated with neuronal death, such as ALS, brain atrophy, or dementia and anemia; and a disorder which causes or is associated with muscle atrophy.

1115. The method of any of the preceding embodiments, wherein the composition further comprises a pharmaceutically acceptable carrier.

1116. The method of any of the preceding embodiments, wherein the method further comprises a step of administering a second agent to treat the Myostatin-related disorder.

1117. The method of any of the preceding embodiments, wherein the second agent comprises an oligonucleotide which specifically targets Myostatin.

1118. The method of any of the preceding embodiments, wherein the steps of administering the composition and the second agent are simultaneously, concurrent, separate or sequential.

1119. A method of decreasing the expression and/or level of a target gene or its gene product in a cell, comprising the step of administering to the cell a composition of any of preceding embodiments, wherein the target gene is Myostatin and the oligonucleotide specifically targets Myostatin.

1120. The use of a composition of any of the preceding embodiments or a pharmaceutically acceptable salt thereof for the preparation of a pharmaceutical composition for treating a Myostatin-related disorder.

1121. The use of a composition of any of the preceding embodiments or a pharmaceutically acceptable salt thereof for the preparation or manufacture of a pharmaceutical composition or medicament for treating a Myostatin-related disorder.

1122. A method for treating a PCSK9-related disorder in a subject, comprising the step of administering to the subject a therapeutically effective amount of a composition of any of preceding embodiments, wherein the oligonucleotide specifically targets PCSK9.

1123. The method of any of the preceding embodiments, wherein the PCSK9-related disorder is selected from: atherosclerosis; hyperlipoproteinemia; hypercholesterolemia; cardiovascular disease; obesity; hypertension; elevated total cholesterol levels; elevated non-high-density lipoprotein (HDL) cholesterol levels; elevated low-density lipoprotein (LDL-C) levels; elevated apolipoprotein B100 (APOB100) levels; hyperlipidemia; dyslipidemia; atherosclerosis; cardiovascular diseases; coronary heart disease (CHD); primary hypercholesterolemia; familial non-familial hypercholesterolemia; heterozygous familial hypercholesterolemia (heFH); hypercholesteremia that is uncontrolled by statins; and hypercholesterolemia that is resistant to statins.

1124. The method of any of the preceding embodiments, wherein the composition further comprises a pharmaceutically acceptable carrier.

1125. The method of any of the preceding embodiments, wherein the method further comprises a step of administering a second agent to treat the PCSK9-related disorder.

1126. The method of any of the preceding embodiments, wherein the second agent comprises an oligonucleotide which specifically targets PCSK9.

1127. The method of any of the preceding embodiments, wherein the steps of administering the composition and the second agent are simultaneously, concurrent, separate or sequential.

1128. A method of decreasing the expression and/or level of a target gene or its gene product in a subject comprising the step of administering to the subject a therapeutically effective amount of a composition of any of preceding embodiments, comprising the step of administering to the subject a therapeutically effective amount of a composition of any of preceding embodiments, wherein the oligonucleotide specifically targets PCSK9.

1129. The method of any of the preceding embodiments, wherein the PCSK9-related disorder is selected from: atherosclerosis; hyperlipoproteinemia; hypercholesterolemia; cardiovascular disease; obesity; hypertension; elevated total cholesterol levels; elevated non-high-density lipoprotein (HDL) cholesterol levels; elevated low-density lipoprotein (LDL-C) levels; elevated apolipoprotein B100 (APOB100) levels; hyperlipidemia; dyslipidemia; atherosclerosis; cardiovascular diseases; coronary heart disease (CHD); primary hypercholesterolemia; familial non-familial hypercholesterolemia; heterozygous familial hypercholesterolemia (heFH); hypercholesteremia that is uncontrolled by statins; and hypercholesterolemia that is resistant to statins.

1130. The method of any of the preceding embodiments, wherein the composition further comprises a pharmaceutically acceptable carrier.

1131. The method of any of the preceding embodiments, wherein the method further comprises a step of administering a second agent to treat the PCSK9-related disorder.

1132. The method of any of the preceding embodiments, wherein the second agent comprises an oligonucleotide which specifically targets PCSK9.

1133. The method of any of the preceding embodiments, wherein the steps of administering the composition and the second agent are simultaneously, concurrent, separate or sequential.

1134. A method of decreasing the expression and/or level of a target gene or its gene product in a cell, comprising the step of administering to the cell a composition of any of preceding embodiments, wherein the target gene is PCSK9 and the oligonucleotide specifically targets PCSK9.

1135. The use of a composition of any of the preceding embodiments or a pharmaceutically acceptable salt thereof for the preparation of a pharmaceutical composition for treating a PCSK9-related disorder.

1136. The use of a composition of any of the preceding embodiments or a pharmaceutically acceptable salt thereof for the preparation or manufacture of a pharmaceutical composition or medicament for treating a PCSK9-related disorder.

1137. A method for treating a PNPLA3-related disorder in a subject, comprising the step of administering to the subject a therapeutically effective amount of a composition of any of preceding embodiments, wherein the oligonucleotide specifically targets PNPLA3.

1138. The method of any of the preceding embodiments, wherein the PNPLA3-related disorder is selected from: liver disease, fatty liver, steatosis, steatohepatitis, hepatitis, and nonalcoholic fatty liver disease.

1139. The method of any of the preceding embodiments, wherein the composition further comprises a pharmaceutically acceptable carrier.

1140. The method of any of the preceding embodiments, wherein the method further comprises a step of administering a second agent to treat the PNPLA3-related disorder.

1141. The method of any of the preceding embodiments, wherein the second agent comprises an oligonucleotide which specifically targets PNPLA3.

1142. The method of any of the preceding embodiments, wherein the steps of administering the composition and the second agent are simultaneously, concurrent, separate or sequential.

1143. A method of decreasing the expression and/or level of a target gene or its gene product in a subject comprising the step of administering to the subject a therapeutically effective amount of a composition of any of preceding embodiments, comprising the step of administering to the subject a therapeutically effective amount of a composition of any of preceding embodiments, wherein the oligonucleotide specifically targets PNPLA3.

1144. The method of any of the preceding embodiments, wherein the PNPLA3-related disorder is selected from: liver disease, fatty liver, steatosis, steatohepatitis, hepatitis, and nonalcoholic fatty liver disease.

1145. The method of any of the preceding embodiments, wherein the composition further comprises a pharmaceutically acceptable carrier.

1146. The method of any of the preceding embodiments, wherein the method further comprises a step of administering a second agent to treat the PNPLA3-related disorder.

1147. The method of any of the preceding embodiments, wherein the second agent comprises an oligonucleotide which specifically targets PNPLA3.

1148. The method of any of the preceding embodiments, wherein the steps of administering the composition and the second agent are simultaneously, concurrent, separate or sequential.

1149. A method of decreasing the expression and/or level of a target gene or its gene product in a cell, comprising the step of administering to the cell a composition of any of preceding embodiments, wherein the target gene is PNPLA3 and the oligonucleotide specifically targets PNPLA3.

1150. The use of a composition of any of the preceding embodiments or a pharmaceutically acceptable salt thereof for the preparation of a pharmaceutical composition for treating a PNPLA3-related disorder.

1151. The use of a composition of any of the preceding embodiments or a pharmaceutically acceptable salt thereof for the preparation or manufacture of a pharmaceutical composition or medicament for treating a PNPLA3-related disorder.

1152. The use of a composition of any of the preceding embodiments or a pharmaceutically acceptable salt thereof for the preparation or manufacture of a pharmaceutical composition or medicament for treating a disorder.

1153. The composition of any of the previous embodiments, wherein the sequence of the oligonucleotide comprises a base which is a mismatch from the wild-type sequence of the target gene, but not a mismatch from a mutant sequence of the target gene which is associated with a disease or disorder.

1154. The composition of any of the previous embodiments, wherein the sequence of the oligonucleotide comprises a base which is a mismatch from the wild-type sequence of the target gene, but not a mismatch from a mutant sequence of the target gene which is associated with a disease or disorder, wherein the base is in the seed region or the post-seed region.

1155. The composition of any of the previous embodiments, wherein the sequence of the oligonucleotide comprises a base which is a mismatch from the wild-type sequence of the target gene, but not a mismatch from a mutant sequence of the target gene which is associated with a disease or disorder, wherein the base is in the seed region.

1156. The composition of any of the previous embodiments, wherein the sequence of the oligonucleotide comprises a base which is a mismatch from the wild-type sequence of the target gene, but not a mismatch from a mutant sequence of the target gene which is associated with a disease or disorder, wherein the base is in the post-seed region.

1157. The composition of any of the previous embodiments, wherein the sequence of the oligonucleotide comprises a base which is a mismatch from the wild-type sequence of the target gene, but not a mismatch from a mutant sequence of the target gene which is associated with a disease or disorder, wherein the base is at any of positions 9, 10, 11, 12, 13, 14, 15, 16, 17, 18, 19, or 20, counting from the 5' end of the oligonucleotide.

1158. The composition of any of the previous embodiments, wherein the sequence of the oligonucleotide comprises a base which is a mismatch from the wild-type sequence of the target gene, but not a mismatch from a mutant sequence of the target gene which is associated with a disease or disorder, wherein the base is at position 14 counting from the 5' end of the oligonucleotide.

1159. The composition of any of the previous embodiments, wherein the sequence of the oligonucleotide comprises two or more bases which are each a mismatch from the wild-type sequence of the target gene, but not a mismatch from a mutant sequence of the target gene which is associated with a disease or disorder.

1160. The composition of any of the previous embodiments, wherein the sequence of the oligonucleotide comprises two or more bases which are each a mismatch from the wild-type sequence of the target gene, but not a mismatch from a mutant sequence of the target gene which is associated with a disease or disorder, wherein at least one of the bases is in the seed region or the post-seed region.

1161. The composition of any of the previous embodiments, wherein the sequence of the oligonucleotide comprises two or more bases which are each a mismatch from the wild-type sequence of the target gene, but not a mismatch from a mutant sequence of the target gene which is associated with a disease or disorder, wherein at least one of the bases is in the seed region.

1162. The composition of any of the previous embodiments, wherein the sequence of the oligonucleotide comprises two or more bases which are each a mismatch from the wild-type sequence of the target gene, but not a mismatch from a mutant sequence of the target gene which is associated with a disease or disorder, wherein at least one of the bases is in the post-seed region.

1163. The composition of any of the previous embodiments, wherein the sequence of the oligonucleotide comprises two or more bases which are each a mismatch from the wild-type sequence of the target gene, but not a mismatch from a mutant sequence of the target gene which is associated with a disease or disorder, wherein at least one of the bases is at any of positions 9, 10, 11, 12, 13, 14, 15, 16, 17, 18, 19, or 20, counting from the 5' end of the oligonucleotide.

1164. The composition of any of the previous embodiments, wherein the sequence of the oligonucleotide comprises two or more bases which are each a mismatch from the wild-type sequence of the target gene, but not a mismatch from a mutant sequence of the target gene which is associated with a disease or disorder, wherein one of the bases is at position 14 counting from the 5' end of the oligonucleotide.

1165. A compound having the structure of a formula selected from:

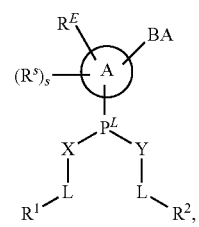

P-I

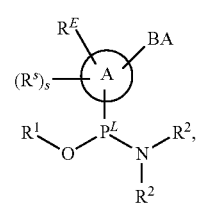

P-II

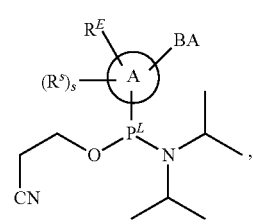

PIII

-continued

P-IV

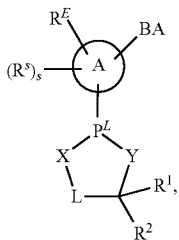

P-V

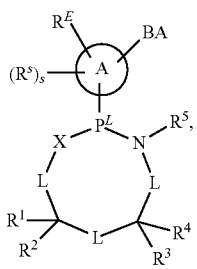

P-VI

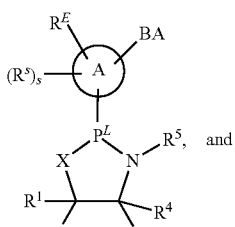 and

P-VII

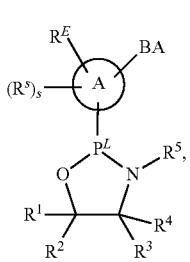

or a salt thereof, wherein:

$R^E$ is a 5'-end group;

each BA is independently an optionally substituted group selected from $C_{1-30}$ cycloaliphatic, $C_{6-30}$ aryl, $C_{5-30}$ heteroaryl having 1-10 heteroatoms, $C_{3-30}$ heterocyclyl having 1-10 heteroatoms, a natural nucleobase moiety, and a modified nucleobase moiety;

each $R^s$ is independently —F, —Cl, —Br, —I, —CN, —$N_3$, —NO, —$NO_2$, -L-R', -L-OR', -L-SR', -L-N(R')$_2$, —O-L-OR', —O-L-SR', or —O-L-N(R')$_2$;

each of $R^1$, $R^2$, $R^3$, $R^4$ and $R^5$ is independently $R^s$;

s is 0-20;

each L is independently a covalent bond, or a bivalent, optionally substituted, linear or branched group selected from a $C_{1-30}$ aliphatic group and a $C_{1-30}$ heteroaliphatic group having 1-10 heteroatoms, wherein one or more methylene units are optionally and independently replaced with $C_{1-6}$ alkylene, $C_{1-6}$ alkenylene, —C≡C—, —C(R')$_2$—, —O—, —S—, —S—S—, —N(R')—, —C(O)—, —C(S)—, —C(NR')—, —C(O)N(R')—, —N(R')C(O)N(R')—, —N(R')C(O)O—, —S(O)—, —S(O)$_2$—, —S(O)$_2$N(R')—, —C(O)S—, —C(O)O—, —P(O)(OR')—, —P(O)(SR')—, —P(O)(R')—, —P(O)(NR')—, —P(S)(OR')—, —P(S)(SR')—, —P(S)(R')—, —P(S)(NR')—, —P(R')—, —P(OR')—, —P(SR')—, —P(NR')—, —P(OR')[B(R')$_3$]—, —OP(O)(OR')O—, —OP(O)(SR')O—, —OP(O)(R')O—, —OP(O)(NR')O—, —OP(OR')O—, —OP(SR')O—, —OP(NR')O—, —OP(R')O—, or —OP(OR')[B(R')$_3$]O—; and one or more carbon atoms are optionally and independently replaced with $Cy^L$;

each $Cy^L$ is independently an optionally substituted tetravalent group selected from a $C_{3-20}$ cycloaliphatic ring, a $C_{6-20}$ aryl ring, a 5-20 membered heteroaryl ring having 1-10 heteroatoms, and a 3-20 membered heterocyclyl ring having 1-10 heteroatoms;

each Ring A is independently an optionally substituted 3-20 membered monocyclic, bicyclic or polycyclic ring having 0-10 heteroatoms;

$P^L$ is P(=W), P, or P→B(R')$_3$;

W is O, S or Se;

each of X and Y is independently —O—, —S—, —N(-L-R$^1$), or L;

each R' is independently —R, —C(O)R, —C(O)OR, or —S(O)$_2$R;

each R is independently —H, or an optionally substituted group selected from $C_{1-30}$ aliphatic, $C_{1-30}$ heteroaliphatic having 1-10 heteroatoms, $C_{6-30}$ aryl, $C_{6-30}$ arylaliphatic, $C_{6-30}$ arylheteroaliphatic having 1-10 heteroatoms, 5-30 membered heteroaryl having 1-10 heteroatoms, and 3-30 membered heterocyclyl having 1-10 heteroatoms, or two R groups are optionally and independently taken together to form a covalent bond, or:

two or more R groups on the same atom are optionally and independently taken together with the atom to form an optionally substituted, 3-30 membered monocyclic, bicyclic or polycyclic ring having, in addition to the atom, 0-10 heteroatoms; or two or more R groups on two or more atoms are optionally and independently taken together with their intervening atoms to form an optionally substituted, 3-30 membered monocyclic, bicyclic or polycyclic ring having, in addition to the intervening atoms, 0-10 heteroatoms.

1166. The compound of embodiment 1165, wherein the compound has the structure of formula P-I.

1167. The compound of embodiment 1165, wherein the compound has the structure of formula P-II.

1168. The compound of embodiment 1165, wherein the compound has the structure of formula P-III.

1169. The compound of embodiment 1165, wherein the compound has the structure of formula P-IV.

1170. The compound of embodiment 1165, wherein the compound has the structure of formula P-V.

1171. The compound of embodiment 1165, wherein the compound has the structure of formula P-VI.

1172. The compound of embodiment 1165, wherein the compound has the structure of formula P-VII.

1173. The compound of any one of embodiments 1165-1172, wherein $P^L$ is P=O.

1174. The compound of any one of embodiments 1165-1172, wherein $P^L$ is P=S.

1175. The compound of any one of embodiments 1165-1172, wherein $P^L$ is P.

1176. The compound of any one of embodiments 1165-1175, wherein each heteroatom is independently selected from oxygen, sulfur, nitrogen, silicon, boron and phosphorus.

1177. The compound of any one of embodiments 1165-1176, wherein each of $R^1$ and $R^2$ is independently hydrogen or an optionally substituted group selected from $C_{1-6}$ aliphatic and $C_{6-14}$ aryl.

1178. The compound of any one of embodiments 1165-1176, wherein each of $R^1$ and $R^2$ is independently an optionally substituted group selected from $C_{1-6}$ aliphatic and $C_{6-14}$ aryl.

1179. The compound of any one of embodiments 1165-1176, wherein one of $R^1$ and $R^2$ is optionally substituted $C_{1-6}$ aliphatic and the other is optionally substituted $C_{6-14}$ aryl.

1180. The compound of any one of embodiments 1165-1176, wherein one of $R^1$ and $R^2$ is optionally substituted methyl and the other is optionally substituted phenyl.

1181. The compound of any one of embodiments 1165-1176, wherein one of $R^1$ and $R^2$ is hydrogen and the other is an optionally substituted group selected from $C_{1-6}$ aliphatic and $C_{6-14}$ aryl.

1182. The compound of embodiment 1181, wherein one of $R^1$ and $R^2$ is hydrogen and the other is optionally substituted phenyl.

1183. The compound of embodiment 1181, wherein one of $R^1$ and $R^2$ is hydrogen and the other is phenyl.

1184. The compound of embodiment 1181, wherein one of $R^1$ and $R^2$ is hydrogen and the other is an optionally substituted $C_{1-6}$ aliphatic.

1185. The compound of embodiment 1181, wherein one of $R^1$ and $R^2$ is hydrogen and the other is —$CH_2Si(R)_3$, wherein the —$CH_2$— is optionally substituted.

1186. The compound of embodiment 1181, wherein one of $R^1$ and $R^2$ is hydrogen and the other is —$CH_2SiMe(Ph)_2$.

1187. The compound of any one of embodiments 1165-1180, wherein one of $R^3$ and $R^4$ is hydrogen and the other is taken together with $R^5$ to form an optionally substituted, saturated or partially saturated, monocyclic, bicyclic or polycyclic 3-10 membered ring having, in addition to the nitrogen to which $R^5$ is bonded, 0-5 heteroatoms.

1188. The compound of any one of embodiments 1165-1180, wherein one of $R^3$ and $R^4$ is hydrogen and the other is taken together with $R^5$ to form an optionally substituted, saturated, monocyclic, 3-7 membered ring having no heteroatoms other than the nitrogen to which $R^5$ is bonded.

1189. The compound of any one of embodiments 1165-1180, wherein one of $R^3$ and $R^4$ is hydrogen and the other is taken together with $R^5$ to form an optionally substituted, saturated, monocyclic, 5-6 membered ring having no heteroatoms other than the nitrogen to which $R^5$ is bonded.

1190. The compound of any one of embodiments 1165-1180, wherein one of $R^3$ and $R^4$ is hydrogen and the other is taken together with $R^5$ to form an optionally substituted, saturated, monocyclic, 5-membered ring having no heteroatoms other than the nitrogen to which $R^5$ is bonded.

1191. The compound of any one of embodiments 1165-1180, wherein one of $R^3$ and $R^4$ is hydrogen and the other is taken together with $R^5$ to form a saturated, monocyclic, 5-membered ring having no heteroatoms other than the nitrogen to which $R^5$ is bonded.

1192. The compound of any one of embodiments 1181-1191, wherein the one of $R^1$ and $R^2$ being hydrogen and the one of $R^3$ and $R^4$ being hydrogen is syn.

1193. The compound of any one of embodiments 1165-1177, wherein the compound has a structure of

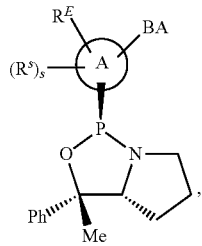

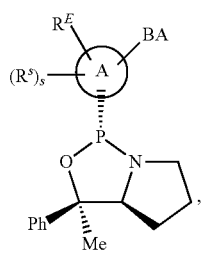

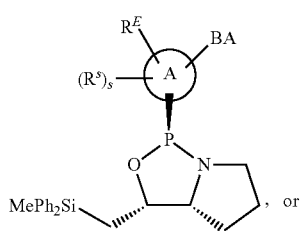

or

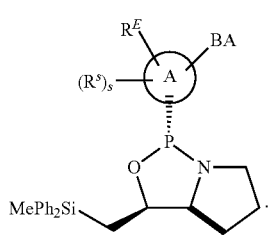

1194. The compound of any one of embodiments 1165-1193, wherein Ring A is

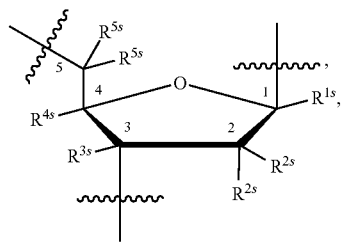

wherein:
BA is connected at C1;
each of $R^{1s}$, $R^{2s}$, $R^{3s}$, $R^{4s}$ and $R^{5s}$ is independently $R^s$.

1195. The compound of embodiment 1194, wherein Ring A is

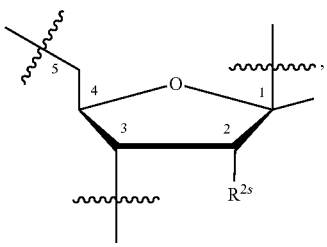

1196. The compound of embodiment 1194, wherein Ring A is

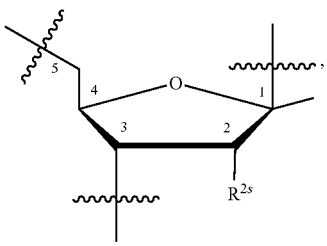

wherein $R^{2s}$ is not —OH.

1197. The compound of embodiment 1194, wherein Ring A is optionally substituted

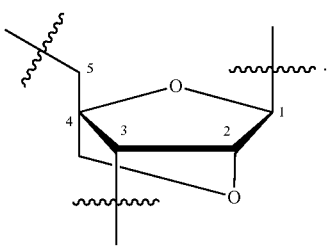 [SMILES: *C[C@]12CO[C@@H](C1*)[C@H](*)O2]

1198. The compound of embodiment 1194, wherein Ring A is

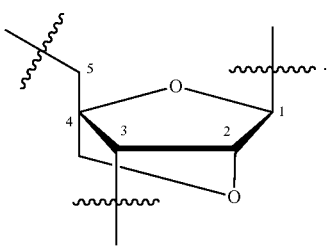 [SMILES: *C[C@]12CO[C@@H](C1*)[C@H](*)O2]

1199. The compound of embodiment 1194, wherein Ring A is

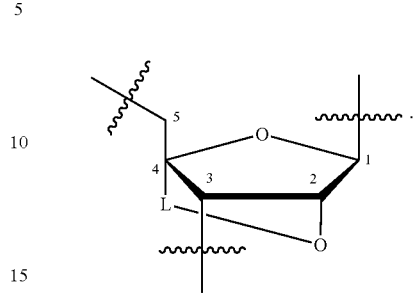

1200. The compound of embodiment 1194, wherein Ring A is

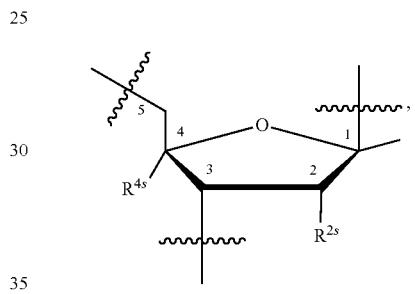

wherein $R^{2s}$ and $R^{4s}$ are R, and the two R groups are taken together with their intervening atoms to form a ring.

1201. The compound of any one of embodiments 1165-1200, wherein BA is an optionally substituted group selected from $C_{1-30}$ cycloaliphatic, $C_{6-30}$ aryl, $C_{5-30}$ heteroaryl having 1-10 heteroatoms, and $C_{3-30}$ heterocyclyl having 1-10 heteroatoms.

1202. The compound of any one of embodiments 1165-1200, wherein BA is an optionally substituted group selected from $C_{6-30}$ aryl, $C_{5-30}$ heteroaryl having 1-10 heteroatoms, and $C_{3-30}$ heterocyclyl having 1-10 heteroatoms.

1203. The compound of any one of embodiments 1165-1200, wherein BA is an optionally substituted group selected from heteroaryl having 1-10 heteroatoms, and $C_{3-30}$ heterocyclyl having 1-10 heteroatoms.

1204. The compound of any one of embodiments 1165-1200, wherein BA is an optionally substituted $C_{5-30}$ heteroaryl group having 1-10 heteroatoms.

1205. The compound of any one of embodiments 1165-1204, wherein BA is optionally substituted or protected adenine, cytosine, guanosine, thymine, or uracil.

1206. The compound of any one of embodiments 1165-1204, wherein BA is protected adenine, cytosine, guanosine, thymine, or uracil.

1207. The compound of any one of embodiments 1165-1204, wherein BA is optionally substituted adenine, cytosine, guanosine, thymine, or uracil.

1208. The compound of any one of embodiments 1165-1204, wherein BA is

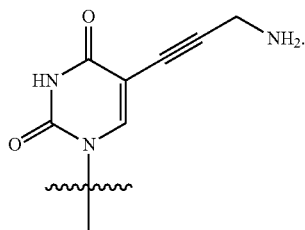 [SMILES: *n1cc(C#CCN)c(=O)[nH]c1=O]

1209. The compound of any one of embodiments 1165-1204, wherein BA is

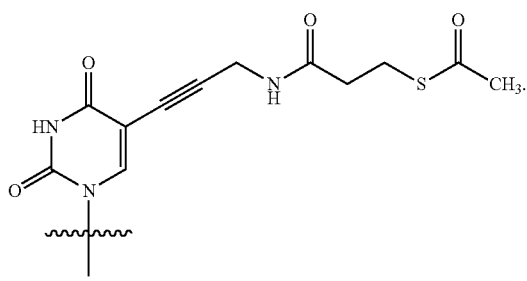 [SMILES: *n1cc(C#CCNC(=O)CCSC(C)=O)c(=O)[nH]c1=O]

1210. The compound of any one of embodiments 1165-1209, wherein $R^E$ is -L-$P^{DB}$, wherein $P^{DB}$ is a phosphate group, or a derivative or a bioisostere thereof.

1211. The compound of any one of embodiments 1210, wherein $R^E$-(E)-CH=CH—$P^{DB}$, wherein $P^{DB}$ is a phosphate group, or a derivative or a bioisostere thereof.

1212. The compound of any one of embodiments 1210-1211, wherein $P^{DB}$ is —OP(O)(OR)$_2$, —OP(O)(OR)(H), —OP(O)(OR)(SR), —OP(O)(OH)(OR), —OP(O)(SH)(OR), —OP(O)(XR)—X-L-X—P(O)(XR)$_2$, —OP(O)(XH)—X-L-X—P(O)(XH)(XR), —OP(O)(XR)—X-L-X—P(O)(XR)(R), —OP(O)(XH)—X-L-X—P(O)(XH)(R), —OP(O)(XH)—X-L-X—P(O)(XH)(H), —OP(O)(XR)—O-L-O—P(O)(XR)$_2$, —OP(O)(XR)—O-L-O—P(O)(XR)(R), —OP(O)(XR)—O-L-O—P(O)(XR)$_2$, —OP(O)(SR)—O-L-O—P(O)(XR)$_2$, —OP(O)(OR)—O-L-O—P(O)(XR)$_2$, —OP(O)(OH)—O-L-O—P(O)(XR)$_2$, —OP(O)(OH)—O-L-O—P(O)(OR)(XR), —OP(O)(OH)—O-L-O—P(O)(OH)(XR), —OP(O)(OH)—O-L-O—P(O)(OH)(OR), —OP(O)(OH)—O-L-O—P(O)(OH)(SR), —OP(O)(OH)—O-L-O—P(O)(OH)(R), —OP(O)(OH)—O-L-O—P(O)(OH)(H), —OP(O)(SH)—O-L-O—P(O)(XR)$_2$, —OP(O)(SH)—O-L-O—P(O)(OR)(XR), —OP(O)(SH)—O-L-O—P(O)(OH)(XR), —OP(O)(SH)—O-L-O—P(O)(OH)(OR), —OP(O)(SH)—O-L-O—P(O)(OH)(SR), —OP(O)(SH)—O-L-O—P(O)(OH)(R), or —OP(O)(SH)—O-L-O—P(O)(OH)(H).

1213. The compound of embodiment 1212, wherein each X in $P^{DB}$ is independently —O—, —S—, or a covalent bond.

1214. The compound of any one of embodiments 1212-1213, wherein each L in $P^{DB}$ is independently a covalent bond, or a bivalent, optionally substituted, linear or branched $C_{1-6}$ aliphatic, wherein one or more methylene units are optionally and independently replaced with —O—, —S— or —N(R')—.

1215. The compound of any one of embodiments 1165-1210, wherein $R^E$ is -L-P(O)(XR)$_2$ or a salt form thereof.

1216. The compound of any one of embodiments 1165-1210, wherein $R^E$ is -L-P(O)(XR)$_2$ or a salt form thereof, wherein each X is independently —O—, —S—, or a covalent bond.

1217. The compound of any one of embodiments 1165-1210, wherein $R^E$ is -L-P(O)(OR)$_2$ or a salt form thereof.

1218. The compound of any one of embodiments 1165-1210, wherein $R^E$ is -L-P(O)(OR)(SR) or a salt form thereof.

1219. The compound of any one of embodiments 1165-1210, wherein $R^E$ is -L-P(O)(OR)(R) or a salt form thereof.

1220. The compound of any one of embodiments 1215-1219, wherein L in $R^E$ is a covalent bond, or a bivalent, optionally substituted, linear or branched $C_{1-6}$ aliphatic, wherein one or more methylene units are optionally and independently replaced with —O—, —S— or —N(R')—.

1221. The compound of any one of embodiments 1215-1220, wherein R in $R^E$ is H.

1222. The compound of any one of embodiments 1215-1220, wherein R in $R^E$ is optionally substituted $C_{1-6}$ aliphatic.

1223. The compound of any one of embodiments 1165-1210, wherein $R^E$ is —X-L-R.

1224. The compound of embodiment 1223 or 1224, wherein L in $R^E$ comprises an optionally substituted, bivalent or multivalent

group.

1225. The compound of embodiment 1223 or 1224, wherein L in $R^E$ comprises an optionally substituted

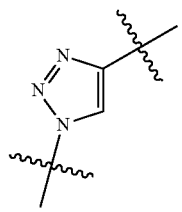 [SMILES: *c1cn(*)nn1]

group.

1226. The compound of embodiment 1223 or 1224, wherein L in $R^E$ comprises a

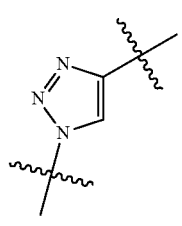 [SMILES: *c1cn(*)nn1]

group.

1227. The compound of any one of embodiments 1165-1142, wherein $R^E$ is

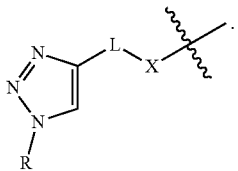

1228. The compound of embodiment 1155-1159, wherein X in $R^E$ is —C(R)$_2$—.
1229. The compound of embodiment 1155-1159, wherein X in $R^E$ is —O—.
1230. The compound of embodiment 1155-1159, wherein X in $R^E$ is —S—.
1231. The compound of embodiment 1155-1159, wherein X in $R^E$ is —N(R)—.
1232. The compound of embodiment 1155-1163, wherein each R in $R^E$ is independently —H, or an optionally substituted group selected from $C_{1-10}$ alkyl, $C_{1-10}$ allyl, and $C_{6-14}$ aryl.
1233. The compound of any one of embodiments 1165-1142, wherein $R^E$ is —CH$_2$OP(O)(OR)$_2$, wherein R is not hydrogen.
1234. The compound of any one of embodiments 1165-1142, wherein $R^E$ is —CH$_2$OP(O)(OR)H or a salt form thereof.
1235. The compound of any one of embodiments 1165-1142, wherein $R^E$ is —CH$_2$OP(O)(OR)(SR) or a salt form thereof.
1236. The compound of any one of embodiments 1165-1209, wherein $R^E$ is -L-OR$^s$.
1237. The compound of any one of embodiments 1165-1209, wherein $R^E$ is -L-OR$^s$, wherein R$^s$ is not hydrogen.
1238. The compound of any one of embodiments 1165-1209, wherein $R^E$ is -L-OR$^s$, wherein R$^s$ is an hydroxyl protecting group.
1239. The compound of any one of embodiments 1165-1209, wherein $R^E$ is -L-OR$^s$, wherein R$^s$ is DMTr.
1240. The compound of any one of embodiments 1236-1239, wherein L in $R^E$ is —C(R)$_2$—O—, wherein each R of —C(R)$_2$— is independently —H or optionally substituted $C_{1-4}$ aliphatic.
1241. The compound of any one of embodiments 1236-1239, wherein L in $R^E$ is —CHR—O—, wherein R of —CHR— is —H or optionally substituted $C_{1-4}$ aliphatic.
1242. The compound of any one of embodiments 1236-1239, wherein L in $R^E$ is —CHR—O—, wherein R of —CHR— is optionally substituted $C_{1-4}$ aliphatic.
1243. The compound of any one of embodiments 1236-1239, wherein L in $R^E$ is —CHR—O—, wherein R of —CHR— is $C_{1-4}$ aliphatic or haloaliphatic.
1244. The compound of any one of embodiments 1236-1239, wherein L in $R^E$ is —CHR—O—, wherein R of —CHR— is $C_{1-3}$ aliphatic or haloaliphatic.
1245. The compound of any one of embodiments 1236-1239, wherein L in $R^E$ is —CHR—O—, wherein R of —CHR— is $C_{1-2}$ aliphatic or haloaliphatic.
1246. The compound of any one of embodiments 1236-1239, wherein L in $R^E$ is —CHR—O—, wherein R of —CHR— is methyl.
1247. The compound of any one of embodiments 1236-1239, wherein L in $R^E$ is —CHR—O—, wherein R of —CHR— is methyl substituted with one or more halogen.
1248. The compound of any one of embodiments 1236-1247, wherein for L, —O— is connected to R$^s$.
1249. The compound of any one of embodiments 1236-1248, wherein L in $R^E$ is —CHR—O—, wherein —CHR— has an R configuration.
1250. The compound of any one of embodiments 1236-1248, wherein L in $R^E$ is —CHR—O—, wherein —CHR— has an S configuration.
1251. The compound of any one of embodiments 1236-1248, wherein $R^E$ is —(R)—CH(Me)-ODMTr.
1252. The compound of any one of embodiments 1236-1248, wherein $R^E$ is —(S)—CH(Me)-ODMTr.
1253. The compound of any one of embodiments 1165-1252, wherein the 5'-nucleoside comprising $R^E$ has the structure of

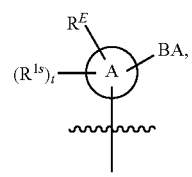

wherein BA is T.
1254. The compound of embodiment 1253, wherein the 5'-nucleoside comprising $R^E$ has the structure of

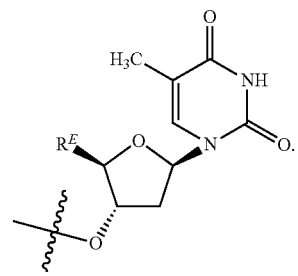

1255. The compound of any one of embodiments 1165-1209, wherein the 5'-nucleoside comprising $R^E$ has the structure of

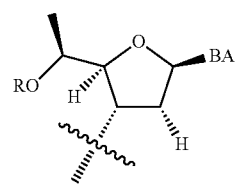

or a salt form thereof.
1256. The compound of any one of embodiments 1165-1209, wherein the 5'-nucleoside comprising $R^E$ has the structure of

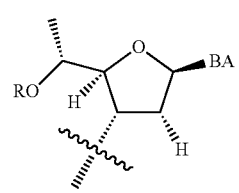

or a salt form thereof.

1257. The compound of any one of embodiments 1255-1256, wherein —OR is not —OH.
1258. The compound of any one of embodiments 1255-1256, wherein —OR is protected hydroxyl group.
1259. The compound of any one of embodiments 1255-1256, wherein —OR is —ODMTr.
1260. The compound of any one of embodiments 1255-1259, wherein BA is optionally protected adenine, cytosine, guanosine, thymine, or uracil.
1261. The compound of any one of embodiments 1255-1259, wherein BA is optionally substituted adenine, cytosine, guanosine, thymine, or uracil.
1262. The compound of any one of embodiments 1255-1259, wherein BA is thymine.
1263. The compound of any one of embodiments 1165-1262, wherein the compound has a purity of 80%-100%.
1264. The compound of any one of embodiments 1165-1263, wherein the compound has a purity of at least 80%, 85%, 90%, 91%, 92%, 93%, 94%, 95%, 96%, 97%, 98%, or 99%.
1265. The compound of any one of embodiments 1165-1263, wherein the compound has a purity of at least 90%, 91%, 92%, 93%, 94%, 95%, 96%, 97%, 98%, or 99%.
1266. The compound of any one of embodiments 1165-1263, wherein the compound has a purity of at least 95%, 96%, 97%, 98%, or 99%.
1267. The compound of any one of embodiments 1165-1266, wherein the compound has a diastereopurity of 80%-100%.
1268. The compound of any one of embodiments 1165-1266, wherein the compound has a diastereopurity of at least 80%, 85%, 90%, 91%, 92%, 93%, 94%, 95%, 96%, 97%, 98%, or 99%.
1269. The compound of any one of embodiments 1165-1266, wherein the compound has a diastereopurity of at least 90%, 91%, 92%, 93%, 94%, 95%, 96%, 97%, 98%, or 99%.
1270. The compound of any one of embodiments 1165-1266, wherein the compound has a diastereopurity of at least 95%, 96%, 97%, 98%, or 99%.

EXEMPLIFICATION

The foregoing has been a description of certain non-limiting embodiments of the disclosure. Accordingly, it is to be understood that the embodiments of the disclosure herein described are merely illustrative of the application of the principles of the disclosure. Reference herein to details of the illustrated embodiments is not intended to limit the scope of the claims.

Certain methods for preparing oligonucleotides and oligonucleotide compositions are widely known in the art and can be utilized in accordance with the present disclosure, including but not limited to those described in WO/2010/064146, WO/2011/005761, WO/2013/012758, WO/2014/010250, US2013/0178612, WO/2014/012081, WO/2015/107425, WO/2017/015555, and WO/2017/062862, the methods and reagents of each of which are incorporated herein by reference.

Applicant describes herein certain examples of provided oligonucleotide and compositions thereof, and methods for preparing, assessing, assaying, and using, etc., certain provided oligonucleotides and compositions thereof.

Example 1. Example Protocols for Assessing Oligonucleotides

As a personal having ordinary skill in the art appreciates, many technologies (e.g., reagents, methods, etc.) can be utilized to assess activities and properties of provided oligonucleotides. Below is one example protocol describing reverse transfection of oligonucleotides (using certain oligonucleotides that can function as ssRNAi as examples) in 96 Well Plate format using Lipofectamine® 2000 (Invitrogen) for assessing oligonucleotide activities in cells:

1. Prepare each ssRNAi, preferably in multiple (e.g., 8) doses, e.g., in a final volume of 25 uL. Example initial concentration could be 150 nM; serial dilution, for example in Opti-MEMO medium without serum, typically by a factor of 4.
2. Lipofectamine® 2000 is desirably mixed gently before use, then diluted 0.25 μl Lipofectamine® 2000 in 25 μl Opti-MEM® medium without serum in a separate vessel. Further gentle mixing can be followed by incubation, e.g., for 5 minutes at room temperature.
3. After incubation, diluted Lipofectamine® 2000 (e.g., 25 uL) can be added to the (diluted) ssRNAi molecules (typically comparable volume, e.g., 25 uL). The combination is desirably mixed gently and may be incubated, e.g., for 15 minutes at room temperature, to allow complex formation to occur.
4. Complexes are then contacted with cells, for example by adding 100 μl complete growth medium without antibiotics with 15,000 Hep3B cells to each ssRNAi molecule-Lipofectamine® 2000 complex. This gives a final volume of 150 μl, and final oligo concentrations are 25, 6.25, 1.56, 0.39, 0.097, 0.024, 0.0061, and 0.0015 nM. Mix gently by rocking the plate back and forth.
5. Cells are incubated, e.g., at 37° C. in a $CO_2$ incubator for 48 hours.
6. Cells are harvested and mRNA is isolated, e.g., using TurboCapture mRNA kit (Qiagen), as per vendor provided protocol.
7. cDNA is prepared, e.g., using Roche cDNA synthesis Kit (Roche), as per vendor provided protocol.
8. Target knockdown is quantified, e.g., by Taqman assays using gene-specific Taqman probes multiplexed with HPRT1 probes, in LightCycler® 480 Probes Master mix (Roche), as per vendor provided protocol. Typically, data are normalized, for example relative to a housekeeping gene such as HPRT1 (Hypoxanthine Phosphoribosyltransferase 1).
9. If multiple dose strengths/concentrations were utilized, dose-response curves can be prepared for each ssRNAi agent, e.g., using Prism Software. $IC_{50}$ can be determined if desired.

Similar protocols can be used for different oligonucleotides targeting other genes and can use different cells.

Alternatively or additionally, one or more activities and properties of oligonucleotides can be assessed using other technologies (e.g., reagents, kits, methods, etc.) in accordance with the present disclosure. Certain data generated from various types of assays are provided in the Tables, demonstrating, for example, unexpectedly high activities, stability, selectivity, etc., of presently provided technologies.

Various models are available for assessing provided technologies in subjects. In some embodiments, provided technologies show high activities, stability, and/or selectivity when administered to animals. Those skilled in the art are aware of animal systems that are considered to be relevant to and/or predictive for certain relevant human diseases, disorders and/or conditions that might benefit from oligonucleotide therapy as described herein.

Example 2. Example IC50 of Certain Provided Oligonucleotides

IC50 of certain oligonucleotides (which may function as single-stranded RNAi agents to APOC3) measured using a protocol such as that presented in Example 1 are provided in the following Table.

| Oligonucleotide | IC50 (nM) |
|---|---|
| WV-5291 | 0.372 |
| WV-6411 | 0.121 |
| WV-6412 | 0.129 |
| WV-6413 | 0.089 |
| WV-6414 | 0.144 |
| WV-6415 | 0.169 |
| WV-6416 | 0.206 |
| WV-6417 | 0.158 |
| WV-6418 | 0.164 |
| WV-6419 | 0.121 |
| WV-6420 | 0.230 |
| WV-6421 | 0.216 |
| WV-6422 | 0.301 |
| WV-6423 | 0.616 |
| WV-6424 | 0.226 |
| WV-6425 | 0.412 |
| WV-6426 | 0.325 |
| WV-6427 | 0.170 |
| WV-6428 | 0.249 |
| WV-6429 | 0.237 |
| WV-6430 | 0.204 |
| WV-6764 | 0.609 |
| WV-6765 | 0.709 |

IC50 of certain oligonucleotides (which may function as antisense oligonucleotides to PNPLA3) measured using a protocol such as that presented in Example 1 are provided in the following Table.

| Wave ID | IC 50 (nM) | Position | Oligonucleotide Start Position |
|---|---|---|---|
| WV-3380 | 1.5 | CDS | 1508 |
| WV-3393 | 1.1 | CDS | 1510 |
| WV-3402 | 1.7 | CDS | 1511 |
| WV-3421 | 1.4 | 3'UTR | 1721 |
| WV-3399 | 0.77 | 3'UTR | 1853 |
| WV-3404 | 1.6 | 3'UTR | 1862 |
| WV-3443 | 1.6 | 3'UTR | 1863 |
| WV-3391 | 0.65 | 3'UTR | 2129 |
| WV-3394 | 1.4 | 3'UTR | 2130 |
| WV-3408 | 0.92 | 3'UTR | 2135 |
| WV-3387 | 1.2 | 3'UTR | 2136 |
| WV-3381 | 1.4 | 3'UTR | 2656 |

Example 3. Example Compounds for Incorporating Moieties—Synthesis of Tri-Antennary GalNAc (with C12, C5, or Triazine Linkers)

In some embodiments, the present disclosure provides technologies (e.g., reagents, methods, conjugates, etc.) for incorporating various moieties (e.g., carbohydrate moieties, lipid moieties, targeting moieties, etc.) into provided oligonucleotide. Described herein are certain examples for incorporating carbohydrate moieties. In some embodiments, a carbohydrate moiety may function as a targeting moiety.

Example 3-1. Synthesis of 1-(((2R,3R,4R,5R,6R)-3-acetamido-4,5-diacetoxy-6-(acetoxymethyl)tetrahydro-2H-pyran-2-yl)oxy)-16,16-bis((3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropoxy)methyl)-5,11,18-trioxo-14-oxa-6,10,17-triazanonacosan-29-oic acid

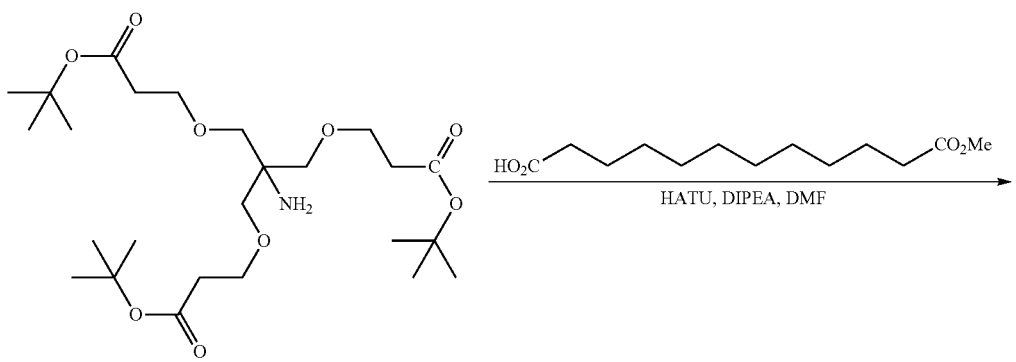

963
964
-continued
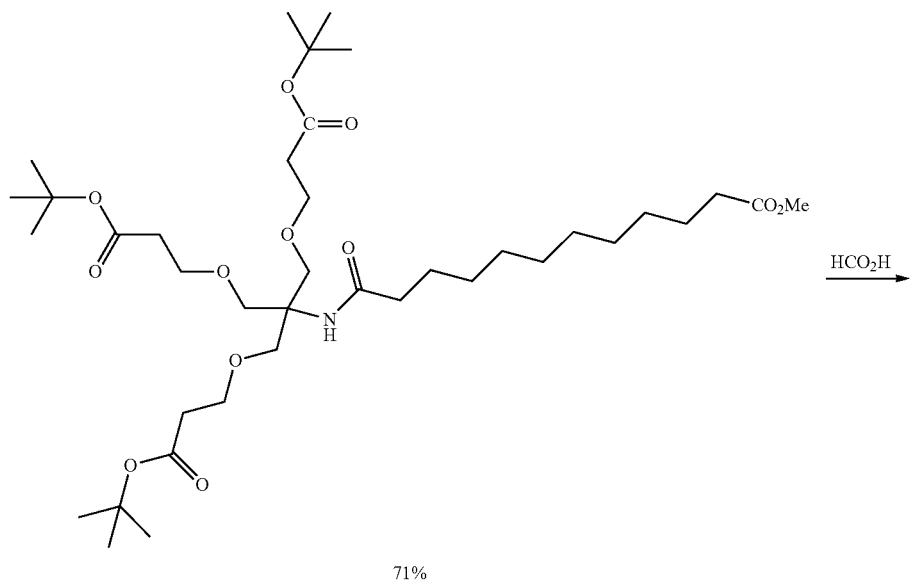
71%
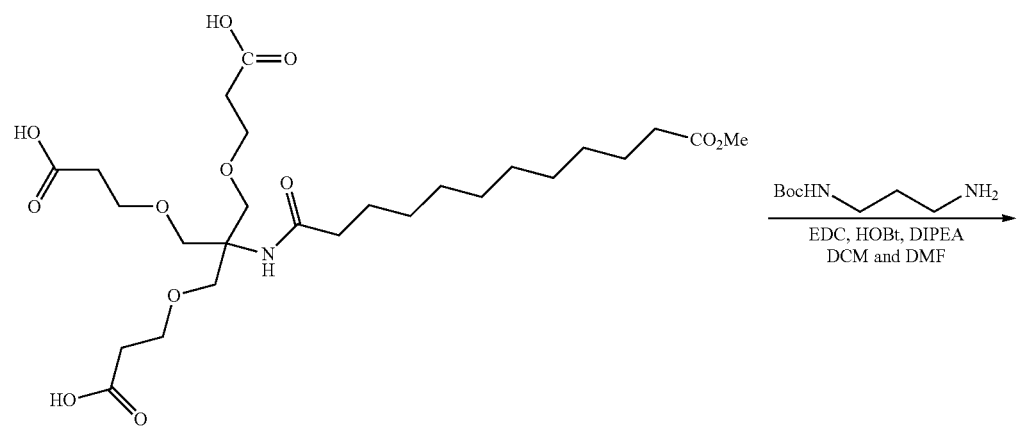
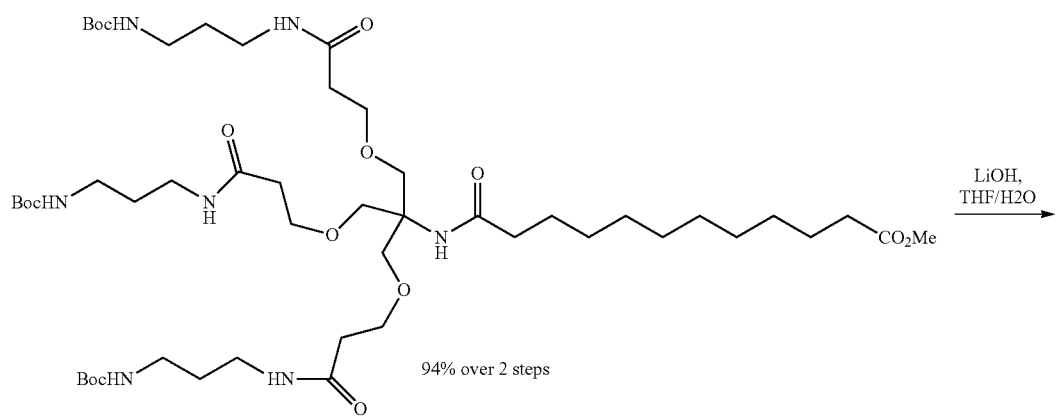
94% over 2 steps

965                                                                                           966
-continued
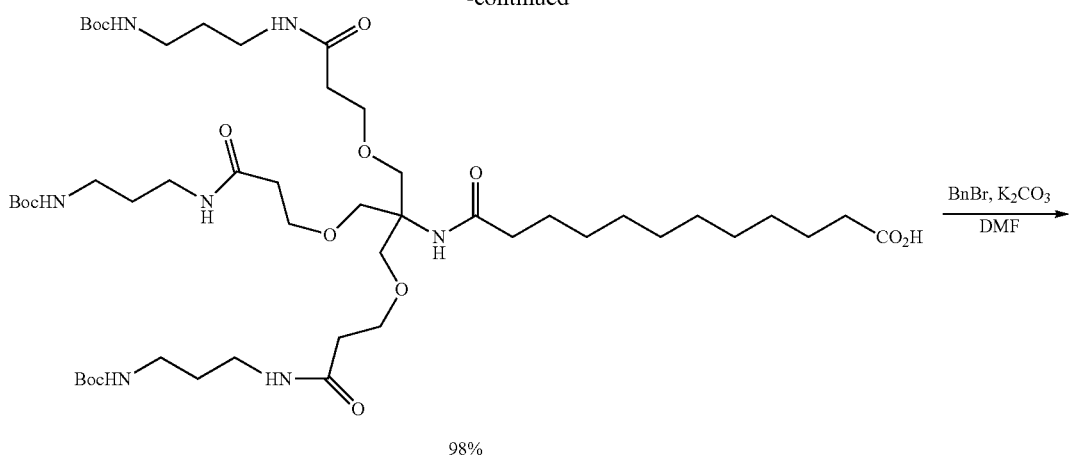
98%
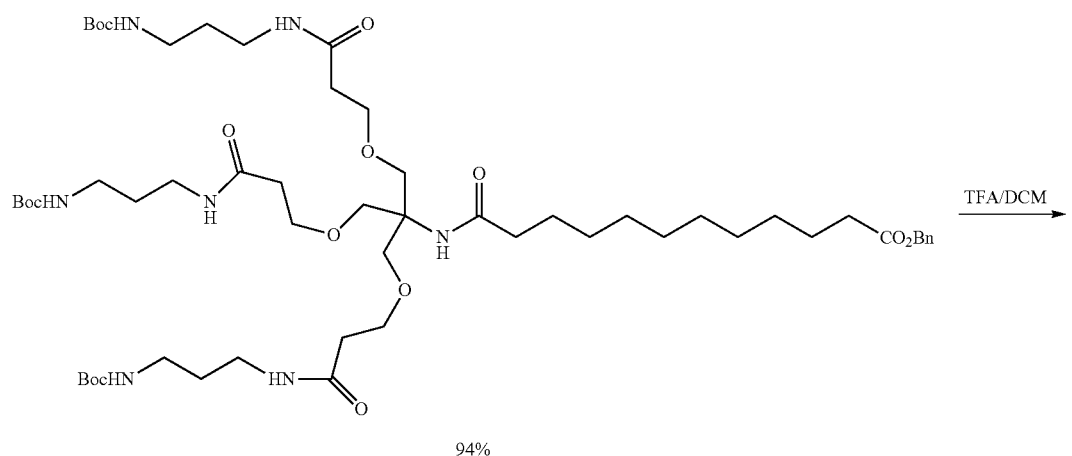
94%
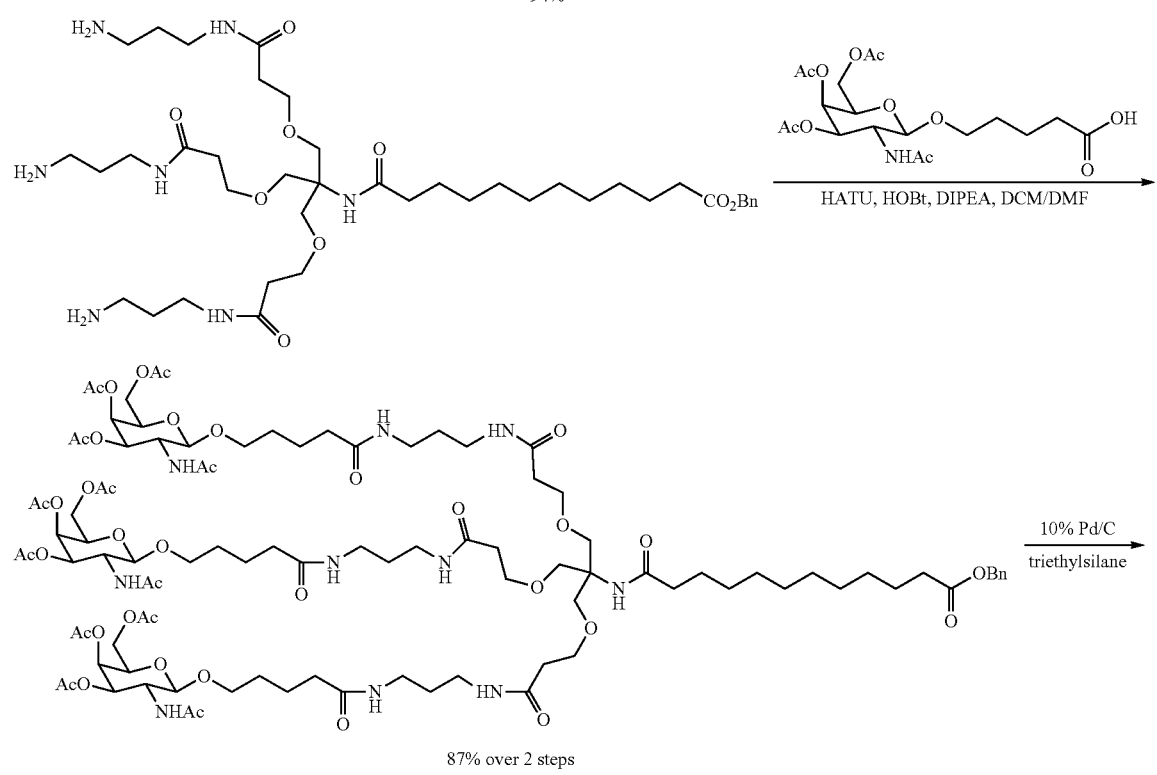
87% over 2 steps

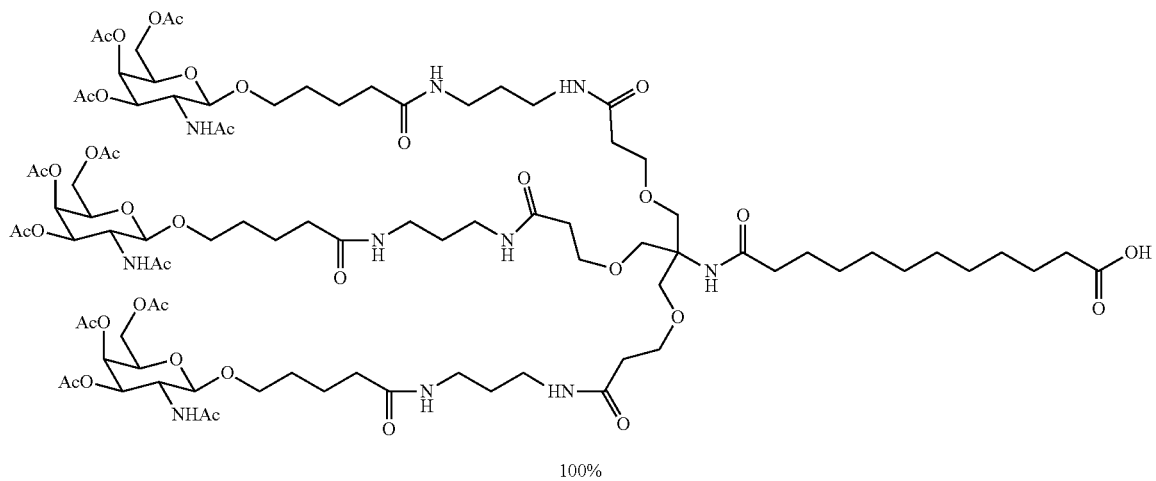

100%

Step 1: To a solution of di-tert-butyl 3,3'-((2-amino-2-((3-(tert-butoxy)-3-oxopropoxy)methyl)propane-1,3-diyl)bis(oxy))dipropanoate (5.0 g, 9.89 mmol) and 12-methoxy-12-oxododecanoic acid (2.416 g, 9.89 mmol) in DMF (45 mL) was added HATU (3.76 g, 9.89 mmol) and DIPEA (2.58 ml, 14.83 mmol). The reaction mixture was stirred at room temperature for 5 hrs. Solvent was concentrated under reduced pressure, and diluted with brine, extracted with EtOAc, dried over anhydrous sodium sulfate, and concentrated to give a residue, which was purified by ISCO (120 g gold silica gel cartridge) eluting with 10% EtOAc in hexane to 40% EtOAc in hexane to give di-tert-butyl 3,3'-((2-((3-(tert-butoxy)-3-oxopropoxy)methyl)-2-(12-methoxy-12-oxododecanamido)propane-1,3-diyl)bis(oxy))dipropanoate (5.13 g, 7.01 mmol, 70.9% yield) as a colorless oil. $^1$H NMR (400 MHz, Chloroform-d) δ 6.03 (s, 1H), 3.74-3.61 (m, 15H), 2.45 (t, J=6.3 Hz, 6H), 2.31 (td, J=7.5, 3.9 Hz, 2H), 2.19-2.10 (m, 2H), 1.64-1.59 (m, 4H), 1.46 (s, 27H), 1.32-1.24 (m, 12H); MS (ESI), 732.6 (M+H)+.

Step 2: A solution of di-tert-butyl 3,3'-((2-((3-(tert-butoxy)-3-oxopropoxy)methyl)-2-(12-methoxy-12-oxododecanamido)propane-1,3-diyl)bis(oxy))dipropanoate (5.0 g, 6.83 mmol) in formic acid (50 mL) was stirred at room temperature for 48 hrs. Solvent was evaporated under reduced pressure, co-evaporated with toluene (3 X) to give a white solid, which was dried under high vacuum for 2 days. LC-MS and H NMR showed the reaction is not complete. The crude product was redissolved in formic acid (50 mL). The reaction mixture was stirred at room temperature for 24 hrs. LC-MS showed the reaction was complete. Solvent was evaporated under reduced pressure, co-evaporated with toluene (3×), dried over high vacuum to give 3,3'-((2-((2-carboxyethoxy)methyl)-2-(12-methoxy-12-oxododecanamido)propane-1,3-diyl)bis(oxy))dipropanoic acid (4.00 g) as a white solid. MS (ESI): 562.4 (M–H)$^-$.

Step 3: A solution of 3,3'-((2-((2-carboxyethoxy)methyl)-2-(12-methoxy-12-oxododecanamido)propane-1,3-diyl)bis(oxy))dipropanoic acid (3.85 g, 6.83 mmol) and HOBt (3.88 g, 28.7 mmol) in DCM (60 mL) and DMF (15 mL) at 0° C. was added tert-butyl (3-aminopropyl)carbamate (4.76 g, 27.3 mmol), EDAC HCl salt (5.24 g, 27.3 mmol) and DIPEA (8.33 ml, 47.8 mmol). The reaction mixture was stirred at 0° C. for 15 minutes and at room temperature for 20 hrs. LC-MS showed the reaction was not complete. t-Butyl (3-aminopropyl) carbamate (1.59 g, 9.12 mmol) and EDC HCl salt (1.75 g, 9.13 mol) was added into the reaction mixture. The reaction mixture was continually stirred at room temperature for 4 hrs. Solvent was evaporated to give a residue, which was dissolved in EtOAc (300 mL), washed with water (1×), saturated sodium bicarbonate (2×), 10% citric acid (2×) and water, dried over sodium sulfate, and concentrated to give a residue which was purified by ISCO (80 g gold cartridge) eluting with DCM to 30% MeOH in DCM to give methyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazaoctacosan-28-oate (6.61 g, 6.40 mmol, 94% yield over 2 steps) as a white solid. MS (ESI): 1033.5 (M+H)+.

Step 4: To a solution of methyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazaoctacosan-28-oate (6.56 g, 6.35 mmol) in THF (75 mL) was added aq. LiOH (0.457 g, 19.06 mmol) in water (25 mL). The mixture was stirred at room temperature for overnight. LC-MS showed the reaction was completed. Solvent was evaporated, acidified using 1 N HCl (45 mL), extracted with DCM (3×), dried over anhydrous sodium sulfate, concentrated to give 15,15-bis(13,13-dimethyl-5,11-dioxo-2,12-dioxa-6,10-diazatetradecyl)-2,2-dimethyl-4,10,17-trioxo-3,13-dioxa-5,9,16-triazaoctacosan-28-oic acid (6.31 g, 6.20 mmol, 98% yield) as a white solid. MS (ESI): 1019.6 (M+H)$^+$.

Step 5: To a solution of 15,15-bis(13,13-dimethyl-5,11-dioxo-2,12-dioxa-6,10-diazatetradecyl)-2,2-dimethyl-4,10,17-trioxo-3,13-dioxa-5,9,16-triazaoctacosan-28-oic acid (6.31 g, 6.20 mmol) and (bromomethyl)benzene (1.272 g, 7.44 mmol) in DMF (40 mL) was added K2CO3 (2.57 g, 18.59 mmol). The mixture was stirred at 40° C. for 4 hrs and at room temperature for overnight. Solvent was evaporated under reduced pressure. The reaction mixture was diluted with EtOAc, washed with water, dried over anhydrous sodium sulfate, concentrated under reduced pressure to give a residue, which was purified by ISCO (80 g cartridge) eluting with DCM to 30% MeOH in DCM to give benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazaoctacosan-28-oate (6.41 g, 5.78 mmol, 93% yield) as a colorless oil. $^1$H NMR (400 MHz, DMSO-d6) δ 7.80 (t, J=5.7 Hz, 3H), 7.39-7.30 (m, 5H), 6.95 (s, 1H), 6.74 (t, J=5.8 Hz, 3H), 5.07 (s, 2H), 3.53 (J, J=7.3 Hz, 6H), 3.51 (s, 6H), 3.02 (q, J=6.7 Hz, 6H), 2.94-2.85 (m, 6H), 2.29 (dt, J=26.1, 6.9 Hz, 8H), 2.02 (q, J=9.7, 8.6 Hz, 2H), 1.56-1.39 (m, 10H), 1.35 (s, 27H), 1.20 (brs, 14H); MS (ESI): 1019.6 (M+H)$^+$.

Step 6: To a solution of benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazaoctacosan-28-oate (2.42 g, 2.183 mmol) in DCM (40 mL) was added 2,2,2-trifluoroacetic acid (8 ml, 105 mmol). The reaction mixture was stirred at room temperature for overnight. Solvent was evaporated under reduced pressure, co-evaporated with toluene (2 X), triturated with ether, dried under high vacuum for overnight. Directly use TFA salt for next step.

Step 7: To a solution of 5-(((2R,3R,4R,5R,6R)-3-acetamido-4,5-diacetoxy-6-(acetoxymethyl)tetrahydro-2H-pyran-2-yl)oxy)pentanoic acid (3.91 g, 8.73 mmol), HBTU (3.48 g, 9.17 mmol) and HOBT (1.239 g, 9.17 mmol) in DCM (25 mL) was added DIPEA (6.08 ml, 34.9 mmol) followed by benzyl 12-((1,19-diamino-10-((3-((3-aminopropyl)amino)-3-oxopropoxy)methyl)-5,15-dioxo-8,12-dioxa-4,16-diazanonadecan-10-yl)amino)-12-oxododecanoate (1.764 g, 2.183 mmol) in DMF (4.0 mL). The mixture was stirred at room temperature for 5 hrs. Solvent was evaporated under reduced pressure to give a residue, which was purified by ISCO (40 g gold column) eluting with 5% MeOH in DCM for 5 column value to remove HOBt followed by 5% to 30% MeOH in DCM to give 1-(((2R,3R,4R,5R,6R)-3-acetamido-4,5-diacetoxy-6-(acetoxymethyl)tetrahydro-2H-pyran-2-y0 oxy)-16,16-bis((3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropoxy)methyl)-5,11,18-trioxo-14-oxa-6,10,17-triazanonacosan-29-oic benzyl ester (3.98 g, 87% yield) as a white solid. $^1$H NMR (400 MHz, DMSO-d6) δ 7.82-7.74 (m, 6H), 7.69 (t, J=5.6 Hz, 3H), 7.33-7.27 (m, 5H), 6.94 (s, 1H), 5.16 (d, J=3.4 Hz, 3H), 5.03 (s, 2H), 4.92 (dd, J=11.2, 3.4 Hz, 3H), 4.43 (d, J=8.4 Hz, 3H), 4.02-3.95 (m, 9H), 3.82 (dt, J=11.2, 8.8 Hz, 3H), 3.65 (dt, J=10.5, 5.6 Hz, 3H), 3.51-3.44 (m, 12H), 3.36 (dt, J=9.6, 6.0 Hz, 3H), 3.01-2.95 (m, 12H), 2.29 (t, J=7.4 Hz, 2H), 2.23 (t, J=6.3 Hz, 6H), 2.05 (s, 9H), 1.99 (t, J=7.0 Hz, 8H), 1.94 (s, 9H), 1.84 (s, 9H), 1.72 (s, 9H), 1.50-1.14 (m, 34H); MS (ESI): 1049.0 (M/2+H)$^+$.

Step 8: To a round bottom flask flushed with Ar was added 10% Pd/C (165 mg, 0.835 mmol) and EtOAc (15 mL). A solution of Benzyl protected tris-GalNAc (1.75 g, 0.835 mmol) in methanol (15 mL) was added followed by triethylsilane (2.67 ml, 16.70 mmol) dropwise. The mixture was stirred at room temperature for 3 hrs. LC-MS showed the reaction was complete, diluted with EtOAc, and filtered through celite, washed with 20% MeOH in EtOAc, concentrated under reduced pressure to give 1-(((2R,3R,4R,5R,6R)-3-acetamido-4,5-diacetoxy-6-(acetoxymethyl)tetrahydro-2H-pyran-2-yl)oxy)-16,16-bis((3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropoxy)methyl)-5,11,18-trioxo-14-oxa-6,10,17-triazanonacosan-29-oic acid (1.67 g, 0.832 mmol, 100% yield) as a white solid. $^1$H NMR (400 MHz, DMSO-d6) δ 11.95 (s, 1H), 7.83-7.74 (m, 6H), 7.69 (t, J=5.7 Hz, 3H), 6.93 (s, 1H), 5.16 (d, J=3.4 Hz, 3H), 4.92 (dd, J=11.2, 3.4 Hz, 3H), 4.43 (d, J=8.4 Hz, 3H), 4.01-3.94 (m, 9H), 3.82 (dt, J=11.3, 8.8 Hz, 3H), 3.66 (dt, J=10.7, 5.6 Hz, 3H), 3.54-3.43 (m, 12H), 3.41-3.33 (m, 3H), 3.03-2.94 (m, 12H), 2.24 (t, J=7.4 Hz, 10H), 2.14 (t, J=7.4 Hz, 2H), 2.06 (s, 9H), 2.00 (t, J=7.2 Hz, 8H), 1.95 (s, 9H), 1.84 (s, 9H), 1.73 (s, 9H), 1.51-1.14 (m, 34H). MS (ESI): 1003.8 (M/2+H)$^+$.

Example 3-2. Synthesis of 22-(((2R,3R,4R,5R,6R)-3-acetamido-4,5-diacetoxy-6-(acetoxymethyl)tetrahydro-2H-pyran-2-yl)oxy)-7,7-bis((3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropoxy)methyl)-5,12,18-trioxo-9-oxa-6,13,17-triazadocosanoic acid

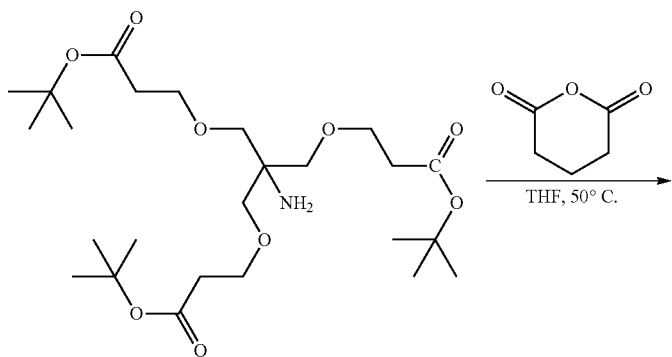

-continued
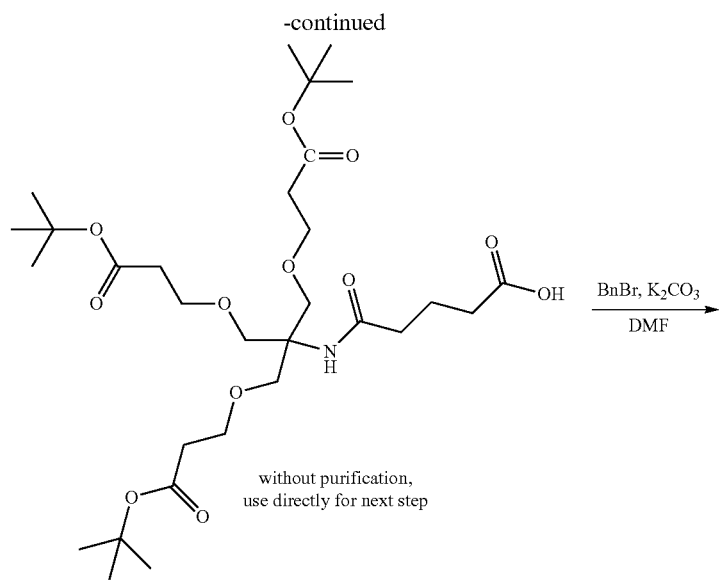
without purification,
use directly for next step
BnBr, K₂CO₃ / DMF →
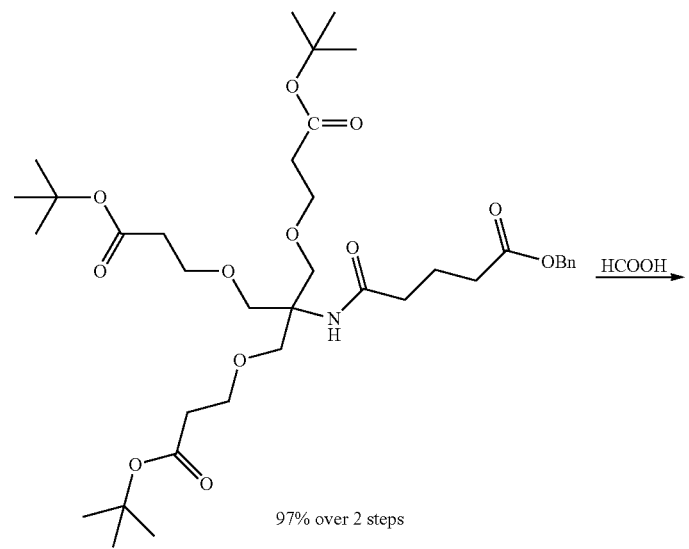
97% over 2 steps
HCOOH →
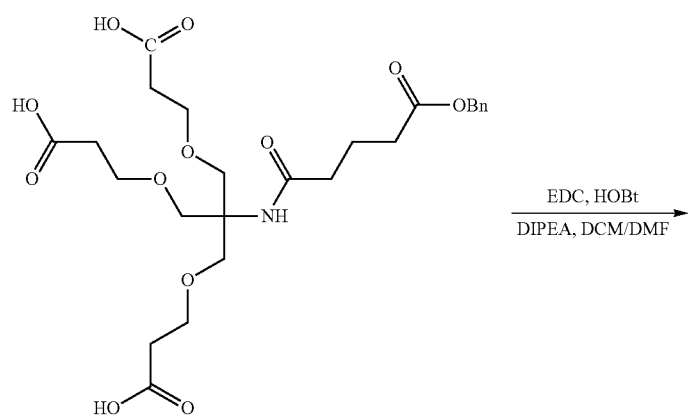
EDC, HOBt / DIPEA, DCM/DMF →

973 974
-continued
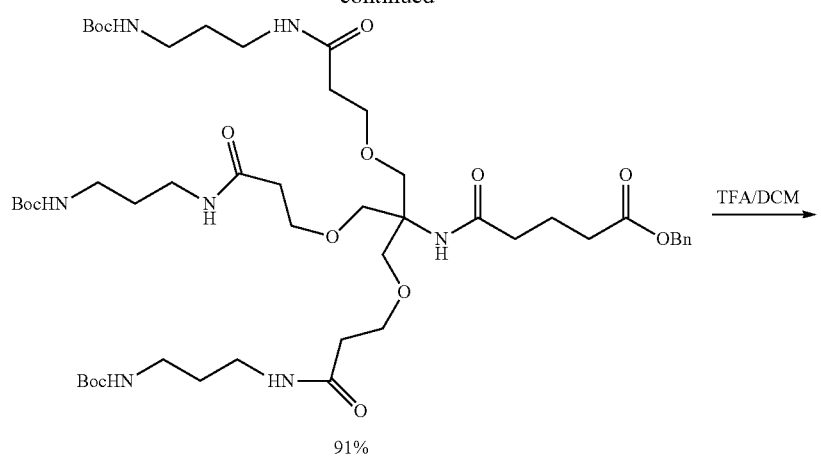
91%
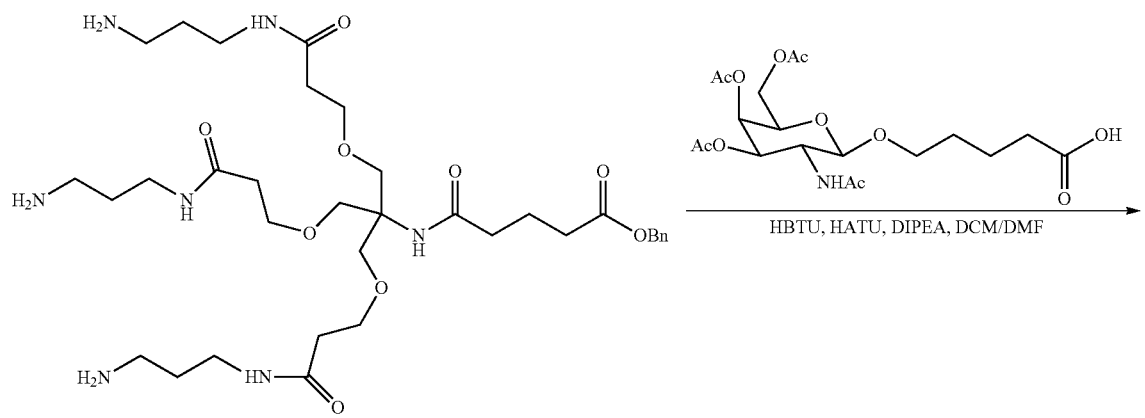
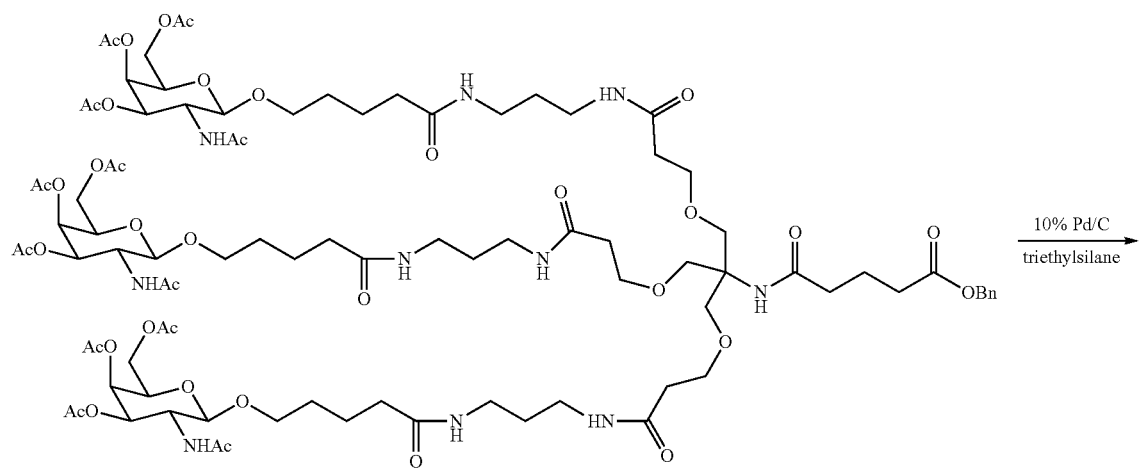
59% over 2 steps

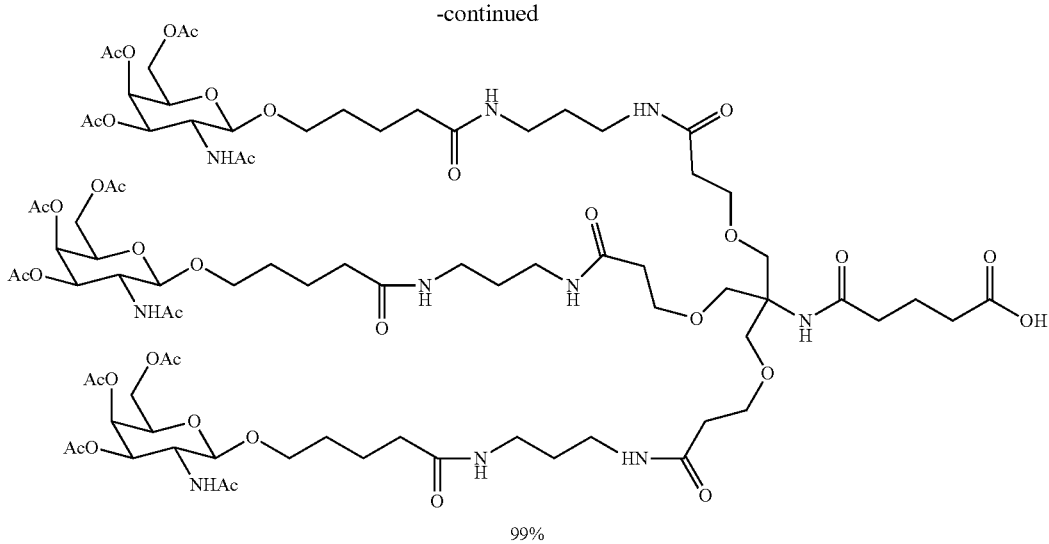

99%

Step 1: A solution of di-tert-butyl 3,3'-((2-amino-2-((3-(tert-butoxy)-3-oxopropoxy)methyl)propane-1,3-diyl)bis(oxy))dipropanoate (4.0 g, 7.91 mmol) and dihydro-2H-pyran-2,6(3H)-dione (0.903 g, 7.91 mmol) in THF (40 mL) was stirred at 50° C. for 3 hrs and at rt for 3 hrs. LC-MS showed desired product. Solvent was evaporated to give the acid, which was directly used for next step without purification.

Step 2: To a solution of 5-((9-((3-(tert-butoxy)-3-oxopropoxy)methyl)-2,2,16,16-tetramethyl-4,14-dioxo-3,7,11,15-tetraoxaheptadecan-9-yl)amino)-5-oxopentanoic acid (4.90 g, 7.91 mmol) and (bromomethyl)benzene (1.623 g, 9.49 mmol) in DMF was added anhydrous K2CO3 (3.27 g, 23.73 mmol). The mixture was stirred at 40° C. for 4 hrs and at room temperature for overnight. Solvent was evaporated under reduced pressure. The reaction mixture was diluted with EtOAc, washed with water, dried over anhydrous sodium sulfate, concentrated under reduced pressure to give a residue, which was purified by ISCO eluting with 10% EtOAc in hexane to 50% EtOAc in hexane to give di-tert-butyl 3,3'-42-(5-(benzyloxy)-5-oxopentanamido)-2-((3-(tert-butoxy)-3-oxopropoxy)methyl)propane-1,3-diyl)bis(oxy))dipropanoate (5.43 g, 7.65 mmol, 97% yield) as a colorless oil. $^1$H NMR (400 MHz, Chloroform-d) δ 7.36-7.28 (m, 5H), 6.10 (s, 1H), 5.12 (s, 2H), 3.70 (s, 6H), 3.64 (t, J=8.0 Hz, 6H), 2.50-2.38 (m, 8H), 2.22 (t, J=7.3 Hz, 2H), 1.95 (p, J=7.4 Hz, 2H), 1.45 (s, 27H); MS, 710.5 (M+H)$^+$.

Step 3: A solution of di-tert-butyl 3,3'-((2-(5-(benzyloxy)-5-oxopentanamido)-2-((3-(tert-butoxy)-3-oxopropoxy)methyl)propane-1,3-diyl)bis(oxy))dipropanoate (5.43 g, 7.65 mmol) in formic acid (50 mL) was stirred at room temperature for 48 hrs. LC-MS showed the reaction was not complete. Solvent was evaporated under reduced pressure. The crude product was re-dissolved in formic acid (50 mL) and was stirred at room temperature for 6 hrs. LC-MS showed the reaction was complete. Solvent was evaporated under reduced pressure, co-evaporated with toluene (3×) under reduced pressure, and dried under vacuum to give 3,3'-((2-(5-(benzyloxy)-5-oxopentanamido)-2-((2-carboxyethoxy)methyl)propane-1,3-diyl)bis(oxy))dipropanoic acid (4.22 g, 7.79 mmol, 102% yield) as a white solid. $^1$H NMR (500 MHz, DMSO-d6) δ 12.11 (s, 3H), 7.41-7.27 (m, 5H), 6.97 (s, 1H), 5.07 (s, 2H), 3.55 (t, J=6.4 Hz, 6H), 3.53 (s, 6H), 2.40 (t, J=6.3 Hz, 6H), 2.37-2.26 (m, 2H), 2.08 (t, J=7.3 Hz, 2H), 1.70 (p, J=7.4 Hz, 2H); MS, 542.3 (M+H)$^+$.

Step 4: A solution of 3,3'-((2-(5-(benzyloxy)-5-oxopentanamido)-2-((2-carboxyethoxy)methyl)propane-1,3-diyl)bis(oxy))dipropanoic acid (4.10 g, 7.57 mmol) and HOBt (4.60 g, 34.1 mmol) in DCM (60 mL) and DMF (15 mL) at 0° C. was added tert-butyl (3-aminopropyl)carbamate (5.94 g, 34.1 mmol), EDAC HCl salt (6.53 g, 34.1 mmol) and DIPEA (10.55 ml, 60.6 mmol). The reaction mixture was stirred at 0° C. for 15 minutes and at room temperature for 20 hrs. LC-MS showed the reaction was not complete. EDAC HCl salt (2.0 g) and tert-butyl (3-aminopropyl)carbamate (1.0 g) was added into the reaction mixture. The reaction mixture was stirred at room temperature for 4 hrs. Solvent was evaporated to give a residue, which was dissolved in EtOAc (300 mL), washed with water (1×), saturated sodium bicarbonate (2×), 10% citric acid (2×) and water, dried over sodium sulfate, and concentrated to give a residue which was purified by ISCO (80 g gold cartridge) eluting with DCM to 30% MeOH in DCM to give benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazahenicosan-21-oate (6.99 g, 6.92 mmol, 91% yield) as a white solid. $^1$H NMR (500 MHz, Chloroform-d) δ 7.38-7.33 (m, 5H), 6.89 (brs, 3H), 6.44 (s, 1H), 5.23 (brs, 3H), 5.12 (s, 2H), 3.71-3.62 (m, 12H), 3.29 (q, J=6.2 Hz, 6H), 3.14 (q, J=6.5 Hz, 6H), 2.43 (dt, J=27.0, 6.7 Hz, 8H), 2.24 (t, J=7.2 Hz, 2H), 1.96 (p, J=7.5 Hz, 2H), 1.64-1.59 (m, 6H), 1.43 (d, J=5.8 Hz, 27H); MS (ESI): 1011.5 (M+H)$^+$.

Step 5: To a solution of benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazahenicosan-21-oate (0.95 g, 0.940 mmol) in DCM (5 mL) was added TFA (5 mL). The reaction mixture was stirred at room temperature for 4 hrs. LC-MS showed the reaction was completed. Solvent was evaporated under reduced pressure to give benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate as a colorless oil. Directly use for next step without purification.

Step 6: To a solution of 5-(((2R,3R,4R,5R,6R)-3-acetamido-4,5-diacetoxy-6-(acetoxymethyl)tetrahydro-2H-pyran-2-yl)oxy)pentanoic acid (1.684 g, 3.76 mmol), HBTU (1.246 g, 3.29 mmol) and HOBT (0.052 g, 0.376 mmol) in DCM (40 mL) followed by 10-(5-(benzyloxy)-5-oxopentanamido)-N1,N19-dichloro-10-((3-((3-(chloroammonio)propyl)amino)-3-oxopropoxy)methyl)-5,15-dioxo-8,12-dioxa-4,16-diazanonadecane-1,19-diaminium (0.767 g, 0.940 mmol) in DMF (2.0 mL). The mixture was stirred at room temperature for 5 hrs. Solvent was evaporated under reduced pressure to give a residue, which was purified by ISCO (40 g gold column) eluting with DCM to 30% MeOH in DCM to give 22-(((2R,3R,4R,5R,6R)-3-acetamido-4,5-diacetoxy-6-(acetoxymethyl)tetrahydro-2H-pyran-2-yl)oxy)-7,7-bis((3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropoxy)methyl)-5,12,18-trioxo-9-oxa-6,13,17-triazadocosanoic benzyl ester (1.11 g, 0.556 mmol, 59% yield) as a white solid. MS (ESI): 1000.0 (M/2+H)+.

Step 7: To a round bottom flask flushed with Ar was added 10% Pd/C (100 mg, 0.500 mmol) and EtOAc (10 mL). A solution of 22-(((2R,3R,4R,5R,6R)-3-acetamido-4,5-diacetoxy-6-(acetoxymethyl)tetrahydro-2H-pyran-2-yl)oxy)-7,7-bis((3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropoxy)methyl)-5,12,18-trioxo-9-oxa-6,13,17-triazadocosanoic benzyl ester (1.00 g, 0.500 mmol) in methanol (10 mL) was added followed by triethylsilane (1.599 ml, 10.01 mmol) dropwise. The mixture was stirred at room temperature for 3 hrs. LC-MS showed the reaction was complete, diluted with EtOAc, and filtered through celite, washed with 20% MeOH in EtOAc, concentrated under reduced pressure to give 22-(((2R,3R,4R,5R,6R)-3-acetamido-4,5-diacetoxy-6-(acetoxymethyl)tetrahydro-2H-pyran-2-yl)oxy)-7,7-bis((3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropoxy)methyl)-5,12,18-trioxo-9-oxa-6,13,17-triazadocosan-1-oic acid (0.9433 g, 0.494 mmol, 99% yield) as a white solid. $^1$H NMR (500 MHz, DMSO-d6) δ 7.85-7.78 (m, 6H), 7.72 (t, J=5.7 Hz, 3H), 7.03 (s, 1H), 5.20 (d, J=3.4 Hz, 3H), 4.95 (dd, J=11.2, 3.5 Hz, 3H), 4.47 (d, J=8.3 Hz, 3H), 4.05-3.99 (m, 9H), 3.85 (dt, J=11.0, 8.8 Hz, 3H), 3.69 (dt, J=10.6, 5.8 Hz, 3H), 3.52 (dd, J=12.3, 5.6 Hz, 12H), 3.39 (dt, J=11.2, 6.3 Hz, 3H), 3.02 (p, J=6.3 Hz, 12H), 2.26 (t, J=6.4 Hz, 6H), 2.17 (t, J=7.5 Hz, 2H), 2.11-2.07 (m, 11H), 2.03 (t, J=7.1 Hz, 6H), 1.98 (s, 9H), 1.87 (s, 9H), 1.76 (s, 9H), 1.53-1.18 (m, 20H); MS (ESI): 1909.4 (M+H)+.

Example 3-3. Synthesis of 5-(4-(4-((3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropyl)amino)-6-(bis(3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropyl)amino)-1,3,5-triazin-2-yl)piperazin-1-yl)-5-oxopentanoic acid

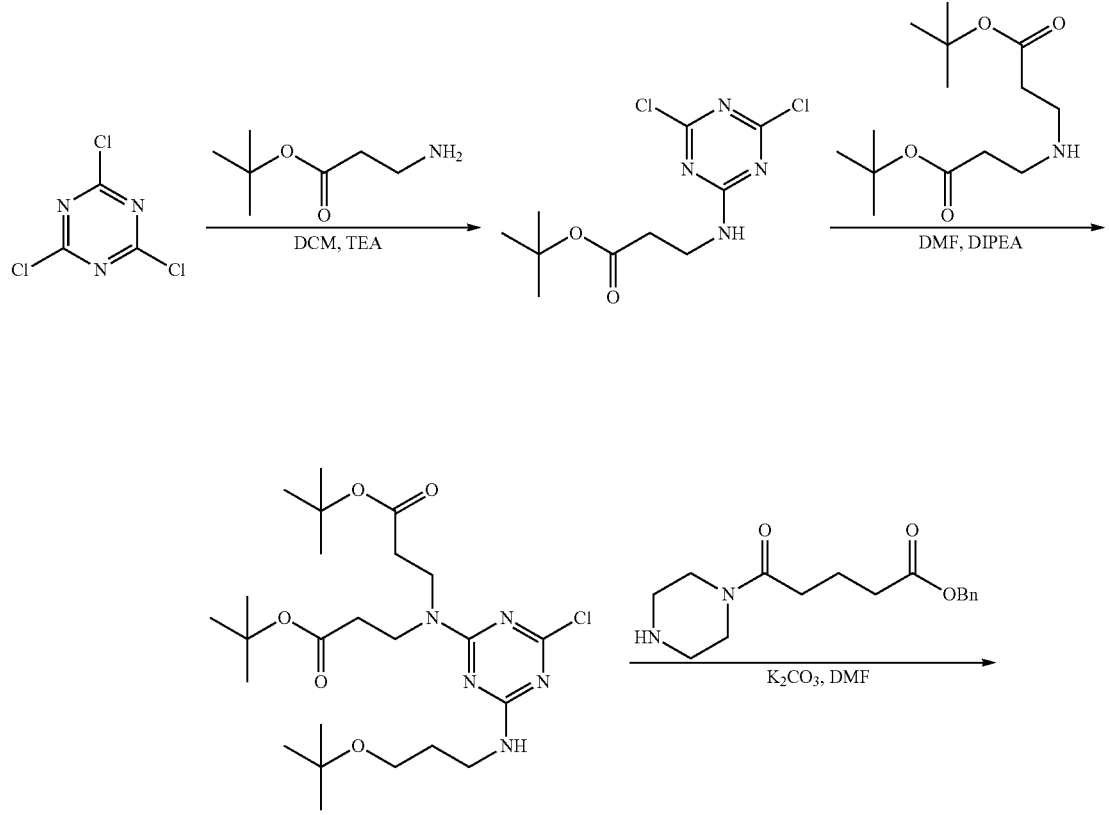

-continued
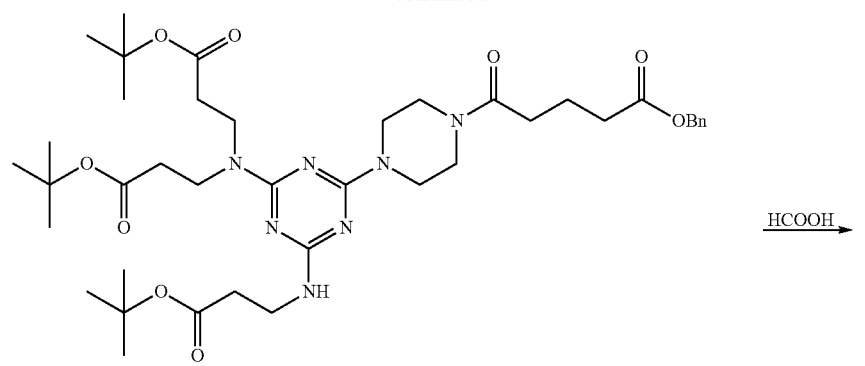
30% over 3 steps
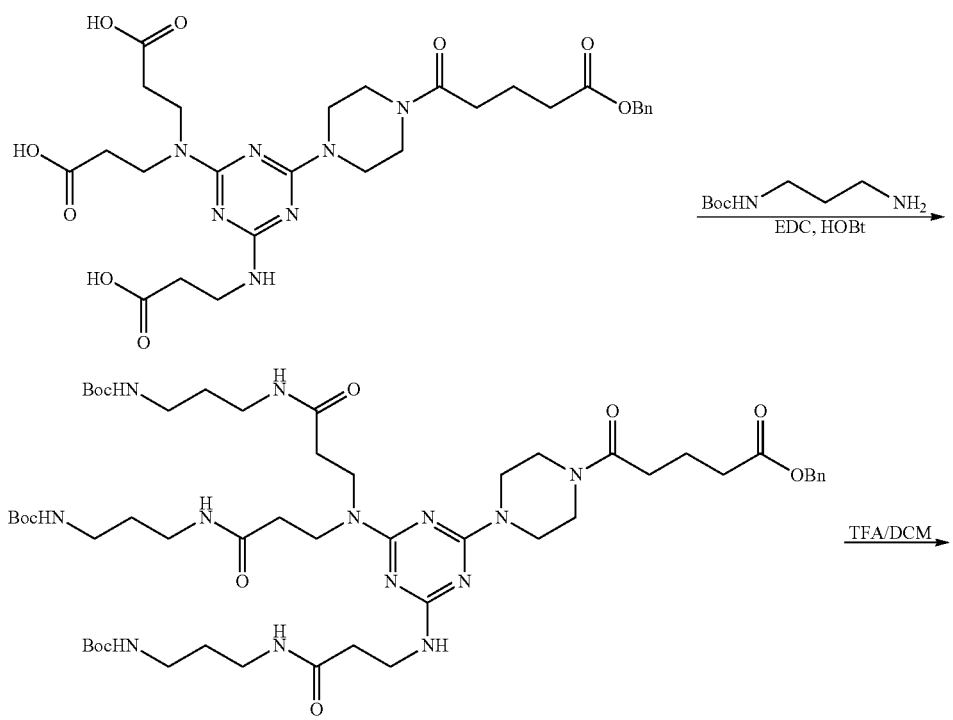
100% over 2 steps
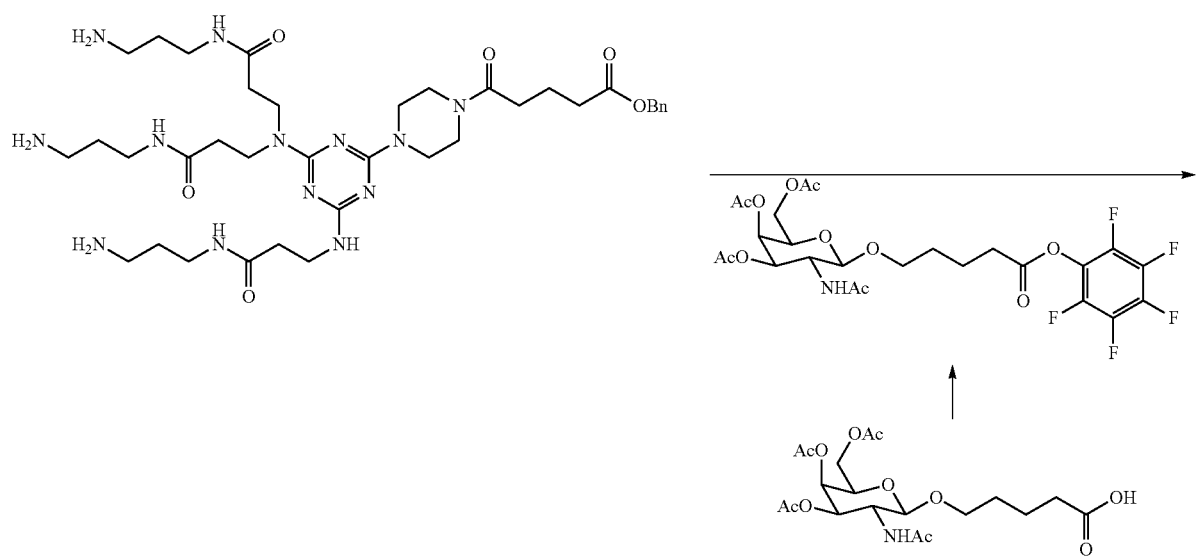

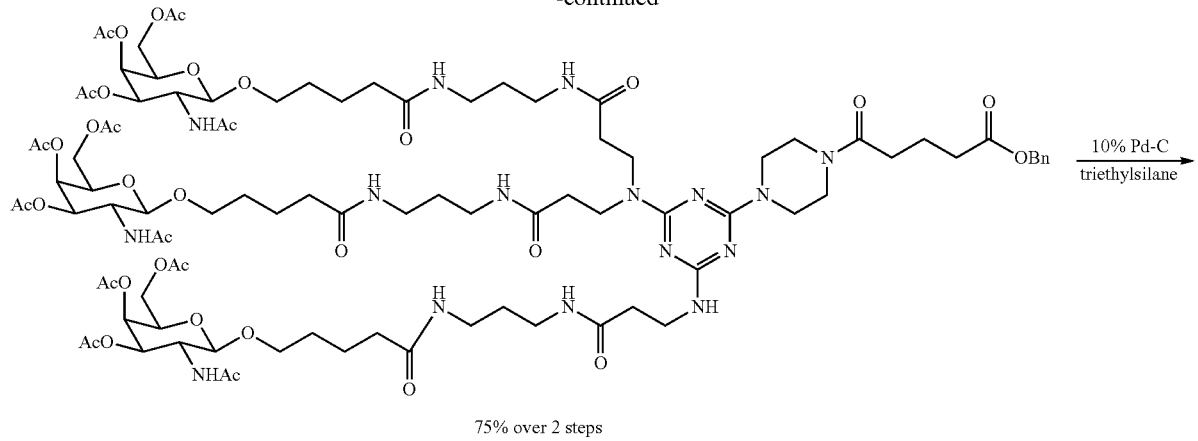

75% over 2 steps

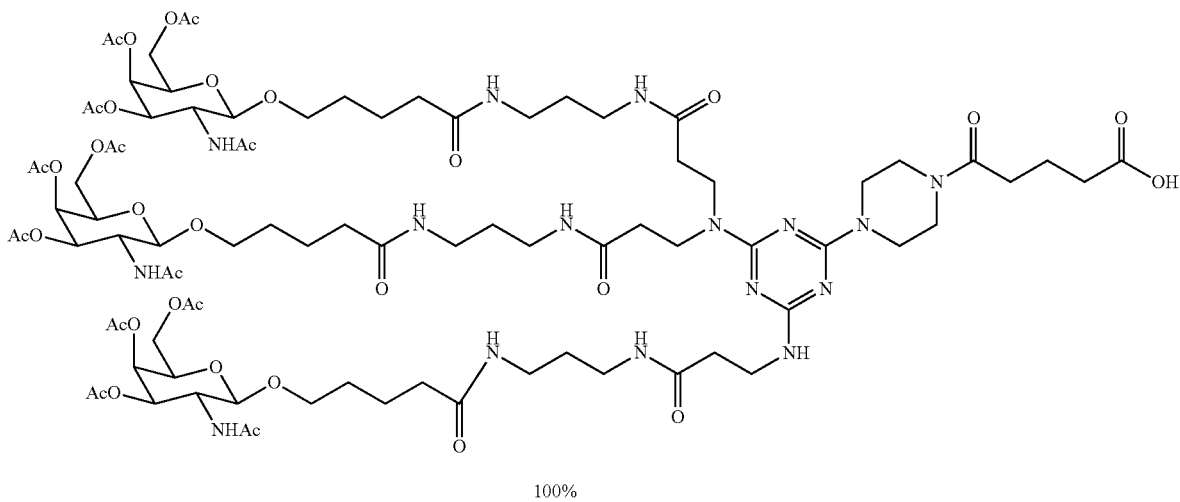

100%

Steps 1 to 3: To a solid reagent 2,4,6-trichloro-1,3,5-triazine (0.700 g, 3.80 mmol) in DCM (25 mL) at 0° C. was added tert-butyl 3-aminopropanoate HCl salt (0.690 g, 3.80 mmol) and TEA (0.635 ml, 4.56 mmol). The reaction mixture was stirred at 0° C. for 1 hrs. LC-MS showed the desired product. Solvent was evaporated under reduced pressure to give a residue, which was directly used for next step. To a solution of tert-butyl 3-((4,6-dichloro-1,3,5-triazin-2-yl)amino)propanoate (1.114 g, 3.80 mmol) in DMF (15 mL) was added di-tert-butyl 3,3'-azanediyldipropanoate (1.039 g, 3.80 mmol) and DIPEA (1.324 ml, 7.60 mmol). The reaction mixture was stirred at room temperature for 2 hrs. LC-MS showed desired product. To the above reaction mixture was added benzyl 5-oxo-5-(piperazin-1-yl)pentanoate (1.103 g, 3.80 mmol) and K2CO3 (1.576 g, 11.40 mmol). The reaction mixture was stirred at room temperature for overnight. Diluted with EtOAc, filtered and concentrated under reduced pressure to give a residue, which was purified by ISCO (40 g gold) eluting with 10% EtOAc in hexane to 50% EtOAc in hexane to give di-tert-butyl 3,3'-((4-(4-(5-(benzyloxy)-5-oxopentanoyl)piperazin-1-yl)-6-((3-(tert-butoxy)-3-oxopropyl)amino)-1,3,5-triazin-2-yl)azanediyl)dipropionate (0.90 g, 30%) as a colorless oil. $^1$H NMR (500 MHz, Chloroform-d) δ 7.43-7.31 (m, 5H), 5.12 (s, 2H), 3.81-3.66 (m, 8H), 3.60 (dd, J=7.6, 4.8 Hz, 4H), 3.40 (t, J=5.1 Hz, 2H), 2.57-2.44 (m, 8H), 2.39 (t, J=7.4 Hz, 2H), 2.06-1.95 (m, 2H), 1.45 (s, 9H), 1.43 (s, 18H); MS (ESI): 784.7 (M+H)$^+$.

Step 4: A solution of di-tert-butyl 3,3'-((4-(4-(5-(benzyloxy)-5-oxopentanoyl)piperazin-1-yl)-6-43-(tert-butoxy)-3-oxopropyl)amino)-1,3,5-triazin-2-yl)azanediyl)dipropanoate (0.90 g, 1.148 mmol) in formic acid (20 mL) was stirred at room temperature for overnight. LC-MS showed the reaction was not completed and solvent was evaporated. Formic acid (20 mL) was added to the reaction mixture and the reaction mixture was stirred at room temperature for overnight. LC-MS showed the reaction was complete. Solvent was concentrated, co-evaporated with toluene (2×) and dried under vacuum for overnight to give 3,3'-((4-(4-(5-(benzyloxy)-5-oxopentanoyl)piperazin-1-yl)-6-((2-carboxyethyl)amino)-1,3,5-triazin-2-yl)azanediyl)dipropanoic acid (0.75 g, 1.218 mmol, 106% yield) as a white solid. MS (ESI), 616.5 (M+H)$^+$.

Step 5: A solution of 3,3'-((4-(4-(5-(benzyloxy)-5-oxopentanoyl)piperazin-1-yl)-6-((2-carboxyethyl)amino)-1,3,5-triazin-2-yl)azanediyl)dipropanoic acid (0.707 g, 1.148 mmol) and HOBt (0.651 g, 4.82 mmol) in DCM (60 mL) and DMF (15 mL) at 0° C. was added tert-butyl (3-aminopropyl) carbamate (0.840 g, 4.82 mmol), EDAC HCl salt (0.924 g, 4.82 mmol) and DIPEA (1.400 ml, 8.04 mmol). The reaction mixture was stirred at 0° C. for 15 minutes and at room temperature for 20 hrs. LC-MS showed the reaction was not complete. t-Butyl (3-aminopropyl) carbamate (0.28 g) and EDC HCl salt (0.46 g) was added into the reaction mixture. The reaction mixture was continually stirred at room temperature for 4 hrs. Solvent was evaporated to give a residue, which was dissolved in EtOAc (300 mL), washed with water (1×), saturated sodium bicarbonate (2×), 10% citric acid (2×) and water, dried over sodium sulfate, and concentrated to give a residue which was purified by ISCO (80 g gold cartridge) eluting with DCM to 30% MeOH in DCM to give benzyl 5-(4-(4-(bis(3-((3-((tert-butoxycarbonyl)amino)propyl)amino)-3-oxopropyl)amino)-6-((3-((3-((tertbutoxycarbonyl) amino)propyl)amino)-3-oxopropyl)amino)-1,3,5-triazin-2-yl)piperazin-1-yl)-5-oxopentanoate (1.24 g, 1.144 mmol, 100% yield) as a white solid. MS (ESI): 1084.8 (M+H)$^+$.

Step 6: A solution of benzyl 5-(4-(4-(bis(3-((3-((tert-butoxycarbonyl)amino)propyl)amino)-3-oxopropyl)amino)-6-((3-((3-((tertbutoxycarbonyl) amino)propyl)amino)-3-oxopropyl)amino)-1,3,5-triazin-2-yl)piperazin-1-yl)-5-oxopentanoate (328.3 mg, 0.303 mmol) in DCM (5.0 mL) was added TFA (3.0 mL). The reaction mixture was stirred at room temperature for 3 hrs. Solvent was evaporated under reduced pressure, use directly for next step without purification. MS (ESI): 784.6 (M+H)$^+$.

Step 7: To a solution of 5-(((2R,3R,4R,5R,6R)-3-acetamido-4,5-diacetoxy-6-(acetoxymethyl)tetrahydro-2H-pyran-2-yl)oxy)pentanoic acid (0.570 g, 1.273 mmol) in DCM (6 mL) was added DIPEA (0.40 mL, 2.296 mmol) and perfluorophenyl 2,2,2-trifluoroacetate (0.535 g, 1.910 mmol). The reaction mixture was stirred at room temperature for 2 hrs. Solvent was evaporated under reduced pressure to give a residue, directly use for next step. MS (ESI): 614.3 (M+H)$^+$. A solution of benzyl 5-(4-(4-((3-((3-aminopropyl)amino)-3-oxopropyl)amino)-6-(bis(3-((3-aminopropyl)amino)-3-oxopropyl)amino)-1,3,5-triazin-2-yl)piperazin-1-yl)-5-oxopentanoate (0.238 g, 0.303 mmol) in DCM (15 mL) and DMF (3 mL) was added DIPEA (0.633 ml, 3.64 mmol), and a solution of (2R,3R,4R,5R,6R)-5-acetamido-2-(acetoxymethyl)-6-((5-oxo-5-(perfluorophenoxy)pentyl)oxy)tetrahydro-2H-pyran-3,4-diyl diacetate (0.781 g, 1.273 mmol) in DCM (6 mL). The reaction mixture was stirred at room temperature for 4 hrs. Solvent was evaporated under reduced pressure to give a residue, which was purified by ISCO (40 g gold) eluting with DCM to 40% MeOH in DCM to give 5-(4-(4-(((3-((3-(5-(((2R,3R,4R,5R,6R)-3-acetamido-4,5-diacetoxy-6-(acetoxymethyl)tetrahydro-2H-pyran-2-yl)oxy)pentanamido) propyl)amino)-3-oxopropyl)amino)-6-(bis(3-((3-(5-(((2R,3R,4R,5R,6R)-3-acetamido-4,5-diacetoxy-6-(acetoxymethyl)tetrahydro-2H-pyran-2-yl)oxy) pentanamido)propyl)amino)-3-oxopropyl)amino)-1,3,5-triazin-2-yl)piperazin-1-yl)-5-oxopentanoic benzyl ester (0.47 g, 0.227 mmol, 74.9% yield) as a white solid. $^1$H NMR (500 MHz, DMSO-d6) δ 7.82-7.78 (m, 6H), 7.70 (t, J=5.7 Hz, 3H), 7.35-7.28 (m, 5H), 6.63 (brs, 1H), 5.20 (d, J=3.3 Hz, 3H), 5.08 (s, 2H), 4.95 (dd, J=11.2, 3.4 Hz, 3H), 4.47 (d, J=8.4 Hz, 3H), 4.05-3.96 (m, 9H), 3.85 (dt, J=11.1, 8.8 Hz, 3H), 3.72-3.53 (m, 12H), 3.43-3.36 (m, 6H), 3.05-2.97 (m, 12H), 2.41-2.27 (m, 10H), 2.08 (s, 9H), 2.03 (d, J=7.0 Hz, 6H), 1.98 (s, 9H), 1.87 (s, 9H), 1.75 (s, 9H), 1.47 (s, 9H), 1.53-1.19 (m, 13H); MS (ESI): 1037.0 (M+H)/2$^+$.

Step 8: To a solution of 5-(4-(4-(((3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropyl)amino)-6-(bis(3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropyl) amino)-1,3,5-triazin-2-yl)piperazin-1-yl)-5-oxopentanoic benzyl ester (0.39 g, 0.188 mmol) in EtOAc (10 mL) was added 10% Pd—C(50 mg) followed by 10 mL MeOH under Ar. triethylsilane (0.601 ml, 3.76 mmol) was added to the reaction mixture slowly. The reaction mixture was stirred at room temperature for 2 hrs. filtered through celite, washed with 50% MeOH in EtOAc, solvents were evaporated under reduced pressure to give 5-(4-(4-(((3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropyl)amino)-6-(bis(3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropyl)amino)-1,3,5-triazin-2-yl)piperazin-1-yl)-5-oxopentanoic acid (0.373 g, 100% yield) a white solid. $^1$H NMR (500 MHz, DMSO-d6) δ 7.82-7.78 (m, 6H), 7.71 (t, J=5.7 Hz, 3H), 6.64 (s, 1H), 5.20 (d, J=3.3 Hz, 3H), 4.95 (dd, J=11.2, 3.4 Hz, 3H), 4.47 (d, J=8.5 Hz, 3H), 4.06-3.96 (m, 9H), 3.85 (dt, J=11.1, 8.8 Hz, 3H), 3.73-3.56 (m, 11H), 3.45-3.35 (m, 5H), 3.09-2.98 (m, 13H), 2.37-2.28 (m, 10H), 2.25 (t, J=7.3 Hz, 2H), 2.09 (s, 9H), 2.03 (t, J=7.0 Hz, 6H), 1.98 (s, 9H), 1.88 (s, 9H), 1.76 (s, 9H), 1.74-1.67 (m, 2H), 1.55-1.40 (m, 15H); MS (ESI): 1983.4 (M+H)$^+$.

Example 4A. Example Compounds for Incorporating Moieties

Synthesis of 18,18-bis(17-((1S,2R,3R,4R,5S)-4-acetamido-2,3-dihydroxy-6,8-dioxabicyclo[3.2.1] octan-1-yl)-5,11-dioxo-2,16-dioxa-6,10-diazaheptadecyl)-1-((1S,2R,3R,4R,5 S)-4-acetamido-2,3-dihydroxy-6,8-dioxabicyclo[3.2.1]octan-1-yl)-'7,13, 20-trioxo-2,16-dioxa-8,12,19-triazatetracosan-24-oic acid

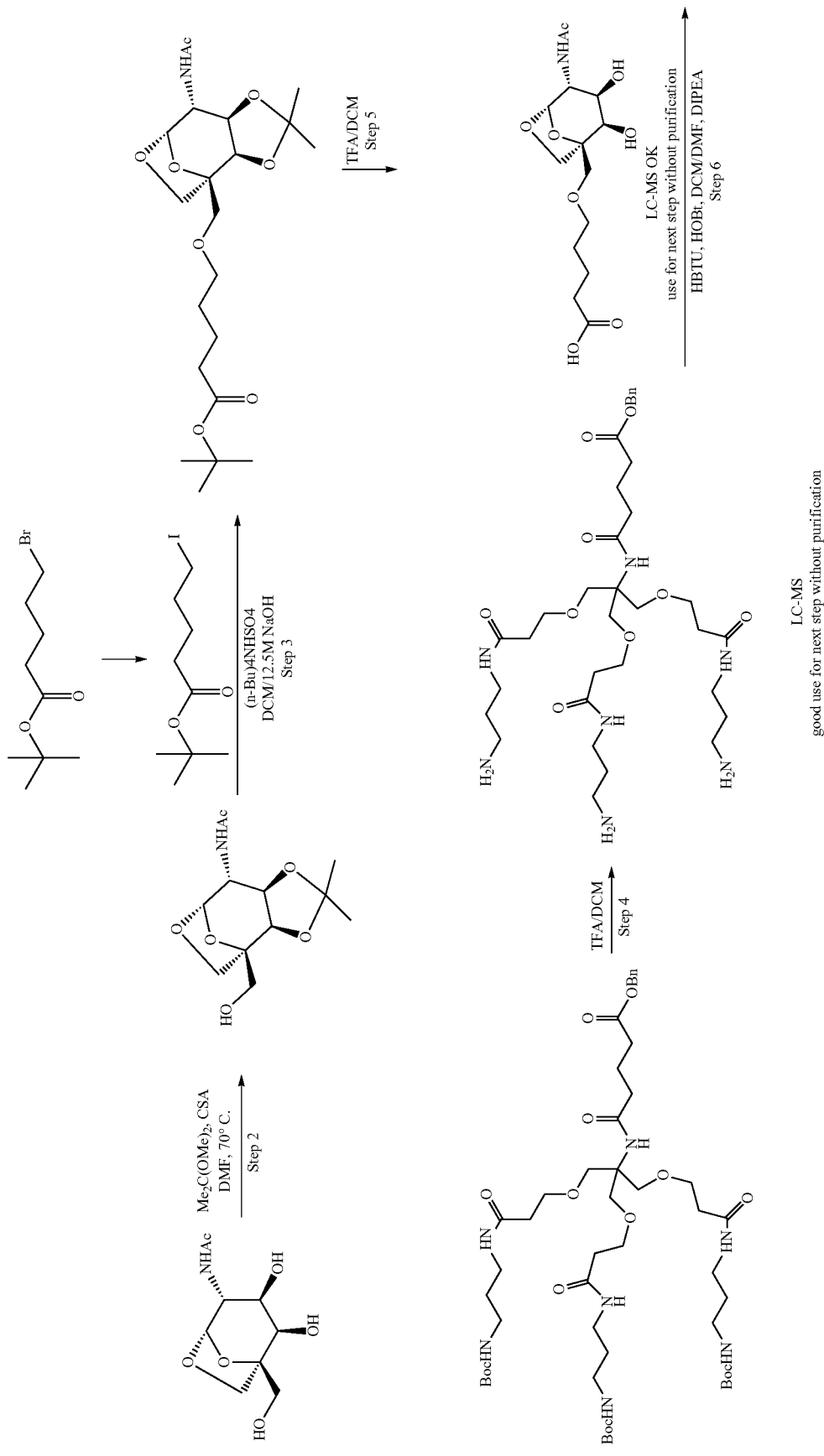

-continued
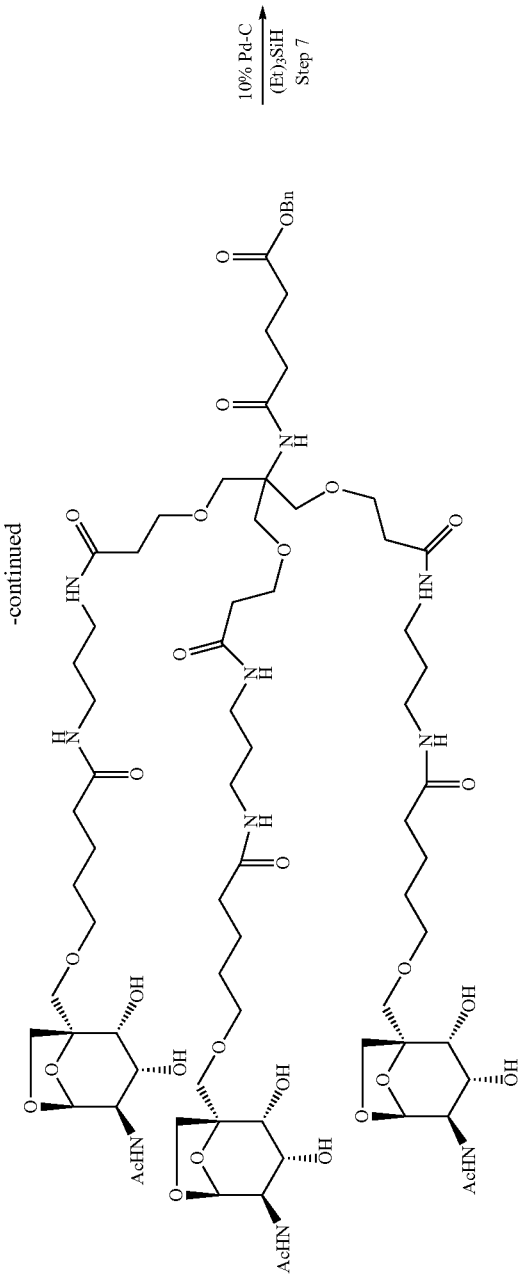
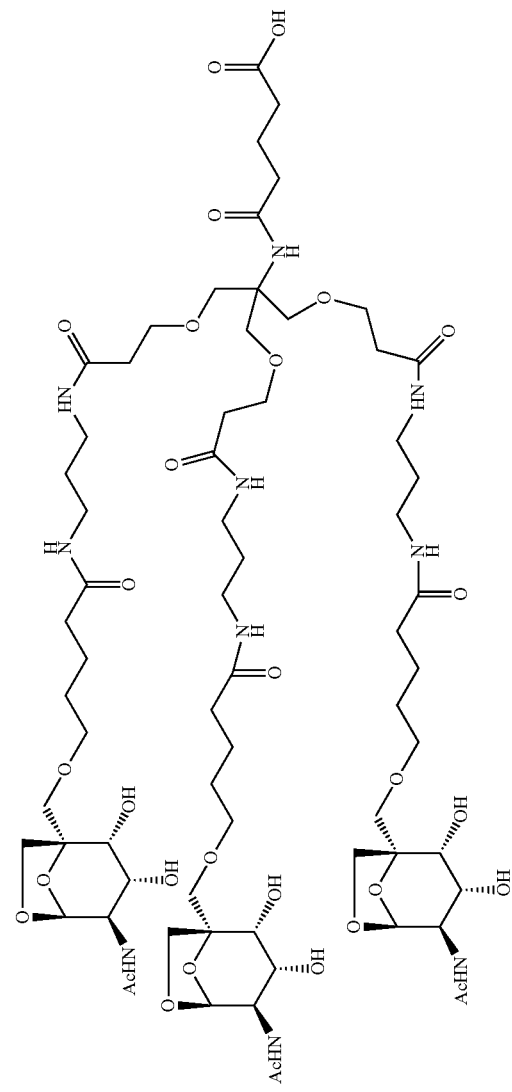
10% Pd-C
(Et)₃SiH
Step 7

Step 1: To a solution of tert-butyl 5-bromopentanoate (4.0 g, 16.87 mmol) in acetone (80 mL) was added NaI (7.59 g, 50.6 mmol). The reaction mixture was stirred at 57° C. for 2 hrs, filtered, and washed with EtOAc. Solvent was evaporated under reduced pressure to give a residue, which was dissolved in EtOAc, washed with water, brine, dried over $Na_2SO_4$, concentrated to give a residue, which was purified by ISCO (40 g column) eluting with 20% EtOAc in hexane to 50% EtOAc in hexane to give tert-butyl 5-iodopentanoate (4.54 g, 15.98 mmol, 95% yield) as a yellow oil. $^1$H NMR (500 MHz, Chloroform-d) δ 3.19 (t, J=6.9 Hz, 2H), 2.24 (t, J=7.3 Hz, 2H), 1.86 (p, J=7.1 Hz, 2H), 1.70 (p, J=7.4 Hz, 2H), 1.45 (s, 9H).

Step 2: To a solution of N-((1S,2R,3R,4R,5S)-2,3-dihydroxy-1-(hydroxymethyl)-6,8-dioxabicyclo[3.2.1]octan-4-yl)acetamide (600 mg, 2.57 mmol) in DMF (15 mL) was added 2,2-dimethoxypropane (2087 μl, 17.03 mmol) followed by (+/−)-camphor-10-sulphonic acid (264 mg, 1.135 mmol). The reaction mixture was stirred at 70° C. for 24 hrs. The reaction mixture was cooled down to room temperature, and then methanol (2.5 mL) was added. The reaction mixture was stirred at room temperature for 30 minutes and neutralized with TEA (0.10 mL). The solvent was evaporated and the residue was coevaporated with toluene. The residue was purified by ISCO (24 g gold) eluting with EtOAc to 10% MeOH in EtOAc to give N-((3aR,4S,7S,8R,8aR)-4-(hydroxymethyl)-2,2-dimethylhexahydro-4,7-epoxy[1,3]dioxolo[4,5-d]oxepin-8-yl)acetamide (666 mg, 2.437 mmol, 95% yield). $^1$H NMR (500 MHz, DMSO-d6) δ 8.09 (d, J=8.1 Hz, 1H), 5.15-5.05 (m, 2H), 4.26 (d, J=5.8 Hz, 1H), 4.09 (dd, J=7.3, 5.8 Hz, 1H), 3.80-3.60 (m, 5H), 1.83 (s, 3H), 1.37 (s, 3H), 1.26 (s, 3H); MS, 274.3 (M+H)$^+$.

Step 3: To a solution of tert-butyl 5-iodopentanoate (1310 mg, 4.61 mmol) and N-43aR,4S,7S,8R,8aR)-4-(hydroxymethyl)-2,2-dimethylhexahydro-4,7-epoxy[1,3]dioxolo[4,5-d]oxepin-8-yl)acetamide 7 (420 mg, 1.537 mmol) in DCM (10.5 mL) was added tetrabutylammonium hydrogensulfate (783 mg, 2.305 mmol) followed by 12.5 M sodium hydroxide solution (7 mL). The reaction mixture was stirred at room temperature for 24 hrs. The reaction mixture was diluted with DCM and water, extracted with DCM (2×). The organic layer was washed with 1 N HCl solution, and dried over sodium sulfate. Solvent was concentrated under reduce pressure to give a residue. The resulting crude material was added ethyl acetate (30 mL) and sonicated for 5 minutes. The result precipitate was filtered, washed with ethyl acetate (10 mL×2). LC-MS showed the filter does not contain desired product and was tetrabutylammonium salt. The filtrate was concentrated under reduced pressure to give a residue, which was purified by ISCO (40 g silica gel gold cartridge) eluting with 50% EtOAc in hexane to EtOAc to give tert-butyl 5-(((3 aR,4 S,7 S,8R,8aR)-8-acetamido-2,2-dimethylhexahydro-4,7-epoxy[1,3]dioxolo[4,5-d]oxepin-4-yl)methoxy)pentanoate (0.470 g, 1.094 mmol, 71.2% yield) as a yellowish oil. $^1$H NMR (500 MHz, Chloroform-d) δ 5.56 (d, J=9.1 Hz, 1H), 4.21 (d, J=5.9 Hz, 1H), 4.12 (dtd, J=7.7, 3.8, 1.7 Hz, 1H), 3.99 (t, J=6.3 Hz, 1H), 3.90 (d, J=9.5 Hz, 1H), 3.77 (d, J=2.0 Hz, 2H), 3.67 (d, J=9.5 Hz, 1H), 3.52 (ddt, J=30.5, 9.2, 5.8 Hz, 2H), 2.23 (t, J=7.1 Hz, 2H), 2.03 (d, J=14.5 Hz, 3H), 1.65-1.55 (m, 7H), 1.44 (s, 9H), 1.35 (s, 3H); MS, 452.4 (M+Na)$^+$.

Step 4: To a solution of benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazahenicosan-21-oate (0.168 g, 0.166 mmol) in DCM (3 mL) was added TFA (3 mL). The reaction mixture was stirred at room temperature for 3 hrs. LC-MS showed the reaction was completed. Solvent was evaporated under reduced pressure to give benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate as a colorless oil. MS, 710.5 (M+H)+. Directly use for next step without purification.

Step 5: To a solution of tert-butyl 5-(((3aR,4S,7S,8R,8aR)-8-acetamido-2,2-dimethylhexahydro-4,7-epoxy[1,3]dioxolo[4,5-d]oxepin-4-yl)methoxy)pentanoate (285 mg, 0.664 mmol) in DCM (5 mL) was added TFA (5 mL) was stirred at room temperature for 4 hrs. LC-MS showed the reaction was complete. Solvent was evaporated to give 5-(((1S,2R,3R,4R,5S)-4-acetamido-2,3-dihydroxy-6,8-dioxabicyclo[3.2.1]octan-1-yl)methoxy)pentanoic acid. MS (ESI): 334.3 (M+H)+. Directly use for next step without purification.

Step 6: To a solution of 5-(((1S,2R,3R,4R,5S)-4-acetamido-2,3-dihydroxy-6,8-dioxabicyclo[3.2.1]octan-1-yl)methoxy)pentanoic acid (221 mg, 0.664 mmol) in DCM (10 mL) was added DIPEA (2313 μl, 13.28 mmol), HBTU (208 mg, 0.548 mmol), HOBT (67.3 mg, 0.498 mmol), a solution of benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate (118 mg, 0.166 mmol) (GL08-02) in DMF (3.0 mL) and DCM (5.0 mL). The reaction mixture was stirred at room temperature for overnight. LC-MS showed the desired product. Solvent was evaporated under reduced pressure to give a residue, which was purified by ISCO (24 g gold cartridge) eluting with DCM to 80% MeOH in DCM to give benzyl 18,18-bis(17-((1S,2R,3R,4R,5 S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5 S)-4-acetamido-2,3-dihydroxy-6,8-dioxabicyclo[3.2.1]octan-1-yl)-7,13,20-trioxo-2,16-dioxa-8,12,19-triazatetracosan-24-oate (272 mg, 0.164 mmol, 99% yield) (product @ tube 30 to 42 (40% MeOH in DCM to 60% MeOH in DCM)). $^1$H NMR (500 MHz, DMSO-d6) δ 7.89 (d, J=7.8 Hz, 3H), 7.81 (t, J=5.7 Hz, 3H), 7.75 (s, 3H), 7.34 (q, J=7.5, 6.9 Hz, 5H), 7.05 (s, 1H), 5.07 (s, 5H), 4.83 (d, J=5.3 Hz, 3H), 4.56 (d, J=7.1 Hz, 3H), 3.73 (dd, J=23.3, 9.2 Hz, 6H), 3.64 (d, J=7.0 Hz, 6H), 3.58-3.35 (m, 27H), 3.02 (p, J=6.2 Hz, 12H), 2.33 (t, J=7.6 Hz, 2H), 2.26 (t, J=6.4 Hz, 6H), 2.10 (t, J=7.6 Hz, 2H), 2.04 (t, J=7.4 Hz, 6H), 1.82 (s, 9H), 1.72 (q, J=7.6 Hz, 2H), 1.52-1.39 (m, 18H); MS (ESI), 1656.3 (M+H)$^+$.

Step 7: To a solution of benzyl 18,18-bis(17-((1S,2R,3R,4R,5S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5 S)-4-acetamido-2,3-dihydroxy-6,8-dioxabicyclo[3.2.1]octan-1-yl)-7,13,20-trioxo-2,16-dioxa-8,12,19-triazatetracosan-24-oate (270 mg, 0.163 mmol) in EtOAc (10 mL) was added 10% Pd—C (50 mg), and MeOH (5.0 mL), and triethylsilane (1042 μl, 6.52 mmol). The reaction mixture was stirred at room temperature for 1 hr, filtered, and concentrated to give 18,18-bis(17-((1S,2R,3R,4R,5S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5 S)-4-acetamido-2,3-dihydroxy-6,8-dioxabicyclo[3.2.1]octan-1-yl)-7,13,20-trioxo-2,16-dioxa-8,12,19-triazatetracosan-24-oic acid (246 mg, 0.157 mmol, 96% yield) as a white solid. $^1$H NMR (500 MHz, DMSO-d6) δ 11.99 (brs, 1H), 7.89 (d, J=7.9 Hz, 3H), 7.82 (t, J=5.4 Hz, 3H), 7.75 (t, J=5.7 Hz, 3H), 7.03 (s, 1H), 5.07 (d, J=1.6 Hz, 3H), 4.83 (brs, 3H), 4.56 (brs, 3H), 3.79-3.68 (m, 6H), 3.64 (d, J=7.2 Hz, 6H), 3.58-3.34 (m, 27H), 3.02 (p, J=6.3 Hz, 12H), 2.27 (t, J=6.4 Hz, 6H), 2.17 (t, J=7.5 Hz, 2H), 2.08 (t, J=7.5 Hz, 2H), 2.04 (t, J=7.3 Hz, 6H), 1.82 (s, 9H), 1.65 (p, J=7.5 Hz, 2H), 1.54-1.40 (m, 18H); MS(ESI), 1566.3 (M+H)+.

Example 4B

Synthesis of 18,18-bis(17-((1S,2R,3R,4R,5 S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5 S)-4-acetamido-2,3-dihydroxy-6,8-dioxabicyclo[3.2.1]octan-1-yl)-7,13,20-trioxo-2,16-dioxa-8,12,19-triazahentriacontan-31-oic acid

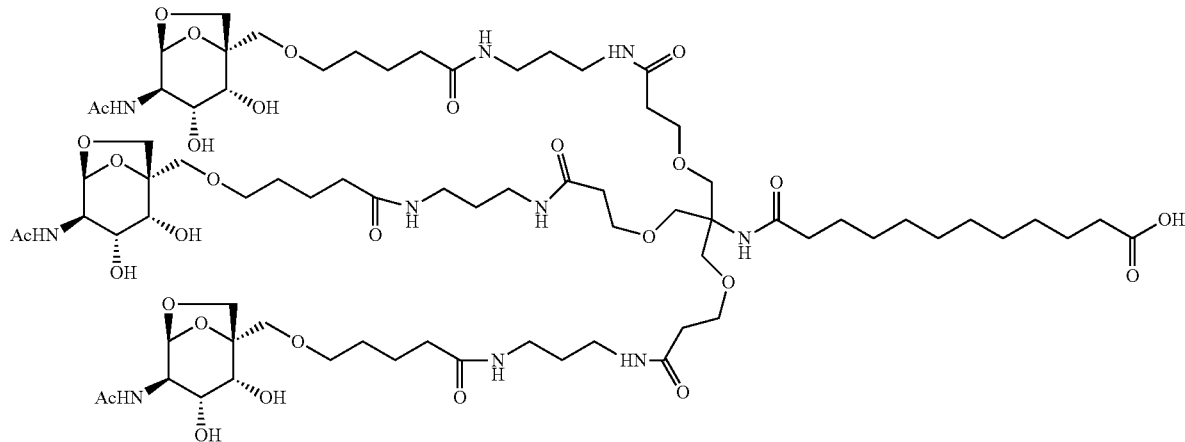 [SMILES: CC(=O)N[C@H]1[C@H]2OC[C@](COCCCCC(=O)NCCCNC(=O)CCOCC(COCCC(=O)NCCCNC(=O)CCCCOC[C@@]34CO[C@@H](O3)[C@H](NC(C)=O)[C@@H](O)[C@H]4O)(COCCC(=O)NCCCNC(=O)CCCCOC[C@@]34CO[C@@H](O3)[C@H](NC(C)=O)[C@@H](O)[C@H]4O)NC(=O)CCCCCCCCCCC(=O)O)(O2)[C@H](O)[C@@H]1O]

18,18-bis(17-((1S,2R,3R,4R,5 S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5 S)-4-acetamido-2,3-dihydroxy-6,8-dioxabicyclo[3.2.1]octan-1-yl)-7,13,20-trioxo-2,16-dioxa-8,12,19-triazahentriacontan-31-oic acid was synthesized using the same procedure as 18,18-bis(17-((1S,2R,3R,4R,5 S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5 S)-4-acetamido-2,3-dihydroxy-6,8-dioxabicyclo[3.2.1]octan-1-yl)-7,13,20-trioxo-2,16-dioxa-8,12,19-triazatetracosan-24-oic acid. $^1$H NMR (400 MHz, DMSO-d6) δ 7.90 (d, J=7.8 Hz, 3H), 7.83 (t, J=5.7 Hz, 3H), 7.76 (t, J=5.7 Hz, 3H), 6.98 (d, J=6.2 Hz, 1H), 5.09 (s, 3H), 3.81-3.69 (m, 6H), 3.69-3.62 (m, 6H), 3.62-3.40 (m, 24H), 3.04 (p, J=6.1 Hz, 9H), 2.28 (t, J=6.4 Hz, 4H), 2.18 (t, J=7.3 Hz, 2H), 2.06 (t, J=7.7 Hz, 6H), 1.84 (s, 6H), 1.48 (tq, J=14.9, 7.4 Hz, 16H), 1.23 (s, 8H). MS(ESI), 1664.0 (M+H)+.

Example 5. Example Compounds for Incorporating Moieties

Synthesis of 5-(4-(4,6-bis((3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropyl)amino)-1,3,5-triazin-2-yl)piperazin-1-yl)-5-oxopentanoic acid

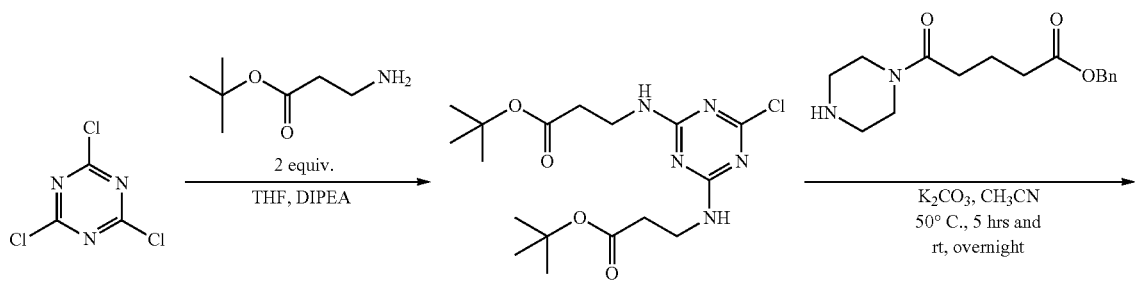

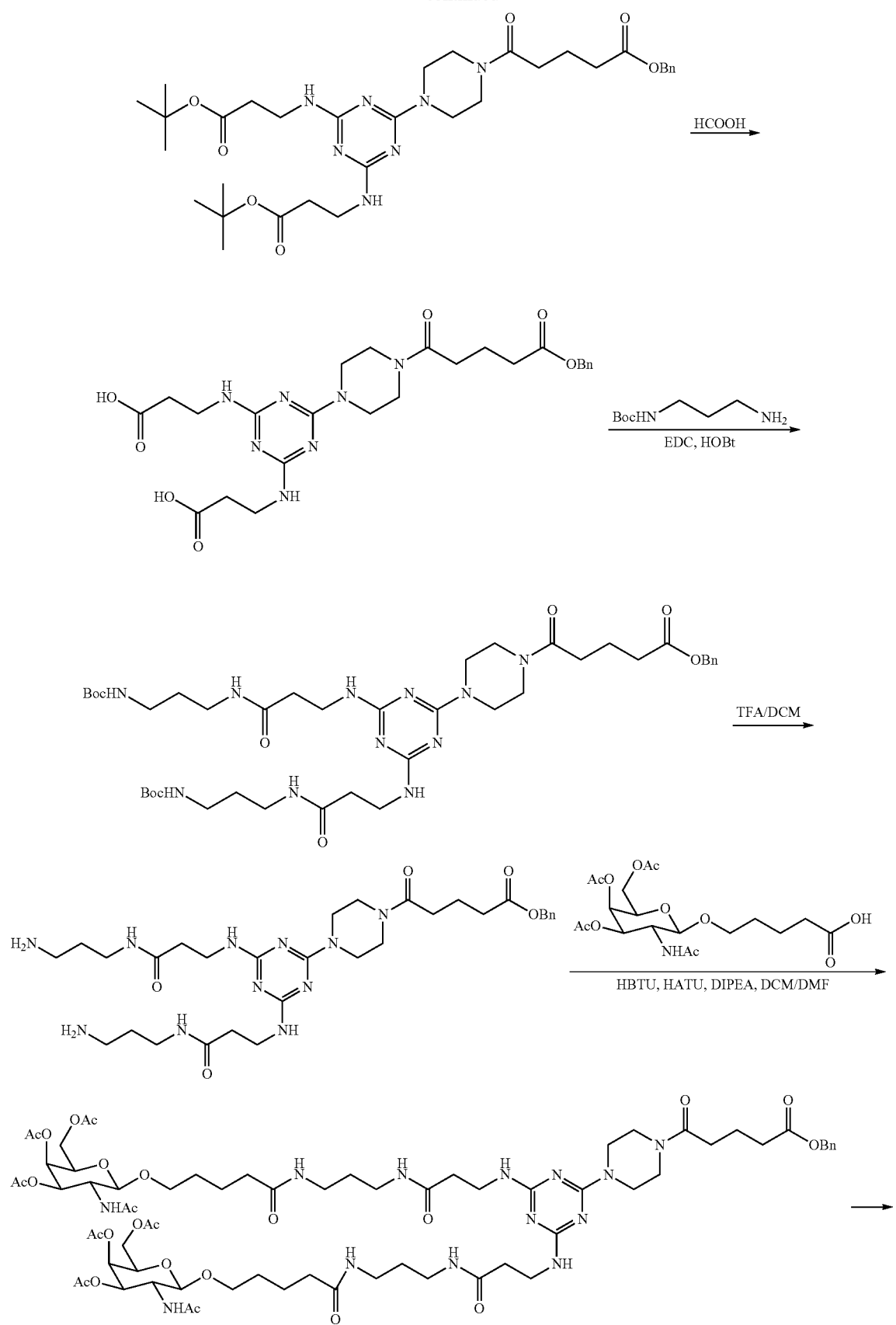

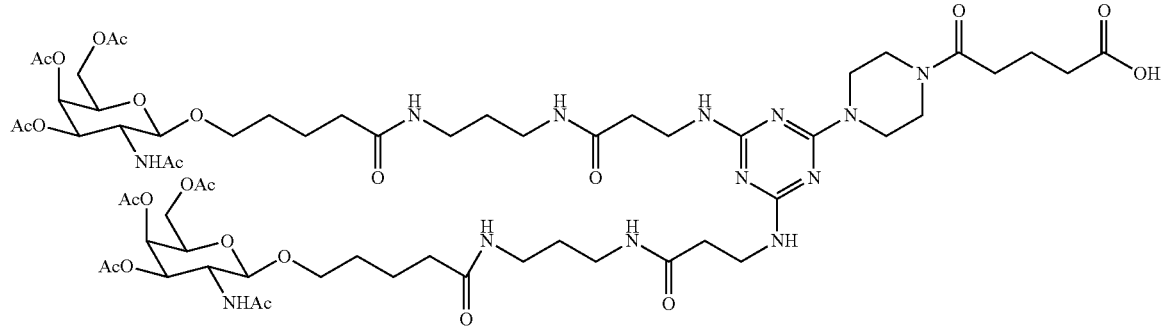

-continued

Steps 1 to 2: To a solid reagent 2,4,6-trichloro-1,3,5-triazine (0.500 g, 2.71 mmol) in THF (30 mL) was added tert-butyl 3-aminopropanoate HCl salt (0.985 g, 5.42 mmol) and DIPEA (2.36 ml, 13.56 mmol). The reaction mixture was stirred at room temperature for 5 hrs. LC-MS showed the desired product; MS(ESI): 402.4 (M+H)⁺. Solvent was evaporated under reduced pressure to give a residue, which was directly used for next step. To a solution of di-tert-butyl 3,3'-((6-chloro-1,3,5-triazine-2,4-diyl)bis(azanediyl))dipropionate (1.052 g, 2.71 mmol) in acetonitrile (50 mL) was added benzyl 5-oxo-5-(piperazin-1-yl)pentanoate (1.103 g, 3.80 mmol) and K2CO3 (2.248 g, 16.27 mmol). The reaction mixture was stirred at room temperature for overnight and at 50° C. Diluted with EtOAc, filtered and concentrated under reduced pressure to give a residue, which was purified by ISCO (40 g gold) eluting with 20% EtOAc in hexane to 50% EtOAc in hexane to give di-tert-butyl 3,3'-((6-(4-(5-(benzyloxy)-5-oxopentanoyl)piperazin-1-yl)-1,3,5-triazine-2,4-diyl)bis(azanediyl))dipropionate (1.13 g, 64%) as a white solid. ¹H NMR (400 MHz, Chloroform-d) δ 7.43-7.30 (m, 5H), 5.15 (s, 2H), 3.75 (brs, 4H), 3.63 (brs, 6H), 3.43 (brs, 2H), 2.51 (q, J=7.0, 6.5 Hz, 6H), 2.42 (t, J=7.4 Hz, 2H), 2.09-1.96 (m, 2H), 1.48 (s, 18H); MS (ESI): 656.6 (M+H)⁺.

Step 3: A solution of di-tert-butyl 3,3'-((6-(4-(5-(benzyloxy)-5-oxopentanoyl)piperazin-1-yl)-1,3,5-triazine-2,4-diyl)bis(azanediyl))dipropionate (1.10 g, 1.68 mmol) in formic acid (20 mL) was stirred at room temperature for overnight. LC-MS showed the reaction was not completed and solvent was evaporated. Formic acid (20 mL) was added to the reaction mixture and the reaction mixture was stirred at room temperature for 5 hrs. LC-MS showed the reaction was complete. Solvent was concentrated, co-evaporated with toluene (2×) and dried under vacuum for overnight to give 3,3'-((6-(4-(5-(benzyloxy)-5-oxopentanoyl)piperazin-1-yl)-1,3,5-triazine-2,4-diyl)bis(azanediyl))dipropionic acid (0.91 g, 100% yield) as a white solid. MS (ESI), 544.2 (M+H)⁺.

Step 4: A solution of 3,3'-46-(4-(5-(benzyloxy)-5-oxopentanoyl)piperazin-1-yl)-1,3,5-triazine-2,4-diyl)bis(azanediyl))dipropionic acid (0.91 g, 1.68 mmol) and HOBt (0.76 g, 4.36 mmol) in DCM (30 mL) and DMF (3 mL) at 0° C. was added tert-butyl (3-aminopropyl)carbamate (0.840 g, 4.36 mmol), EDC HCl salt (0.836 g, 4.36 mmol) and DIPEA (1.460 ml, 8.39 mmol). The reaction mixture was stirred at 0° C. for 15 minutes and at room temperature for 20 hrs. Solvent was evaporated to give a residue, which was dissolved in EtOAc (300 mL), washed with water (1×), saturated sodium bicarbonate (2×), 10% citric acid (2×) and water, dried over sodium sulfate, and concentrated to give a residue which was purified by ISCO (80 g gold cartridge) eluting with DCM to 30% MeOH in DCM to give benzyl 5-(4-(4,6-bis((3-((tert-butoxycarbonyl)amino)propyl)amino)-3-oxopropyl)amino)-1,3,5-triazin-2-yl)piperazin-1-yl)-5-oxopentanoate (1.11 g, 77% yield) as a white solid. MS (ESI): 857.5 (M+H)⁺.

Step 5: A solution of benzyl 5-(4-(4,6-bis((3-((3-((tert-butoxycarbonyl)amino)propyl)amino)-3-oxopropyl)amino)-1,3,5-triazin-2-yl)piperazin-1-yl)-5-oxopentanoate (212.3 mg, 0.250 mmol) in DCM (5.0 mL) was added TFA (3.0 mL). The reaction mixture was stirred at room temperature for 3 hrs. Solvent was evaporated under reduced pressure, use directly for next step without purification. MS (ESI): 656.3 (M+H)⁺.

Step 6: To a solution of 5-(((2R,3R,4R,5R,6R)-3-acetamido-4,5-diacetoxy-6-(acetoxymethyl)tetrahydro-2H-pyran-2-yl)oxy)pentanoic acid (333 mg, 0.740 mmol) in DCM (5 mL) was added DIPEA (2.16 ml, 12.4 mmol), HBTU (235 mg, 0.620 mmol), HOBT (67 mg, 0.50 mmol), a solution of benzyl 5-(4-(4,6-bis((3-((3-aminopropyl)amino)-3-oxopropyl)amino)-1,3,5-triazin-2-yl)piperazin-1-yl)-5-oxopentanoate (163 mg, 0.250 mmol) in DCM (3.0 mL). The reaction mixture was stirred at room temperature for 3 hrs. LC-MS showed the desired product. Solvent was evaporated under reduced pressure to give a residue, which was purified by ISCO (24 g gold cartridge) eluting with DCM to 50% MeOH in DCM to give (2R,2'R,3R,3'R,4R,4'R,5R,5'R,6R,6'R)-((((((3,3'-((6-(4-(5-(benzyloxy)-5-oxopentanoyl) piperazin-1-yl)-1,3,5-triazine-2,4-diyl)bis (azanediyl))bis (propanoyl))bis(azanediyl))bis(propane-3,1-diyl))bis(azanediyl))bis(5-oxopentane-5,1-diyl))bis(oxy)) bis(5-acetamido-2-(acetoxymethyl) tetrahydro-2H-pyran-6,3,4-triyl) tetraacetate (460 mg) containing some HOBt. MS (ESI), 1515.7 (M+H)⁺.

Step 7: To a solution of (2R,2'R,3R,3'R,4R,4'R,5R,5'R,6R,6'R)-((((((3,3'-((6-(4-(5-(benzyloxy)-5-oxopentanoyl) piperazin-1-yl)-1,3,5-triazine-2,4-diyl)bis(azanediyl))bis (propanoyl))bis(azanediyl))bis(propane-3,1-diyl))bis (azanediyl))bis(5-oxopentane-5,1-diyl))bis(oxy))bis(5-acetamido-2-(acetoxymethyl)tetrahydro-2H-pyran-6,3,4-triyl) tetraacetate (0.44 g, 0.290 mmol) in EtOAc (20 mL) was added 10% Pd—C(40 mg) followed by 2.0 mL MeOH under Ar. Triethylsilane (2.784 ml, 17.43 mmol) was added to the reaction mixture slowly. The reaction mixture was stirred at room temperature for 2 hrs, filtered through celite, washed with 50% MeOH in EtOAc. Solvents were evaporated under reduced pressure to give 5-(4-(4,6-bis((3-((3-(5-(((2R,3R,4R,5R,6R)-3-acetamido-4,5-diacetoxy-6-(acetoxymethyl) tetrahydro-2H-pyran-2-yl)oxy)pentanamido)propyl)amino)-3-oxopropyl)amino)-1,3,5-triazin-2-yl)piperazin-1-yl)-5-oxopentanoic acid (0.43 g, 100% yield) a white solid. MS (ESI): 1425.0 (M+H)⁺.

Example 6. Example Compounds for Incorporating Moieties
Synthesis of 5-(4-(4,6-bis((3-((3-(5-((((1S,2R,3R,4R,5S)-4-acetamido-2,3-dihydroxy-6,8-dioxabicyclo[3.2.1]octan-1-yl)methoxy)pentanamido)propyl)amino)-3-oxopropyl)amino)-1,3,5-triazin-2-yl)piperazin-1-yl)-5-oxopentanoic acid
5
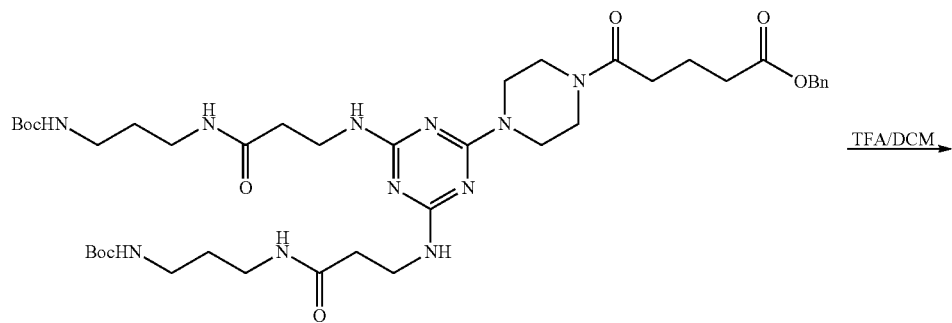
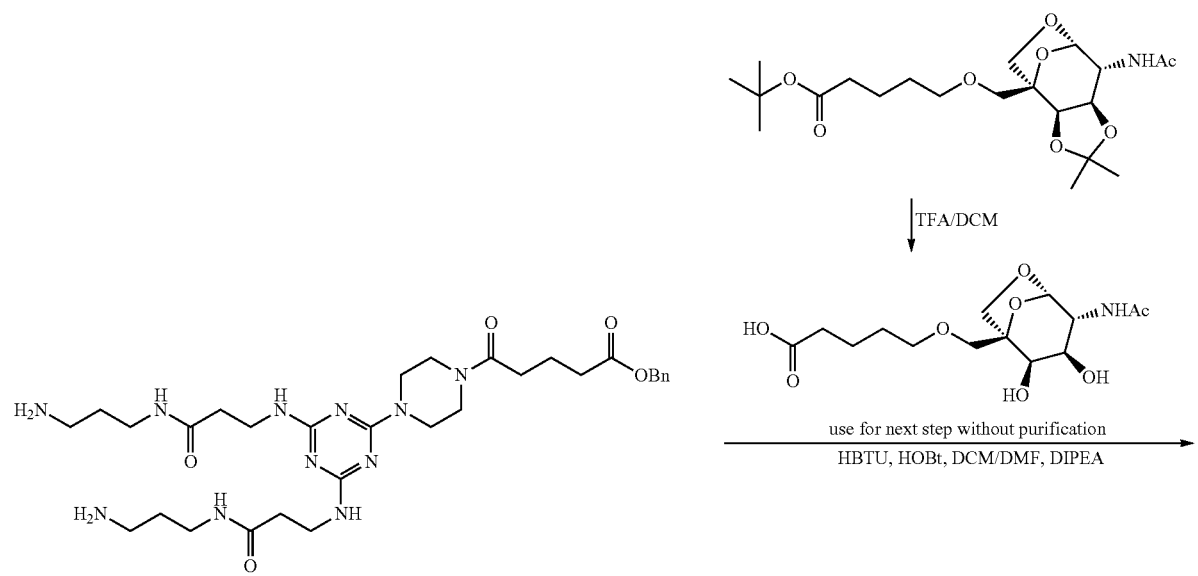
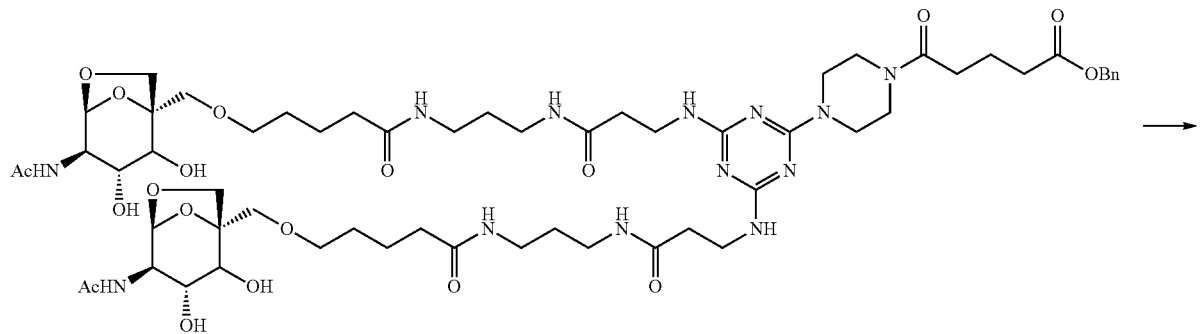

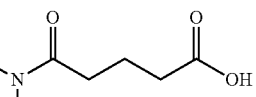
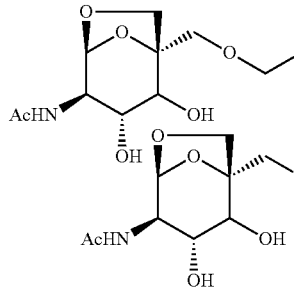

Step 1: A solution of benzyl 5-(4-(4,6-bis((3-((3-((tert-butoxycarbonyl)amino)propyl)amino)-3-oxopropyl)amino)-1,3,5-triazin-2-yl)piperazin-1-yl)-5-oxopentanoate (212.3 mg, 0.250 mmol) in DCM (5.0 mL) was added TFA (3.0 mL). The reaction mixture was stirred at room temperature for 3 hrs. Solvent was evaporated under reduced pressure, use directly for next step without purification. MS (ESI): 656.3 (M+H)$^+$.

Step 2: To a solution of tert-butyl 5-(((3aR,4S,7S,8R,8aR)-8-acetamido-2,2-dimethylhexahydro-4,7-epoxy[1,3]dioxolo[4,5-d]oxepin-4-yl)methoxy)pentanoate (373 mg, 0.870 mmol) in DCM (5 mL) was added TFA (5 mL) was stirred at room temperature for 4 hrs. LC-MS showed the reaction was complete. Solvent was evaporated to give 5-(((1S,2R,3R,4R,5S)-4-acetamido-2,3-dihydroxy-6,8-dioxabicyclo[3.2.1]octan-1-yl)methoxy)pentanoic acid. MS (ESI): 334.3 (M+H)+. Directly use for next step without purification.

Step 3: To a solution of 55-(((1S,2R,3R,4R,5S)-4-acetamido-2,3-dihydroxy-6,8-dioxabicyclo[3.2.1]octan-1-yl)methoxy)pentanoic acid (289 mg, 0.870 mmol) in DCM (5 mL) was added DIPEA (2.16 ml, 12.4 mmol), HBTU (330 mg, 0.870 mmol), HOBT (67 mg, 0.50 mmol), a solution of benzyl 5-(4-(4,6-bis((3-((3-aminopropyl)amino)-3-oxopropyl)amino)-1,3,5-triazin-2-yl)piperazin-1-yl)-5-oxopentanoate (163 mg, 0.250 mmol) in DCM (3.0 mL). The reaction mixture was stirred at room temperature for 3 hrs. LC-MS showed the desired product. Solvent was evaporated under reduced pressure to give a residue, which was purified by ISCO (24 g gold cartridge) eluting with DCM to 50% MeOH in DCM to give benzyl 5-(4-(4,6-bis((3-((3-(5-(((1S,2R,3R,4R,5S)-4-acetamido-2,3-dihydroxy-6,8-dioxabicyclo[3.2.1]octan-1-yl)methoxy)pentanamido)propyl)amino)-3-oxopropyl)amino)-1,3,5-triazin-2-yl)piperazin-1-yl)-5-oxopentanoate (227 mg, 71%). MS (ESI), 1287.0 (M+H)$^+$.

Step 4: To a solution of benzyl 5-(4-(4,6-bis((3-((3-(5-(((1S,2R,3R,4R,5S)-4-acetamido-2,3-dihydroxy-6,8-dioxabicyclo[3.2.1]octan-1-yl)methoxy)pentanamido)propyl)amino)-3-oxopropyl)amino)-1,3,5-triazin-2-yl)piperazin-1-yl)-5-oxopentanoate (0.167 g, 0.130 mmol) in EtOAc (10 mL) was added 10% Pd—C(50 mg) followed by 2.0 mL MeOH under Ar. Triethylsilane (1.66 ml, 10.39 mmol) was added to the reaction mixture slowly. The reaction mixture was stirred at room temperature for 2 hrs, filtered through celite, washed with 50% MeOH in EtOAc. Solvents were evaporated under reduced pressure to give 5-(4-(4,6-bis((3-((3-(5-(((1S,2R,3R,4R,5S)-4-acetamido-2,3-dihydroxy-6,8-dioxabicyclo[3.2.1]octan-1-yl)methoxy)pentanamido)propyl)amino)-3-oxopropyl)amino)-1,3,5-triazin-2-yl)piperazin-1-yl)-5-oxopentanoic acid (32 mg, 21% yield) a white solid. MS (ESI): 1196.7 (M+H)$^+$.

Example 7. Example Preparation of Certain Phosphoramidites

In some embodiments, the present disclosure provides monomers (phosphoramidites) and methods thereof for oligonucleotide preparation. In some embodiments, provided phosphoramidites comprise 5'-end structures that provides special and/or greatly improved activities and/or properties. In some embodiments, provided phosphoramidites comprise desired chemical moieties, e.g., carbohydrate moieties, lipid moieties, etc., for incorporation into oligonucleotides. In some embodiments, provided phosphoramidites comprise linkers/handles for incorporation of desired chemical moieties, e.g., carbohydrate moieties, lipid moieties, etc. Many technologies can be utilized to prepare phosphoramidites in accordance with the present disclosure, including but not limited to those described in WO/2010/064146, WO/2011/005761, WO/2013/012758, WO/2014/010250, US2013/0178612, WO/2014/012081, WO/2015/107425, WO/2017/015555, and WO/2017/062862, the methods and reagents of each of which are incorporated herein by reference. Provided below as examples are preparation of certain phosphoramidites.

Example 7-1. Preparation of Thymidine-5'-dimethylvinylphosphonate-2'-deoxy-3'-CNE Phosphoramidite

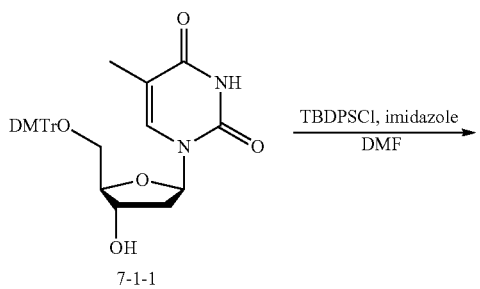

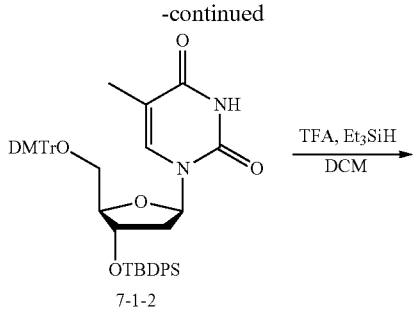

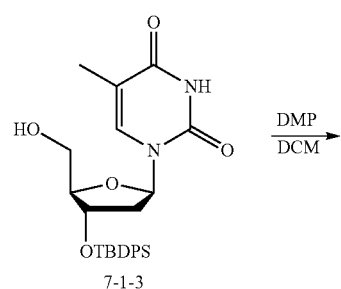

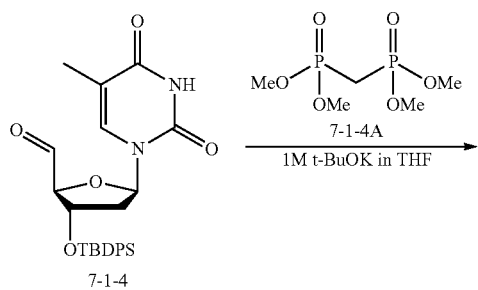

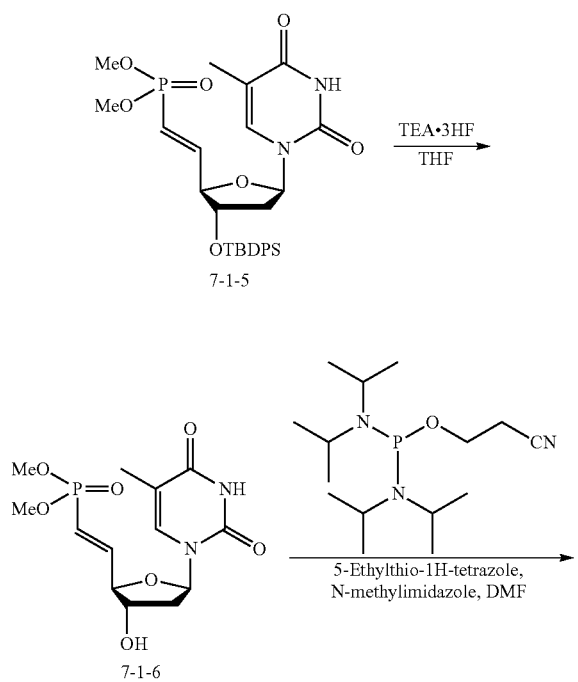

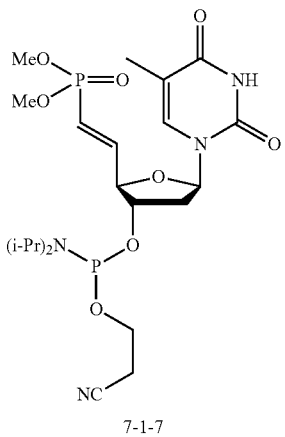

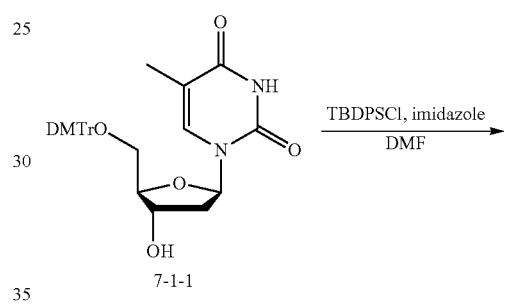

Preparation of Compound 7-1-2.

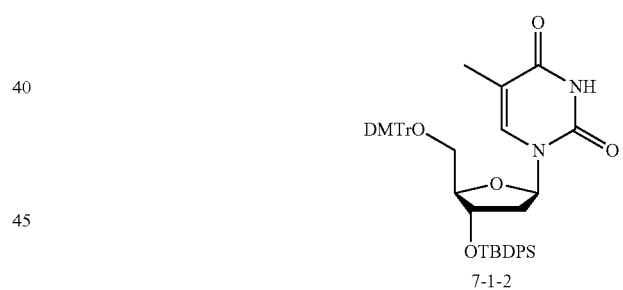

To a solution of compound 7-1-1 (20.00 g, 36.72 mmol, 1.00 eq.) in DMF (100.00 mL) was added imidazole (25.00 g, 367.20 mmol, 10.00 eq.) followed by TBDPSCl (50.47 g, 183.60 mmol, 47.17 mL, 5.00 eq.). The reaction mixture was stirred at 25° C. for 16 h. TLC (Dichloromethane:Methanol=1:1) showed compound 7-1-1 was consumed completely. EtOAc (300 mL) was added and the mixture was washed with water (60 mL*3). The organic phase was dried over $Na_2SO_4$, filtered and concentrated. The residue was purified by column chromatography on silica gel (Petroleum ether:Ethyl acetate=20:1, 1:1, 1:4). Compound 7-1-2 (30.00 g) was obtained as white foamy solid. $^1$H NMR: ($CDCl_3$, 400 MHz) δ=8.165 (s, 1H), 7.575-7.080 (m, 21H), 6.718-6.741 (m, 4H), 6.473 (d, J=2.8 Hz, 1H), 4.520-4.534 (m, 1H), 4.037-4.043 (d, J=2.4 Hz, 1H), 3.758 (s, 6H), 3.184-3.217 (m, 1H), 2.841-2.874 (m, 1H), 2.319-2.338 (m, 1H), 2.025-2.078 (m, 1H), 1.321 (s, 3H), 1.021 (s, 9H).

Preparation of Compound 7-1-3

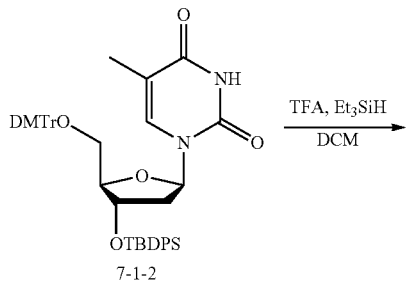
7-1-2

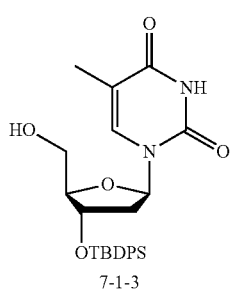
7-1-3

To a solution of compound 7-1-2 (25.00 g, 31.93 mmol, 1.00 eq.) in DCM (250 mL) was added TFA (8.37 g, 73.44 mmol, 5.44 mL, 2.30 eq.). The color of the solution turned to red. Et$_3$SiH (8.17 g, 70.24 mmol, 11.19 mL, 2.20 eq.) was added at 25° C. The reaction mixture was stirred at 25° C. for 2 h and the red solution became colorless. TLC (Petroleum ether:Ethyl acetate=1:1) showed compound 7-1-2 was consumed completely. The solvent was removed under reduced pressure, and the residue was dissolved in EtOAc (100 mL). The organic phase was washed with NaHCO$_3$ (40 mL), brine, dried over Na$_2$SO$_4$, filtered and concentrated. The residue was purified by column chromatography on silica gel (Petroleum ether:Ethyl acetate=20:1, 1:1). Compound 7-1-3 (9.80 g, 56.20% yield, 88% purity) was obtained as white solid. $^1$H NMR: (CDCl$_3$, 400 MHz) δ=8.108 (s, 1H), 7.643 (s, 1H), 7.403-7.412 (m, 6H), 7.269 (d, J=4.8 Hz, 2H), 6.217 (d, J=5.6 Hz, 1H), 4.451 (s, 1H), 3.975 (s, 1H), 3.631 (d, J=12 Hz, 1H), 3.255 (s, 1H), 2.264-2.296 (m, 1H), 2.136-2.184 (m, 1H), 1.957 (s, 1H), 1.859 (s, 3H), 1.090 (s, 9H).

Preparation of Compound 7-1-4

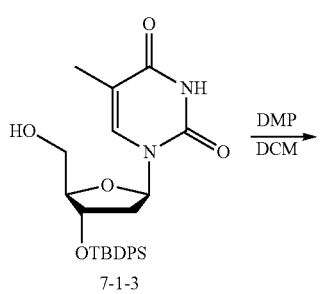
7-1-3

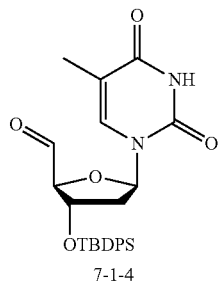
7-1-4

To a solution of compound 7-1-3 (18.00 g, 37.45 mmol, 1.00 eq.) in DCM (500 mL) was added DMP (17.47 g, 41.20 mmol, 12.75 mL, 1.10 eq.) at 0° C. The reaction mixture was stirred at 25° C. for 3 h. TLC (Petroleum ether:Ethyl acetate=1:1) showed the reaction was complete. Na$_2$SO$_3$ (sat., 100 mL) and NaHCO$_3$ (sat.100 mL) was added successively. The mixture was extracted with DCM (100 mL*3). The organic phase was dried over Na$_2$SO$_4$ and concentrated. Compound 7-1-4 (17.92 g, crude) was obtained as yellow oil.

Preparation of Compound 7-1-5

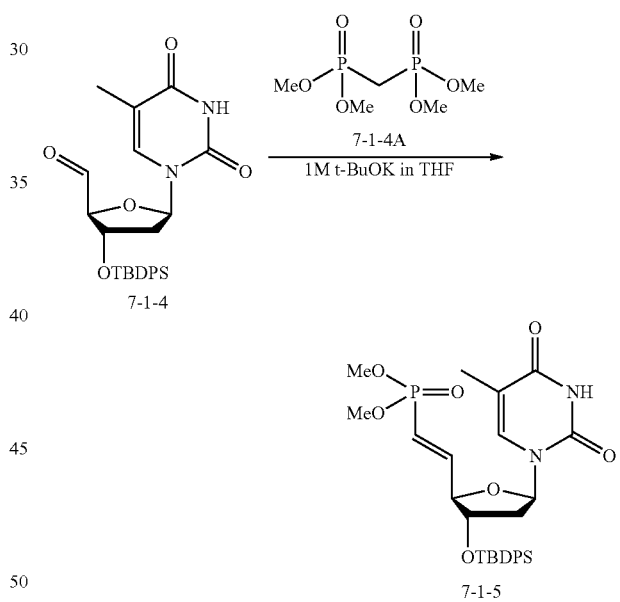

To a solution of compound 7-1-4A (16.08 g, 69.26 mmol, 1.85 eq.) in THF (29 mL) was added t-BuOK (1 M, 69.26 mL, 1.85 eq.) at 0° C. The mixture was stirred at 0° C. for 10 min, then warmed up to 25° C. for 30 min. The above mixture was added to a solution of compound 7-1-4 (17.92 g, 37.44 mmol, 1.00 eq.) in THF (36 mL) at 0° C. The reaction mixture was stirred at 0° C. for 1 h and then allowed to warm up to 25° C. in 80 min. TLC (Dichloromethane:Methanol=20:1) showed the reaction was complete. To the reaction mixture water (200 mL) was added and extracted with EtOAc (300 mL*4). The organic phase was dried (Na$_2$SO$_4$), filtered and concentrated. The residue was purified by column chromatography on silica gel (PE (10% DCM):EA=10:1, 1:8). Compound 7-1-5 (15.00 g) was obtained as yellow solid.

Preparation of Compound 7-1-6

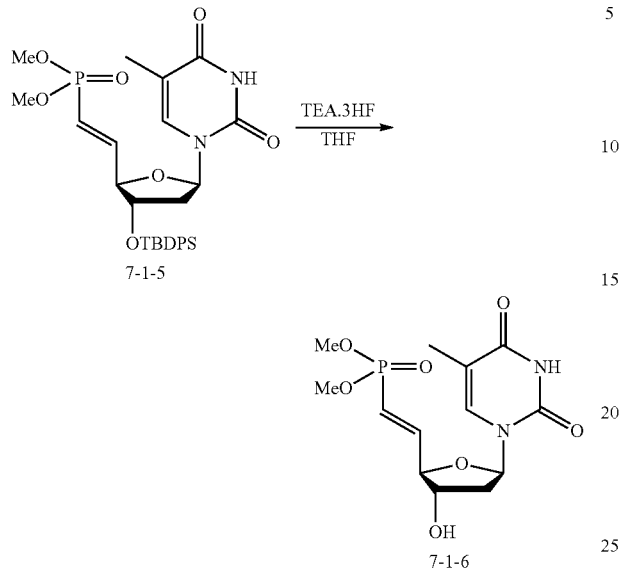

To a solution of compound 7-1-5 (21.00 g, 35.92 mmol, 1.00 eq.) in THF (60 mL) was added N, N-diethylethanamine; trihydrofluoride (28.95 g, 179.59 mmol, 29.24 mL, 5.00 eq.) at 25° C. The reaction mixture was stirred at 25° C. for 20 h. TLC (Dichloromethane:Methanol=10:1) showed the reaction was complete. The reaction mixture was concentrated under reduced pressure and the mixture was neutralized with $Na_2CO_3$ (aq., sat) until pH=7. The water phase was freeze-dried. The freeze-drying solid was washed with DCM:MeOH=10:1(300 mL*2). The organic phase was concentrated. The residue obtained was purified by column chromatography on silica gel (Dichloromethane:Methanol=100:1,100:8). Compound 7-1-6 (5.20 g, 15.02 mmol, 41.81% yield) was obtained as white solid. $^1$H NMR: ($CDCl_3$, 400 MHz) δ=9.521 (s, 1H), 7.120 (s, 1H), 6.974-7.074 (m, 1H), 6.372-6.405 (m, 1H), 5.961-6.050 (m, 1H), 4.684 (s, 1H), 4.504-4.518 (m, 1H), 4.393-4.409 (m, 1H), 3.726-3.775 (m, 6H), 3.151-3.180 (m, 2H), 2.411-2.427 (m, 1H), 1.930-2.218 (m, 1H), 1.927 (s, 3H).

Preparation of Compound 7-1-7

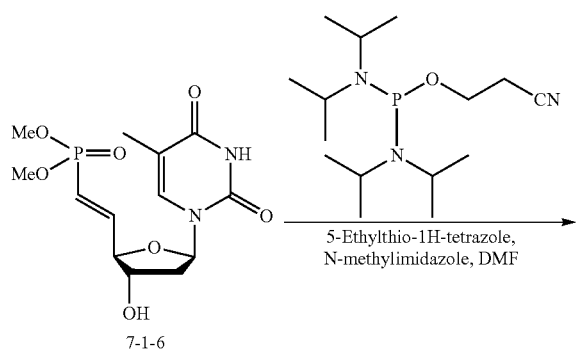

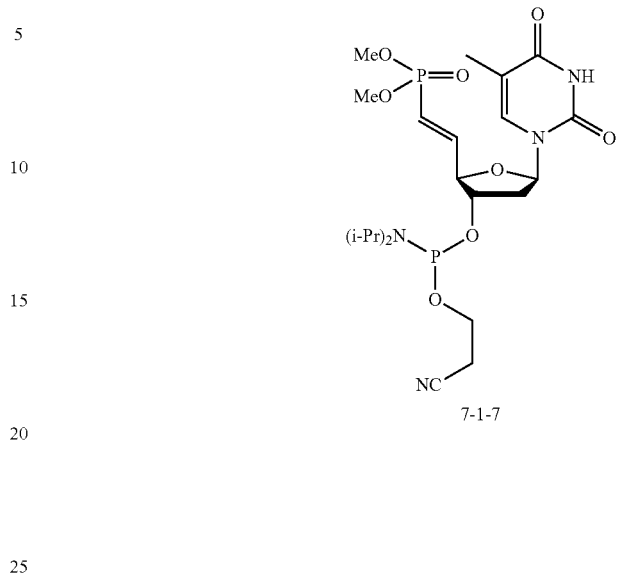

To a solution of compound 7-1-6 (3.80 g, 10.97 mmol, 1.00 eq.) in DMF (23 mL) was added 5-ethylsulfanyl-2H-tetrazole (1.43 g, 10.97 mmol, 1.00 eq.), 1-methylimidazole (1.80 g, 21.94 mmol, 1.75 mL, 2.00 eq.) and 3-bis(diisopropylamino)phosphanyloxypropanenitrile (4.96 g, 16.46 mmol, 5.22 mL, 1.50 eq.). The reaction mixture was stirred at 25° C. under $N_2$ for 3 h. TLC (Dichloromethane:Methanol=10:1) showed the reaction was complete. The reaction mixture was diluted with EtOAc (200 mL). The reaction mixture was washed with aq. saturated. $NaHCO_3$ solution (20 mL*4), dried over $Na_2SO_4$, filtered and concentrated under reduced pressure. The column was eluted with MeOH (20 min), EA (20 min), Petroleum ether (20 min), and Petroleum ether/Ethyl acetate (20 min). The residue thus obtained was purified by silica gel column chromatography (elution with Petroleum ether:EtOAc=10:1, 1:1 and then EtOAc/Acetonitrile=1000:1,100:2,100:4). Compound 7-1-7 (4.80 g, 8.78 mmol, 80.04% yield) was obtained as yellow solid. MS: LCMS, Calculated C22H36N4O8P2, 546.2008; Observed in +Ve mode 568.95; 569.43[M+Na]. $^1$H NMR: ($CDCl_3$, 400 MHz) δ=9.489 (s, 1H), 7.233 (s, 1H), 6.835-7.035 (m, 1H), 6.303-6.337 (m, 1H), 5.931-5.983 (m, 1H), 4.388-4.504 (m, 1H), 3.703-3.846 (m, 1H), 3.666-3.694 (m, 6H), 3.533-3.559 (m, 2H), 2.594-2.702 (m, 2H), 2.162-2.578 (m, 2H), 1.863 (s, 3H), 1.111-1.189 (m, 12H). $^{13}$C NMR (101 MHz, $CDCl_3$) δ 163.66, 162.54, 150.47, 150.40, 148.68, 148.61, 148.41, 148.35, 135.10, 135.01, 118.73, 118.25, 117.76, 117.61, 116.91, 116.85, 116.38, 111.74, 84.83, 84.79, 84.75, 84.72, 84.62, 84.56, 84.53, 84.50, 84.40, 84.33, 77.40, 77.29, 77.09, 76.77, 76.03, 75.87, 75.49, 75.48, 75.34, 75.32, 58.21, 58.19, 58.16, 58.12, 58.00, 57.92, 52.59, 52.55, 52.54, 52.52, 52.49, 52.46, 45.33, 45.27, 43.43, 43.40, 43.30, 43.27, 38.45, 38.40, 38.37, 36.45, 24.62, 24.57, 24.54, 24.49, 24.46, 22.96, 22.94, 22.88, 22.85, 20.47, 20.39, 20.37, 20.30, 20.11, 20.04, 12.50, 12.48. $^{31}$P NMR (162 MHz, $CDCl_3$) δ 149.40, 149.38, 19.99, 19.64, 14.10.

Example 7-2. Stereopure L-DPSE-5'-DMT-5'VP-dT Amidite, 7-2-8

Preparation of L-DPSE-NOPCl

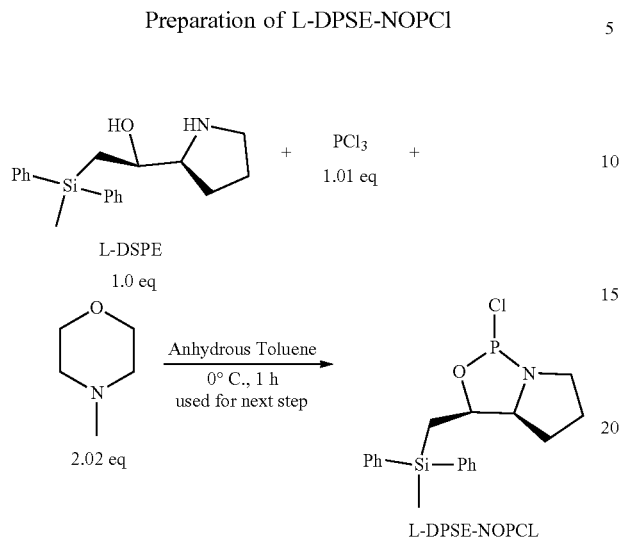

L-DPSE (8.82 g, 28.5 mmol) was dried by azeotropic evaporation with anhydrous toluene (60 ml) at 35° C. in a rotary evaporator and further dried in high vacuum for overnight. A solution of this dried L-DPSE and 4-methyl-morpholine (5.82 g, 6.33 mL, 57.5 mmol) which was dissolved in anhydrous toluene (50 ml) was added to a solution of $PCl_3$ (4.0 g, 2.5 mL, 29.0 mmol) in anhydrous toluene (25 ml) placed in 250 mL three neck round bottomed flask which was cooled at −5° C. under argon (start Temp: −2° C., Max: 5° C. temp, 10 min addition) and the reaction mixture was stirred at 0° C. for another 40 min. After that the precipitated white solid was filtered by vacuum under argon using special filter tube (Chemglass: Medium Frit, Airfree, Schlenk). The solvent was removed by rotary evaporator under argon at bath temperature (25° C.) and the crude oily mixture was obtained and dried under vacuum overnight (~15 h) and used for next step.

Preparation of L-DPSE-5'-DMT-5'VP-dT Amidite

Compound 7-2-6 (7.0 g, 20.2 mmol) was dried two times by co-evaporation with 75 mL of anhydrous toluene at 45° C. and kept at high vacuum for overnight. Then the dried Compound 7-2-6, was dissolved in dry THF (70 mL) in a 250 mL three neck flasks under argon, followed by the addition of triethylamine (14 mL, 101 mmol) and the mixture was cooled to −45° C. To this cooled reaction mixture was added a solution of the crude L-DPSE-NOPCl (28.5 mmol, 1.4 eq, in THF 50 mL) from the previous step via syringe dropwise (~10 min, maintaining the internal temperature −40 to −35° C.). The reaction mixture was then gradually warmed to 5° C. After 30 min at 5° C., TLC and LC-MS analysis indicated the complete conversion of SM to product (total reaction time 2 h). The reaction mixture was cooled in an ice bath, and was quenched by addition of water (0.36 mL, 20.2 mmol) and stirred for 10 min followed by added anhydrous $Mg_2SO_4$ (3.0 g, 20.2 mmol). The reaction was filtered through Airfree, Schlenk filter tube, washed with dry THF (50 mL) and evaporated under rotary evaporation at 28° C. to afford the pale-yellow solid of the crude product, which was dried under high vacuum for overnight. The dried crude product was purified by 120 silica column (which was pre-deactivated with 3 column volume of ethyl acetate with 5% TEA) using ethyl acetate/hexane mixture with 5% TEA as a solvent. After column purification, fractions were analyzed by TLC and LC-MS and pooled together. Solvent was evaporated in a rotary evaporator at 28° C. and the residue was dried under high vacuum to afford the product as a white solid. Yield: 11.8 g (87%). $^1$H NMR (400 MHz, Chloroform-d) δ 7.46 (ddt, J=16.5, 7.6, 2.7 Hz, 4H), 7.33-7.17 (m, 6H), 6.93-6.88 (m, 1H), 6.75 (ddd, J=22.6, 17.2, 4.4 Hz, 1H), 6.16 (dd, J=7.5, 6.3 Hz, 1H), 5.85 (ddd, J=19.2, 17.1, 1.8 Hz, 1H), 4.71 (dt, J=8.7, 5.7 Hz, 1H), 4.38 (dp, J=10.7, 3.6 Hz, 1H), 4.15 (tt, J=5.6, 2.7 Hz, 1H), 3.68 (dd, J=11.1, 3.7 Hz, 6H), 3.55-3.29 (m, 2H), 3.09 (tdd, J=10.8, 8.8, 4.3 Hz, 1H), 2.11 (ddd, J=13.9, 6.3, 3.3 Hz, 1H), 1.96 (s, 1H), 1.87 (d, J=1.2 Hz, 3H), 1.85-1.73 (m, 2H), 1.70-1.49 (m, 2H), 1.38 (ddd, J=15.9, 10.4, 6.3 Hz, 2H), 1.26-1.11 (m, 2H), 0.60 (s, 3H). $^{31}$P NMR (162 MHz, $CDCl_3$) δ 152.41, 19.95. $^{13}$C NMR (101 MHz, $CDCl_3$) δ 171.07, 163.62, 163.59, 150.21, 150.19, 148.49, 148.43, 136.61, 135.84, 135.15, 134.57, 134.33, 129.48, 129.42, 127.97, 127.93, 127.81, 118.38, 116.50, 111.52, 85.02, 84.72, 84.70, 84.51, 84.48, 79.25, 79.16, 77.40, 77.28, 77.08, 76.76, 74.93, 74.91, 74.83, 74.81, 68.01, 67.98, 60.35, 52.60, 52.55, 52.47, 52.42, 47.03, 46.67, 38.12, 38.08, 27.18, 25.85, 25.82, 21.01, 17.58, 17.54, 14.19, 12.58, −3.00, −3.27. MS: LCMS, Calculated C32H41N3O8P2Si, 685.7255: Observed in +Ve mode: 686.21 [M+H], 708.14 [M+Na].
Example 7-3. Synthesis of 5'-DMT-2'OMe-5-Lipid-3'-CNE Phosphoramidite—Incorporation of Desired Moieties Through Nucleobases
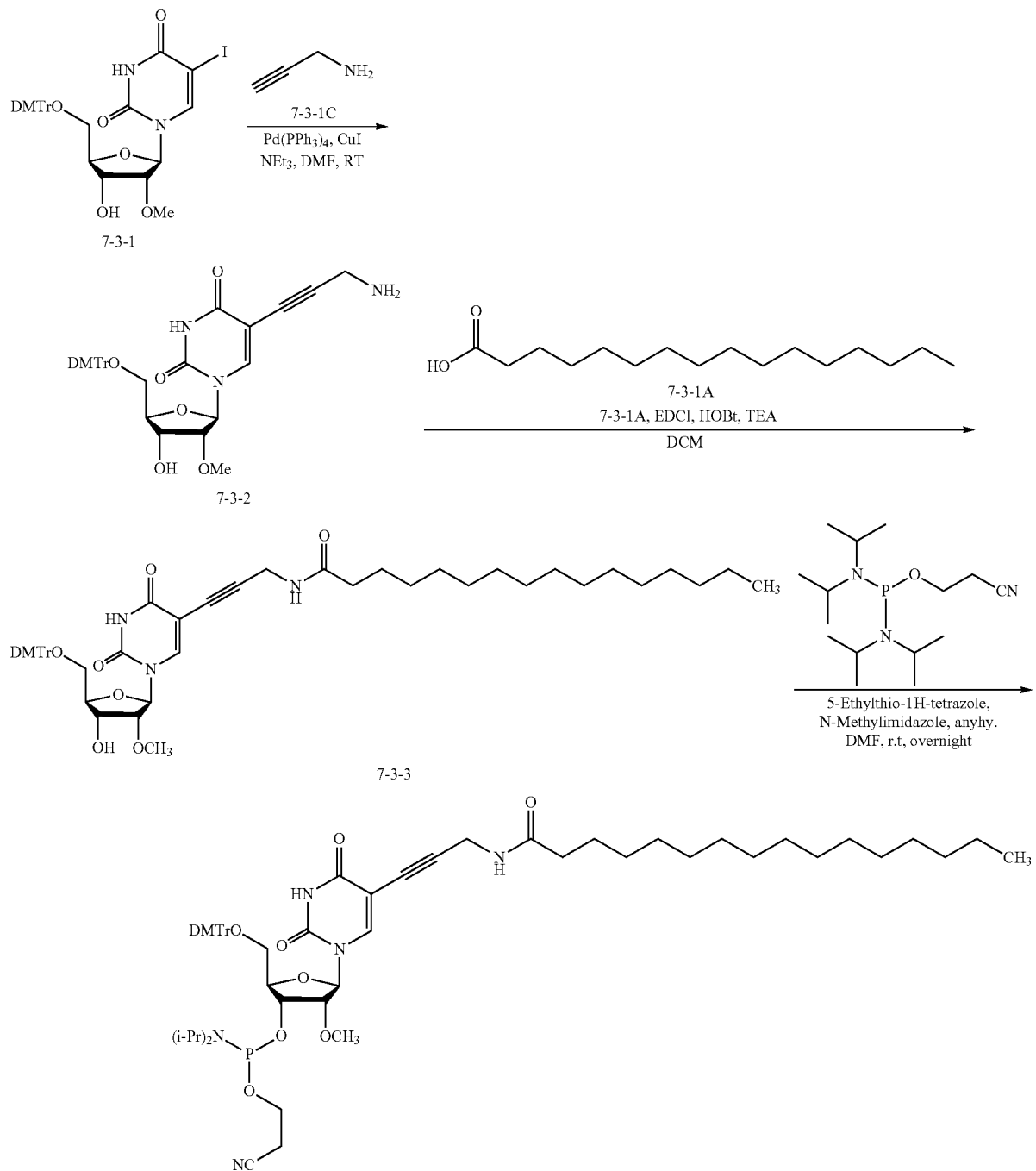
5'-DMT-2'OMe-5-Lipid-3'-CNE phosphoramidite

Preparation of Compound 7-3-2

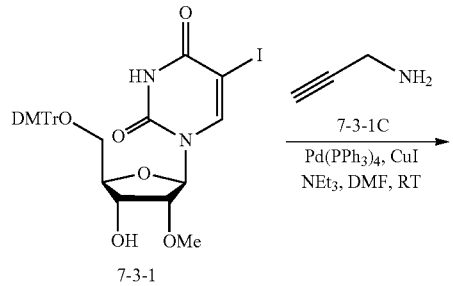

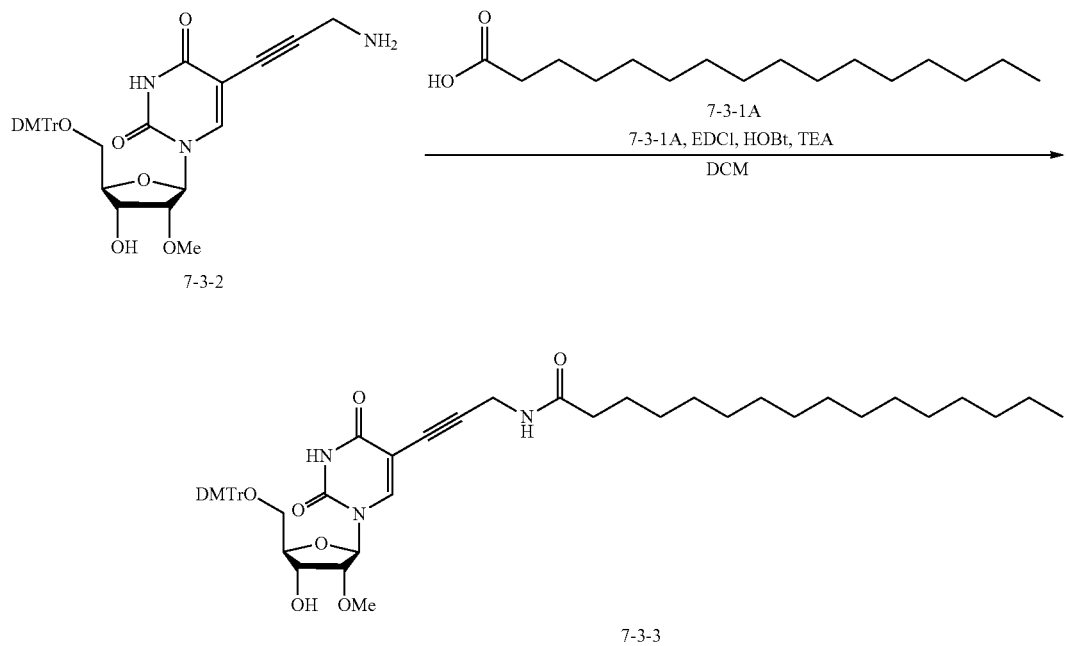

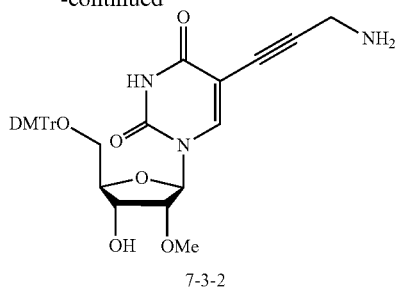

A mixture of compound 7-3-1 (13.00 g, 18.94 mmol), prop-2-yn-1-amine (2.09 g, 37.87 mmol, 2.43 mL), CuI (901.63 mg, 4.73 mmol), Pd(PPh₃)₄ (2.19 g, 1.89 mmol) and TEA (3.83 g, 37.87 mmol, 5.25 mL) in DMF (130 mL) was degassed and purged with $N_2$ for 3 times, and then the mixture was stirred at 25° C. for 12 hour under $N_2$ atmosphere and dark. LC-MS showed Compound 7-3-1 was consumed completely and one main peak with desired MS was detected. The mixture was concentrated in vacuo. The residue was purified by column chromatography (SiO₂, Dichloromethane/Methanol=100/1 to 0:1). Compound 7-3-2 (11.00 g, crude) was obtained as a yellow solid. ¹H NMR (400 MHz, CDCl₃): δ=8.23 (s, 1H), 7.48-7.14 (m, 13H), 6.83 (br d, J=7.3 Hz, 5H), 5.94 (br s, 1H), 4.48 (br t, J=5.8 Hz, 2H), 4.05 (br d, J=6.4 Hz, 2H), 3.93 (br d, J=2.9 Hz, 1H), 3.81-3.70 (m, 8H), 3.62 (s, 4H), 3.52 (br d, J=11.0 Hz, 2H), 3.35 (br d, J=9.0 Hz, 1H). LCMS: (M+H⁺): 614.2. TLC (Dichloromethane/Methanol=10:1) Rf=0.19.

Preparation of Compound 7-3-3

To a solution of palmitic acid (5.06 g, 19.72 mmol) in DCM (130 mL) was added TEA (3.63 g, 35.85 mmol, 4.97 mL), EDCI (5.15 g, 26.89 mmol), HOBt (3.63 g, 26.89 mmol), and Compound 7-3-3 (11.00 g, 17.93 mmol). The mixture was stirred at 25° C. for 1 hour. LC-MS showed Compound 7-3-3 was consumed completely and one main peak with desired MS was detected. The mixture was concentrated in vacuo. The residue was purified by column chromatography (SiO₂, Dichloromethane:Ethyl acetate=10/1 to 0:1 Dichloromethane:Ethyl acetate=100/1 to 0:1). Compound 7-3-3 (6.20 g, 40.58% yield) was obtained as a yellow solid. ¹H NMR (400 MHz, CDCl₃): δ=8.25 (s, 1H), 7.50-7.14 (m, 10H), 6.90-6.77 (m, 4H), 5.93 (d, J=2.0 Hz, 1H), 5.01 (br s, 1H), 4.53-4.44 (m, 1H), 4.06 (br d, J=6.8 Hz, 1H), 3.94 (dd, J=2.0, 5.1 Hz, 1H), 3.83-3.73 (m, 9H), 3.63 (s, 3H), 3.55-3.48 (m, 1H), 3.39 (dd, J=2.5, 11.1 Hz, 1H), 2.79 (q, J=7.1 Hz, 1H), 1.85-1.76 (m, 2H), 1.50-1.41 (m, 2H), 1.24 (br s, 22H), 0.87 (t, J=6.7 Hz, 3H). ¹³CNMR (100 MHz, CDCl₃): δ=172.37, 162.32, 158.66, 158.58, 158.55, 149.58, 144.63, 142.49, 135.55, 135.44, 130.14, 130.00, 129.94, 128.08, 127.86, 126.91, 113.51, 113.35, 99.62, 89.56, 87.56, 86.85, 83.77, 83.68, 74.14, 68.49, 61.77, 58.82, 55.24, 45.30, 36.10, 31.89, 29.84, 29.67, 29.63, 29.49, 29.37, 29.33, 25.42, 22.66, 14.79, 14.11, 9.74. LCMS: (M+H⁺): 850.4.

Preparation of 5'-DMT-2'OMe-5-Lipid-3'-CNE Phosphoramidite

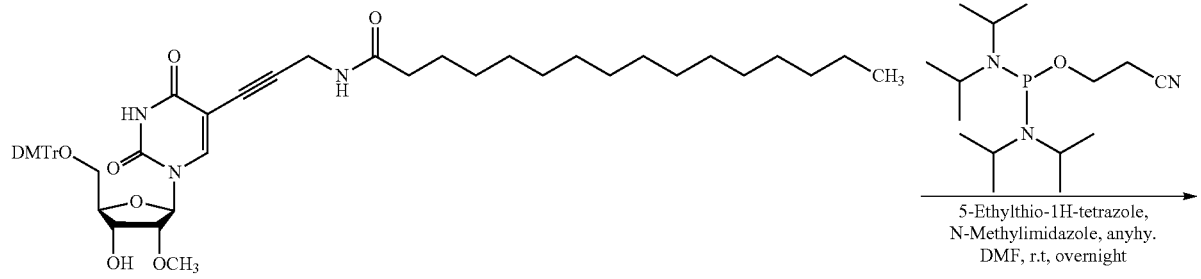

7-3-3

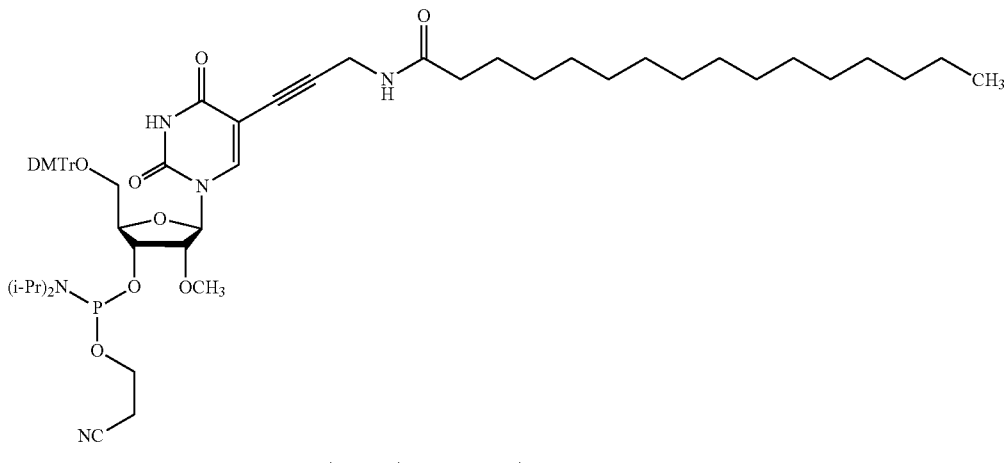

5'-DMT-2'OMe-5-Lipid-3'-CNE phosphoramidite

Compound 7-3-3 (2.8 g, 3.29 mmol) was co-evaporated with anhydrous toluene two times (25 mL×2) and dried under high vacuum overnight. The dried foamy solid was dissolved in anhydrous DMF (5 ml) and was added 5-ethylthio-1H-tetrazole (0.43 g, 3.29 mmol), N-methylimidazole (0.052 mL, 0.66 mmol) followed by 2-cynoethyl-N,N,N', N'-tetraisopropylphosphordiamidite (1.49 g, 4.93 mmol). The reaction mixture was stirred at room temperature under argon atmosphere for overnight. After TLC indicated completion, the reaction was diluted with EtOAc (70 mL) and washed with aq. saturated. NaHCO₃ solution (10 mL), and dried over Mg₂SO₄. The solvent was evaporated under reduced pressure and dried in high vacuum for night. The dried crude product was purified by Combi-Flash Rf (Teledyne ISCO) using 80 g silica column (which was pre-deactivated with 3 column volume of ethyl acetate with 5% TEA) with Hexane/Ethyl acetate/Acetonitrile which contains 5% TEA as an eluent to afford 5'-DMT-2'OMe-5-Lipid-3'CNE phosphoramidite as a foamy solid. Yield 3.1 g (90%). ³¹P NMR (162 MHz, CDCl₃) δ 150.58(s) 150.26(s). ¹³C NMR (101 MHz, CDCl₃) δ 172.20, 172.18, 161.78, 161.66, 158.70, 158.68, 149.45, 149.35, 144.71, 144.57, 142.69, 142.62, 137.91, 135.63, 135.53, 135.49, 135.40, 130.16, 130.11, 128.08, 128.06, 128.01, 127.00, 126.97, 117.71, 117.51, 113.39, 113.36, 113.32, 99.75, 99.46, 89.30, 89.26, 88.49, 88.00, 87.05, 86.84, 83.86, 83.04, 82.98, 82.93, 82.66, 77.39, 77.27, 77.07, 76.75, 74.45, 74.30, 69.88, 69.77, 69.64, 62.10, 61.24, 58.94, 58.92, 58.65, 58.47, 58.44, 57.97, 57.76, 55.30, 55.27, 43.35, 43.32, 43.23, 43.19, 36.11, 36.09, 33.26, 31.90, 29.88, 29.67, 29.65, 29.63, 29.58, 29.50, 29.37, 29.33, 25.41, 24.70, 24.64, 24.61, 24.57, 24.54, 24.50, 22.66, 20.47, 20.40, 20.34, 20.27, 14.82, 14.09. ¹H NMR (400 MHz, Chloroform-d) δ 7.40 (dd, J=10.5, 7.6 Hz, 2H), 7.35-7.12 (m, 7H), 6.78 (ddd, J=9.0, 4.2, 2.7 Hz, 4H), 4.82 (dt, J=22.1, 4.9 Hz, 1H), 4.57-4.38 (m, 1H), 4.24-4.10 (m, 1H), 4.06-3.96 (m, 1H), 3.86-3.67 (m, 7H), 3.67-3.58 (m, 2H), 3.57-3.39 (m, 6H), 3.25 (ddd, J=13.5, 11.3, 2.8 Hz, 1H), 2.55 (t, J=6.1 Hz, 1H), 2.30 (t, J=6.2 Hz, 1H), 1.71 (qd, J=7.4, 7.0, 1.4 Hz, 2H), 1.38 (dtt, J=10.5, 7.7, 2.8 Hz, 2H), 1.09 (dd, J=6.7, 5.1 Hz, 17H), 0.97 (d, J=6.8 Hz, 3H), 0.80 (t, J=6.6 Hz, 3H). MS: LCMS: Calculated, C₅₉H₈₂N₅O10P; 1051.5730; Observed +Ve mode: m/z: 1153.69 [M+Et₃N].

Example 7-4. Synthesis of 5'-(R)—C-Me-5'-DMT-dT-CNE Amidite

Preparation of Compound 7-4-6B

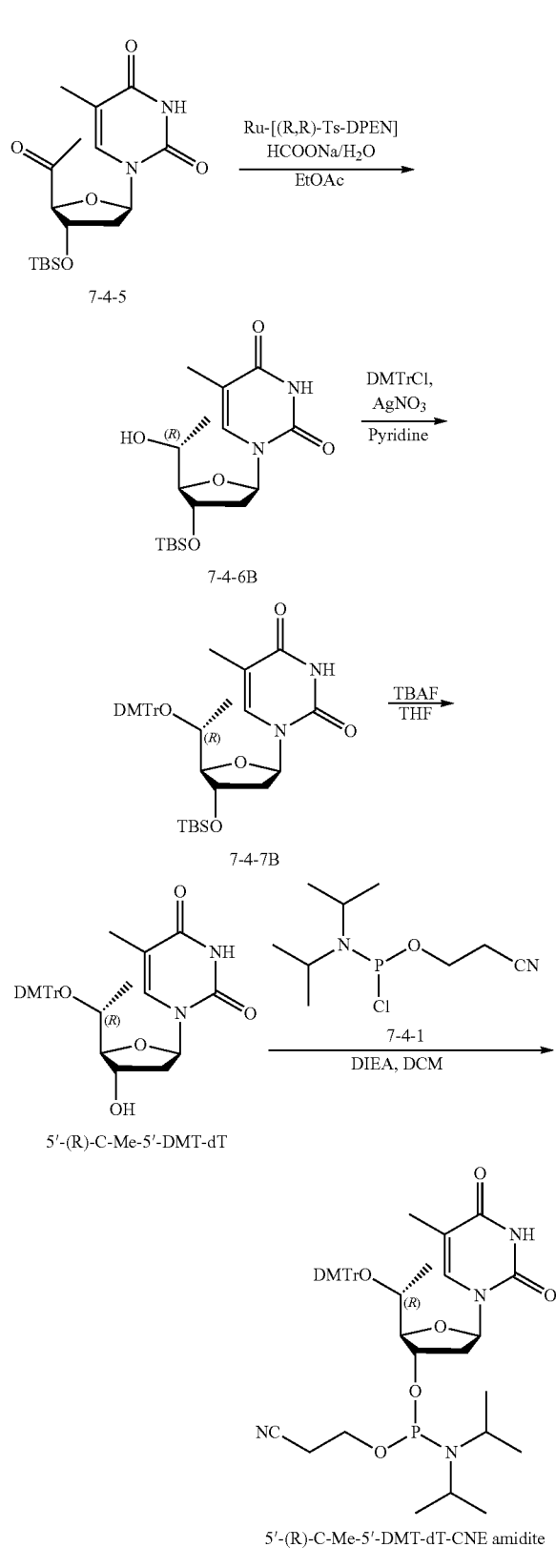

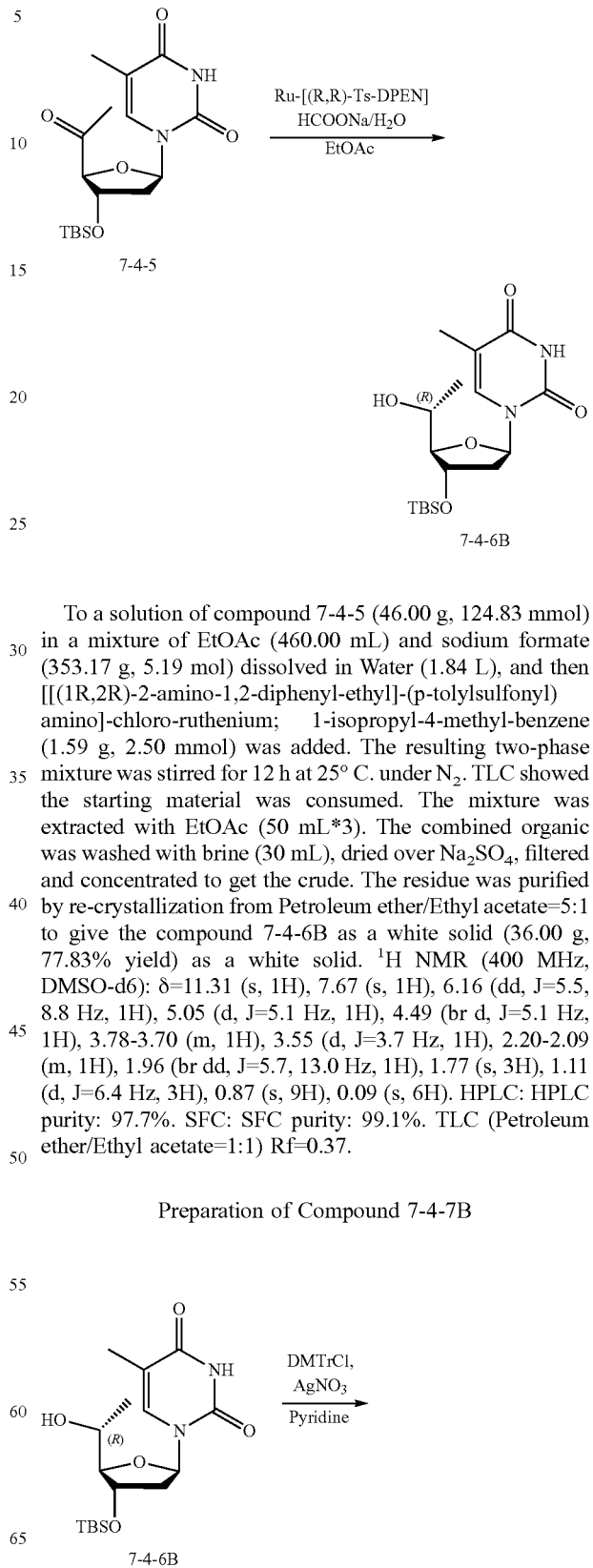

To a solution of compound 7-4-5 (46.00 g, 124.83 mmol) in a mixture of EtOAc (460.00 mL) and sodium formate (353.17 g, 5.19 mol) dissolved in Water (1.84 L), and then [[(1R,2R)-2-amino-1,2-diphenyl-ethyl]-(p-tolylsulfonyl)amino]-chloro-ruthenium; 1-isopropyl-4-methyl-benzene (1.59 g, 2.50 mmol) was added. The resulting two-phase mixture was stirred for 12 h at 25° C. under $N_2$. TLC showed the starting material was consumed. The mixture was extracted with EtOAc (50 mL*3). The combined organic was washed with brine (30 mL), dried over $Na_2SO_4$, filtered and concentrated to get the crude. The residue was purified by re-crystallization from Petroleum ether/Ethyl acetate=5:1 to give the compound 7-4-6B as a white solid (36.00 g, 77.83% yield) as a white solid. $^1$H NMR (400 MHz, DMSO-d6): δ=11.31 (s, 1H), 7.67 (s, 1H), 6.16 (dd, J=5.5, 8.8 Hz, 1H), 5.05 (d, J=5.1 Hz, 1H), 4.49 (br d, J=5.1 Hz, 1H), 3.78-3.70 (m, 1H), 3.55 (d, J=3.7 Hz, 1H), 2.20-2.09 (m, 1H), 1.96 (br dd, J=5.7, 13.0 Hz, 1H), 1.77 (s, 3H), 1.11 (d, J=6.4 Hz, 3H), 0.87 (s, 9H), 0.09 (s, 6H). HPLC: HPLC purity: 97.7%. SFC: SFC purity: 99.1%. TLC (Petroleum ether/Ethyl acetate=1:1) Rf=0.37.

Preparation of Compound 7-4-7B

-continued

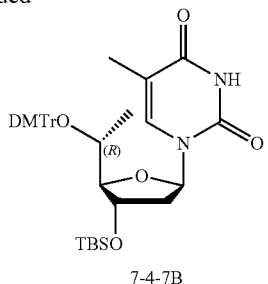

7-4-7B

Compound 7-4-6B (18.00 g, 48.58 mmol) was dried by azeotropic distillation on a rotary evaporator with pyridine (100 mL) and toluene (100 mL*2). A solution of compound 7-4-6B (18.00 g, 48.58 mmol) and DMTCl (1.89 g, 5.59 mmol) in the mixture of pyridine (180.00 mL) and THF (720.00 mL) was degassed and purged with $N_2$ for 3 times and then $AgNO_3$ (14.19 g, 83.56 mmol) was added. The mixture was stirred at 25° C. for 15 hr. TLC showed the starting material was consumed. MeOH (5 mL) was added and stirred for 15 min and then the mixture was filtered and the cake was washed with toluene (300 mL*3). The filtrate was concentrated to obtain the compound 7-4-7B as a yellow oil (65.38 g, crude). The mixture was used directly to next step without any purification. TLC (Petroleum ether/Ethyl acetate) Rf=0.63.

Preparation of 5'-(R)—C-Me-5'-DMTr-dT

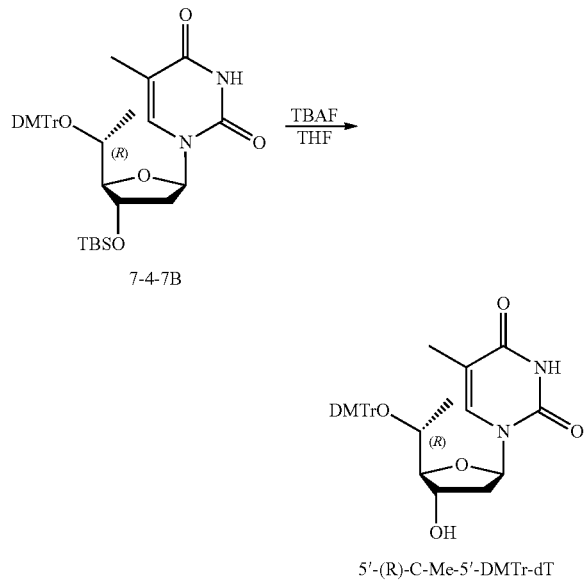

5'-(R)-C-Me-5'-DMTr-dT

To a solution of compound 7-4-7B (65.38 g, 97.16 mmol) in THF (650.00 mL) was added TBAF (1 M, 184.60 mL). The mixture was stirred at 25° C. for 12 hours. TLC showed the starting material was consumed. The mixture was concentrated to provide the crude and then sat. NaCl (5% aq., 200 mL*2) was added and the mixture was extracted with EtOAc (200 mL*3). The combined organic phase was dried over $Na_2SO_4$, filtered and concentrated to provide the crude product, which was purified by MPLC (Petroleum ether:Ethyl acetate 5:1,1:1,1:4,5% TEA) to provide 5'-(R)—C-Me-5'-DMTr-dT as a white solid (47.50 g, 85.03 mmol, 87.52% yield). $^1$H NMR (400 MHz, DMSO-d6): δ=11.32 (s, 1H), 7.46 (br d, J=7.8 Hz, 2H), 7.37-7.25 (m, 6H), 7.23-7.16 (m, 1H), 7.07 (s, 1H), 6.89 (dd, J=4.6, 8.5 Hz, 4H), 6.12 (t, J=7.2 Hz, 1H), 5.27 (d, J=4.6 Hz, 1H), 4.54-4.46 (m, 1H), 3.73 (d, J=1.8 Hz, 6H), 3.62 (t, J=2.9 Hz, 1H), 3.40-3.34 (m, 1H), 2.09-2.02 (m, 2H), 1.40 (s, 3H), 0.77 (d, J=6.2 Hz, 3H). $^{13}$C NMR (101 MHz, DMSO-d6): δ=163.98, 158.58, 150.81, 146.95, 137.11, 136.79, 135.76, 130.49, 130.41, 128.20, 128.15, 127.04, 113.54, 113.52, 110.16, 89.87, 86.24, 83.35, 70.28, 70.05, 60.20, 55.47, 55.35, 21.20, 17.82, 14.52, 12.08. HPLC: HPLC purity: 98.7%. LC-MS: (M−H$^+$)=557.2; LCMS purity: 98.9%. SFC: SFC purity: 100.0%. TLC (Petroleum ether/Ethyl acetate=1:1, 5% TEA) Rf=0.02.

Preparation of 5'-(R)—C-Me-5'-DMT-dT-CNE-amidite

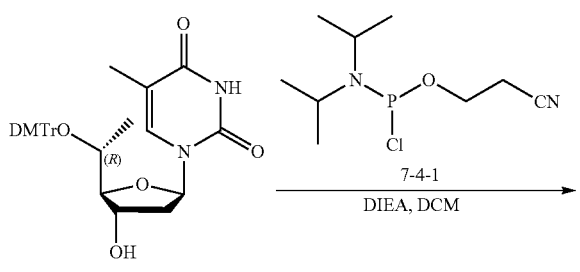

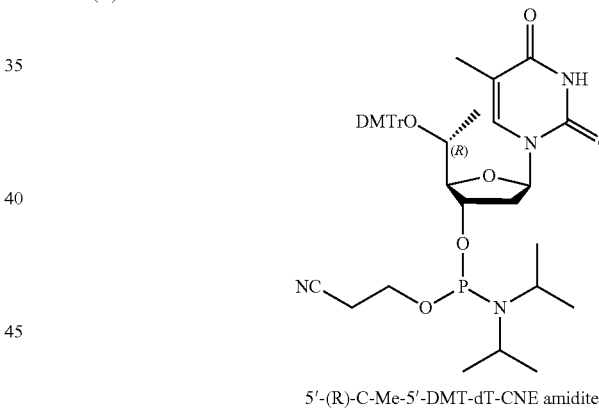

5'-(R)-C-Me-5'-DMT-dT-CNE amidite

5'-(R)—C-Me-5'-OMT-dT (5 g, 8.95 mmol) was dried with toluene (50 mL). To a solution of DIEA (1.39 g, 10.74 mmol, 1.87 mL) and 5'-(R)—C-Me-5'-DMT-dT (5 g, 8.95 mmol) in anhydrous DCM (50 mL) was added compound 7-4-1 (2.76 g, 9.40 mmol) under $N_2$ at 0° C. The mixture was stirred at 15° C. for 2 h. TLC showed the starting material was consumed and two new spots were found. The mixture was quenched by addition of saturated aq. $NaHCO_3$ (20 mL) and extracted with DCM (30 mL*3). The combined organic phase was dried over $Na_2SO_4$, filtered and concentrated to provide the crude product, which was purified on a Combiflash instrument from Teledyne. A 40 g silica gel cartridge column was first pre-treated by eluting with 10% EtOAc/Petroleum ether containing 5% $Et_3N$ (300 mL). The crude product was dissolved in a 2:1 volume:volume mixture of methylene chloride:petroleum ether containing 5% $Et_3N$ and loaded onto the column. After loading, the purification process was run using the following gradient: 10 to 50%

EtOAc/Petroleum ether containing 5% Et₃N. Fractions were collected. After evaporation of the solvent, 5'-(R)—C-Me-5'-DMT-dT-CNE-amidite was obtained as a white solid (3.6 g, 53% yield). $^1$H NMR (400 MHz, CHLOROFORM-d) δ=8.11 (br s, 1H), 7.53 (br d, J=7.7 Hz, 3H), 7.42 (br t, J=8.2 Hz, 4H), 7.32-7.17 (m, 4H), 7.07-6.99 (m, 1H), 6.84 (br d, J=8.2 Hz, 4H), 6.31 (br dd, J=5.5, 8.7 Hz, 1H), 4.94 (br s, 1H), 3.96-3.73 (m, 10H), 3.72-3.41 (m, 4H), 2.65 (td, J=6.1, 18.0 Hz, 2H), 2.53-2.37 (m, 1H), 2.10 (br d, J=8.2 Hz, 1H), 1.47 (br s, 4H), 1.33-1.16 (m, 15H), 1.00-0.90 (m, 3H). $^{31}$P NMR (162 MHz, CHLOROFORM-d) δ=148.81 (s, 1P), 148.35 (s, 1P).

Example 7-5. Synthesis of 5'-(S)—C-Me-5'-DMT-dT-CNE Amidite

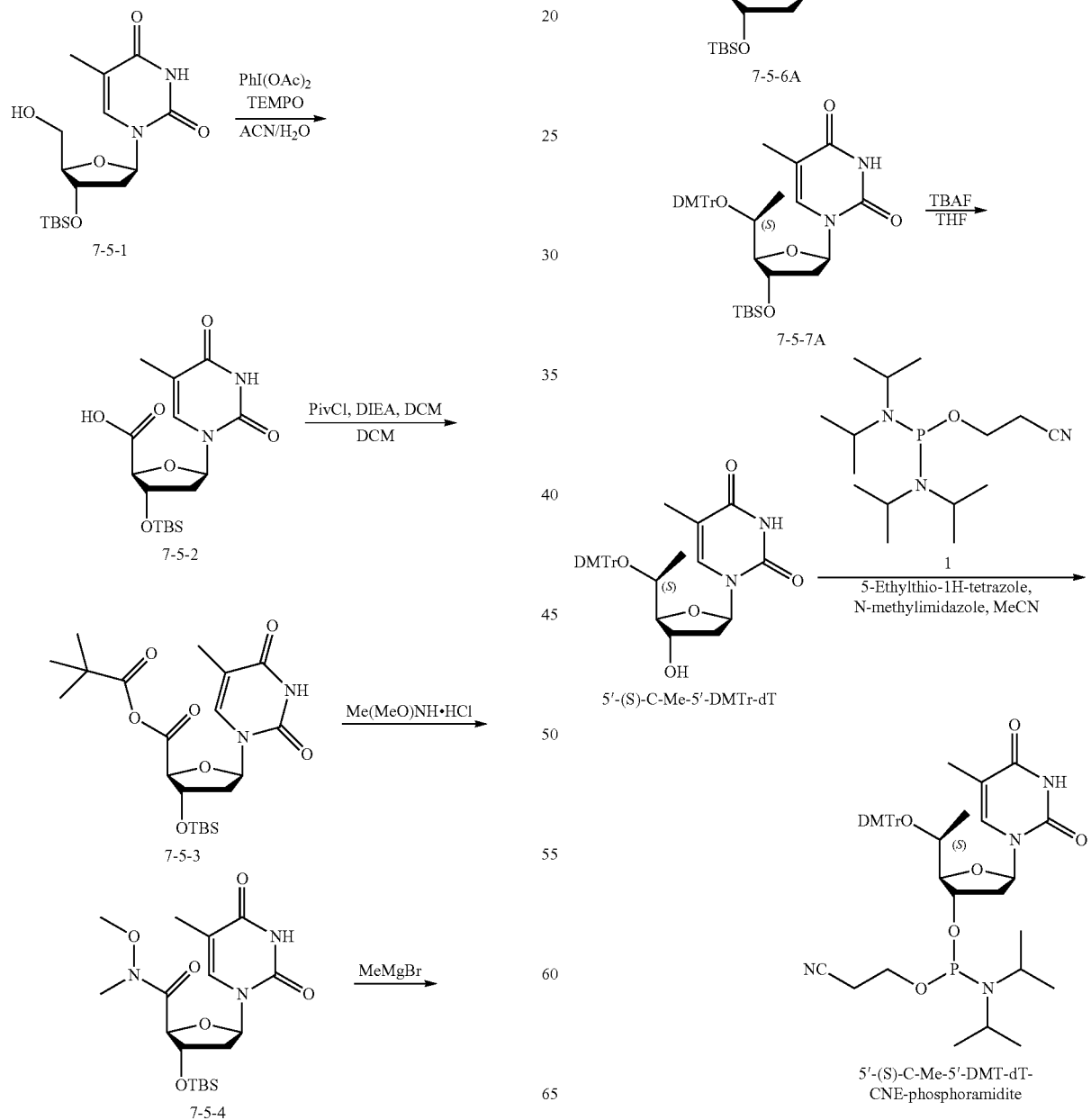

Preparation of Compound 7-5-2

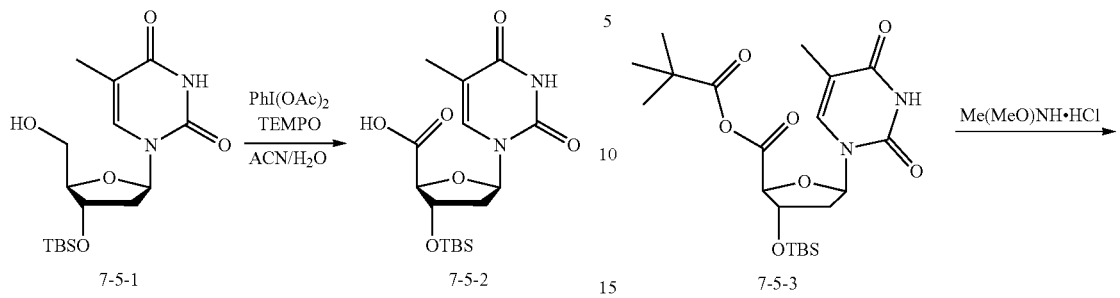

To a solution of compound 7-5-1 (63.00 g, 176.72 mmol) in the mixture of H$_2$O (250.00 mL) and MeCN (250.00 mL) was added PhI(OAc)$_2$ (125.23 g, 388.79 mmol) and TEMPO (5.56 g, 35.34 mmol) at 10° C. The mixture was stirred at 25° C. for 2 hours. TLC (Petroleum ether/Ethyl acetate=1:1, Rf=0) showed the starting material was consumed. The mixture was concentrated, and MTBE (1 L) was added. The mixture was stirred for 0.5 h and then filtered. The cake was washed with MTBE (1 L*2), and dried to provide compound 7-5-2 as a white solid (126 g, 96.23% yield). $^1$H NMR (400 MHz, DMSO): δ=11.21 (s, 1H), 7.89 (d, J=1.0 Hz, 1H), 6.18 (dd, J=5.9, 8.6 Hz, 1H), 4.61-4.41 (m, 1H), 4.17 (d, J=0.9 Hz, 1H), 2.51-2.26 (m, 3H), 2.09-1.85 (m, 2H), 1.74-1.58 (m, 3H), 0.90-0.58 (m, 10H), 0.00 (d, J=2.0 Hz, 6H). LC-MS: (M+H$^+$): 371.1. TLC (Petroleum ether/Ethyl acetate=1:1) Rf=0.

Preparation of Compound 7-5-3

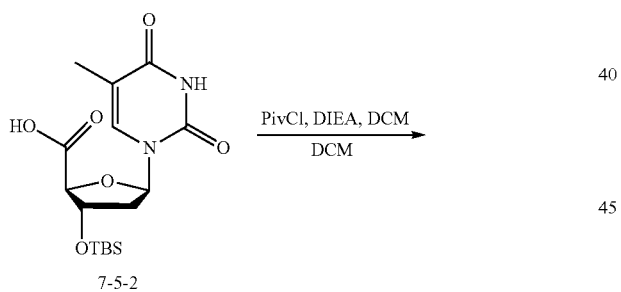

To a solution of compound 7-5-2 (50.00 g, 134.96 mmol) in DCM (500.00 mL) was added DIEA (34.89 g, 269.92 mmol, 47.15 mL) and 2,2-dimethylpropanoyl chloride (21.16 g, 175.45 mmol). The mixture was stirred at −10-0° C. for 1.5 hours. TLC showed the starting material was consumed. The mixture in DCM was used directly for next step. TLC (Petroleum ether/Ethyl acetate=1:1) Rf=0.15.

Preparation of Compound 7-5-4

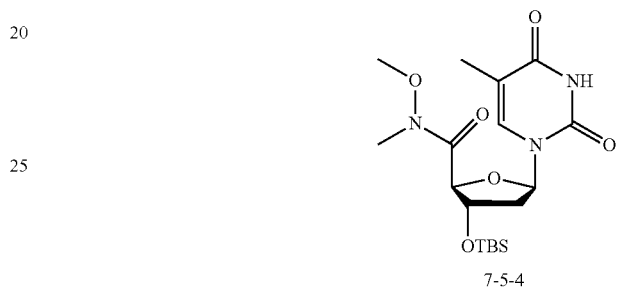

To compound 7-5-3 in DCM was added TEA (40.94 g, 404.55 mmol, 56.08 mL) and N-methoxymethanamine hydrochloride (19.73 g, 202.27 mmol). The mixture was stirred at 0° C. for 1 h. TLC showed the starting material was consumed. The mixture was washed with HCl (1N, 100 mL) and then aqueous NaHCO$_3$ (100 mL). The organic layer was dried over Na$_2$SO$_4$, filtered and concentrated to provide the crude product, which was purified by silica gel chromatography (Petroleum ether/Ethyl acetate=30/1, 0/1) to afford compound 7-5-4 as a white solid (95.5 g, 85.63% yield). $^1$H NMR (400 MHz, CDCl$_3$): δ=8.29 (s, 1H), 8.19 (br s, 1H), 6.46 (dd, J=5.1, 9.3 Hz, 1H), 4.71 (s, 1H), 4.38 (d, J=4.2 Hz, 1H), 3.65 (s, 3H), 3.15 (s, 3H), 2.18-2.08 (m, 1H), 2.00-1.90 (m, 1H), 1.87 (d, J=1.1 Hz, 3H), 0.88-0.74 (m, 10H), 0.00 (d, J=3.7 Hz, 6H). TLC (Petroleum ether/Ethyl acetate=1:1) Rf=0.43.

Preparation of Compound 7-5-5

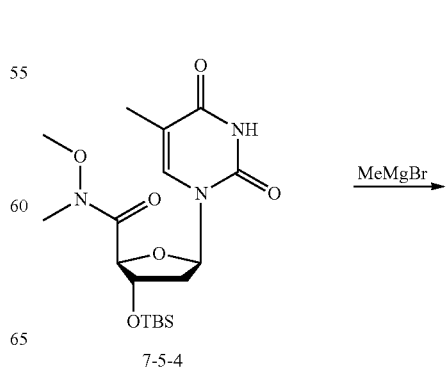

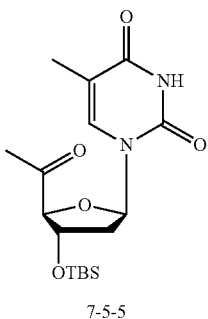

7-5-5

To a solution of compound 7-5-4 (115.00 g, 278.09 mmol) in THF (1.20 L) was added MeMgBr (3 M, 185.39 mL) at 0° C. The mixture was stirred at 0° C. for 2 h. TLC showed the starting material was consumed. To the mixture was added water (1 L) at 0° C. and the mixture was extracted with EtOAc (300 mL*2). The combined organic phase was dried over $Na_2SO_4$, filtered and concentrated to provide the compound 7-5-5 as a white solid (100.00 g, 97.58% yield). The mixture was used directly without further purification. $^1$H NMR (400 MHz, $CDCl_3$): δ=8.81 (br s, 1H), 7.95 (s, 1H), 6.41 (dd, J=5.6, 8.1 Hz, 1H), 4.60-4.40 (m, 2H), 2.40-2.16 (m, 4H), 1.98 (s, 3H), 1.02-0.83 (m, 10H), 0.14 (d, J=3.3 Hz, 6H), 0.20-0.00 (m, 1H). TLC (Petroleum ether/Ethyl acetate=1:1) Rf=0.68.

Preparation of Compound 7-5-6A

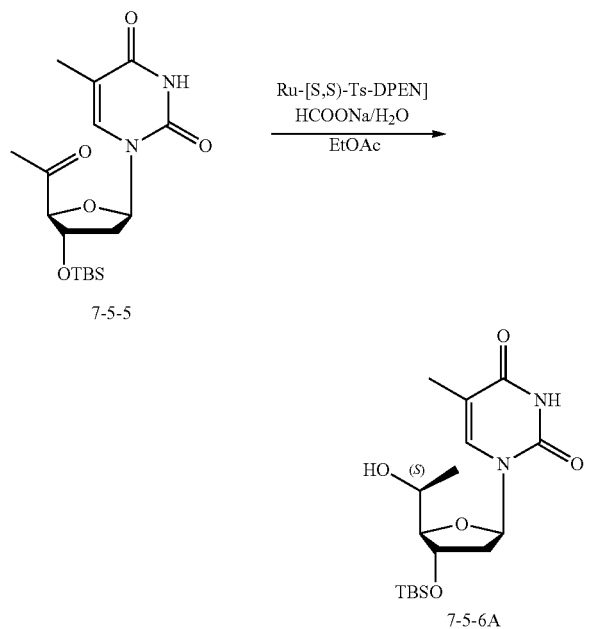

To a solution of compound 7-5-5 (46.00 g, 124.83 mmol) in the mixture of EtOAc (460.00 mL) and sodium formate (353.17 g, 5.19 mol) dissolved in water (1.84 L), and N-[(1S,2S)-2-amino-1,2-diphenyl-ethyl]-4-methyl-benzenesulfonamide chlororuthenium; 1-isopropyl-4-methyl-benzene (1.59 g, 2.50 mmol) was added. The resulting two-phase mixture was stirred for 12 h at 25° C. under $N_2$. TLC showed the starting material was consumed. The mixture was extracted with EtOAc (500 mL*3). The combined organic was washed with brine (300 mL), dried over $Na_2SO_4$, filtered and concentrated to provide the crude product. The mixture was purified by MPLC (Petroleum ether/MTBE=10:1 to 1:1) seven times to provide compound 7-5-6A as a yellow oil (25.6 g, 57.53% yield). $^1$H NMR (400 MHz, DMSO-d6): δ=11.28 (s, 1H), 7.85 (s, 1H), 6.16 (t, J=6.8 Hz, 1H), 5.04 (d, J=4.6 Hz, 1H), 4.46-4.29 (m, 1H), 3.79 (br t, J=6.8 Hz, 1H), 3.59 (br s, 1H), 3.32 (s, 1H), 2.21-2.09 (m, 1H), 2.06-1.97 (m, 1H), 1.76 (s, 3H), 1.17-1.08 (m, 4H), 0.91-0.81 (m, 10H), 0.08 (s, 6H). SFC: SFC purity: 98.6%. TLC (Petroleum ether/Ethyl acetate=1:1) Rf=0.38.

Preparation of Compound 7-5-7A

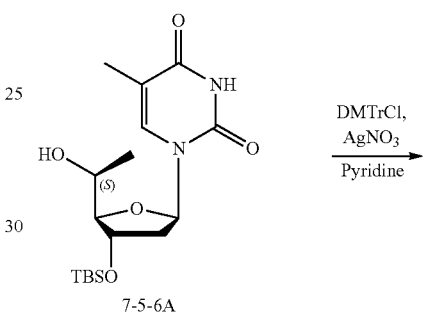

Compound 7-5-6A (12.80 g, 34.55 mmol) was dried by azeotropic distillation on a rotary evaporator with pyridine (100 mL) and toluene (100 mL*2). To a solution of compound 7-5-6A (12.80 g, 34.55 mmol) and DMTCl (1.89 g, 5.59 mmol) in the mixture of pyridine (120.00 mL) and THF (400.00 mL) was degassed and purged with $N_2$ for 3 times and then $AgNO_3$ (10.09 g, 59.43 mmol) was added. The mixture was stirred at 25° C. for 15 hr. TLC showed the starting material was consumed. MeOH (5 mL) was added and stirred for 15 min and then the mixture was filtered and the cake was washed with toluene (300 mL*3). The filtrate was concentrated to get the compound 7-7-7A as a yellow oil (46.50 g, crude). The mixture was used directly to next step without any purification. TLC (Petroleum ether/Ethyl acetate) Rf=0.63.

1025
Preparation of 5'-(S)—C-Me-5'-DMT-dT

1026
Preparation of 5'-(S)—C-Me-5'-DMT-dT-CNE-amidite

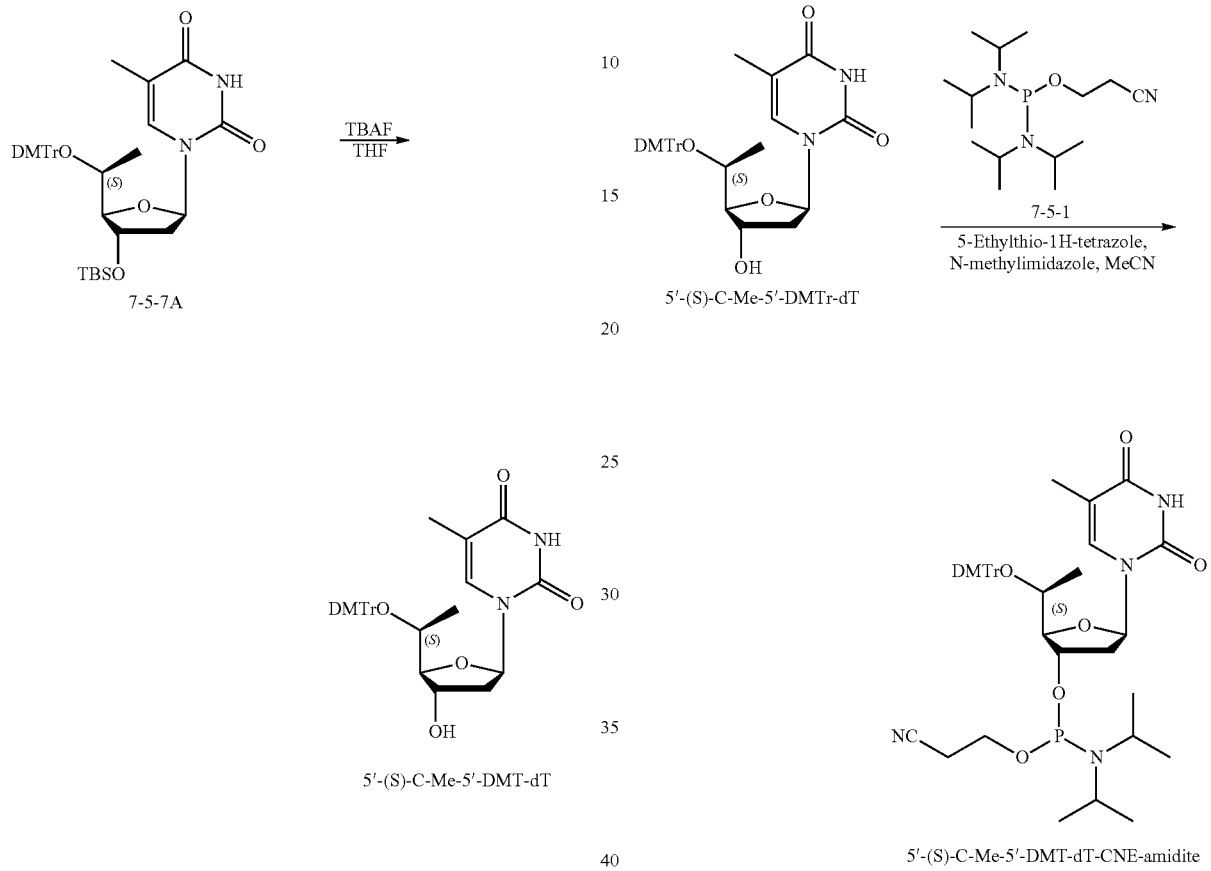

To a solution of compound 7-5-7A (46.50 g, 69.11 mmol) in THF (460.00 mL) was added TBAF (1 M, 131.31 mL). The mixture was stirred at 25° C. for 5 hrs. TLC showed the starting material was consumed. The mixture was concentrated and then sat. NaCl (5% aq., 200 mL) was added and the aqueous phase was extracted with EtOAc (200 mL*3). The combined organic layer was dried over $Na_2SO_4$, filtered and concentrated to provide the crude product, which was purified by MPLC (Petroleum ether/Ethyl acetate 5:1, 1:1, 1:4, 5% TEA) to provide 5'-(S)—C-Me-5'-DMT-dT as a white solid (29.0 g, 75.12% yield). $^1$H NMR (400 MHz, DMSO-d6): δ=11.35 (s, 1H), 7.56 (s, 1H), 7.58-7.53 (m, 1H), 7.44 (d, J=7.8 Hz, 2H), 7.37-7.24 (m, 6H), 7.23-7.17 (m, 1H), 6.87 (t, J=8.3 Hz, 4H), 6.13 (t, J=6.9 Hz, 1H), 5.21 (d, J=4.9 Hz, 1H), 4.23 (br s, 1H), 3.73 (d, J=2.9 Hz, 6H), 3.67 (t, J=3.7 Hz, 1H), 3.57-3.46 (m, 1H), 2.23-2.04 (m, 2H), 1.67 (s, 3H), 1.70-1.65 (m, 1H), 0.71 (d, J=6.2 Hz, 3H). $^{13}$CNMR (101 MHz, DMSO-d6): δ=170.78, 164.16, 158.64, 158.59, 150.86, 146.71, 137.00, 136.75, 135.97, 130.65, 130.52, 128.38, 128.07, 127.11, 113.48, 110.11, 89.78, 86.41, 83.87, 70.58, 70.22, 60.21, 55.48, 21.20, 18.08, 14.53, 12.54. HPLC: HPLC purity: 98.4%. LCMS: (M−H+)=557.2; LCMS purity: 99.0%. SFC: SFC purity: 99.4%. TLC (Petroleum ether/Ethyl acetate=1:1, 5% TEA) Rf=0.01.

To a solution of 5'-(S)—C-Me-5'-DMT-dT (5.00 g, 8.95 mmol) in MeCN (50.00 mL) was added 5-ethylsulfanyl-2H-tetrazole (1.17 g, 8.95 mmol), 1-methylimidazole (1.47 g, 17.90 mmol, 1.43 mL) and compound 7-5-1 (4.05 g, 13.43 mmol, 4.26 mL). The reaction mixture was stirred at 20° C. under $N_2$ for 2 hrs. TLC and LC-MS showed some starting material was consumed and the desired substance was formed. The reaction mixture was concentrated under reduced pressure, and the residue was diluted with EtOAc (20 mL). The reaction mixture was washed with aq. saturated $NaHCO_3$ solution (20 mL), dried over $Na_2SO_4$, filtered and concentrated to provide the crude product, which was purified by MPLC (Petroleum ether 5% TEA:Ethyl acetate from 10:1 to 1:1) to provide 5'-(S)—C-Me-5'-DMT-dT-CNE-amidite as a white solid (4.3 g, 63.31% yield). $^1$H NMR (400 MHz, CHLOROFORM-d) δ=8.19 (br s, 1H), 7.69-7.60 (m, 1H), 7.54 (s, 1H), 7.43-7.33 (m, 2H), 7.32-7.07 (m, 8H), 6.73 (ddd, J=3.7, 5.8, 9.0 Hz, 4H), 6.27-6.15 (m, 1H), 4.49-4.37 (m, 1H), 3.82-3.65 (m, 8H), 3.63-3.55 (m, 2H), 3.53-3.39 (m, 3H), 2.50 (t, J=6.3 Hz, 1H), 2.46-2.31 (m, 1H), 2.29-2.19 (m, 1H), 2.16-2.04 (m, 1H), 1.68 (s, 3H), 1.20-1.00 (m, 13H), 0.95 (d, J=6.8 Hz, 3H), 0.92-0.74 (m, 4H). $^{31}$P NMR (162 MHz, CHLOROFORM-d) δ=149.11 (s, 1P), 148.99 (s, 1P).

Example 7-6. Synthesis of L-DPSE-5'-(R)—C-Me-5'-DMT-dT Amidite

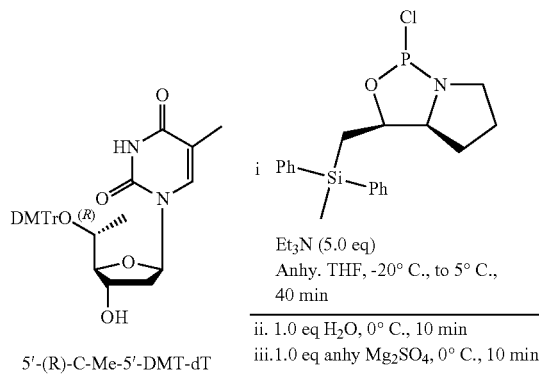

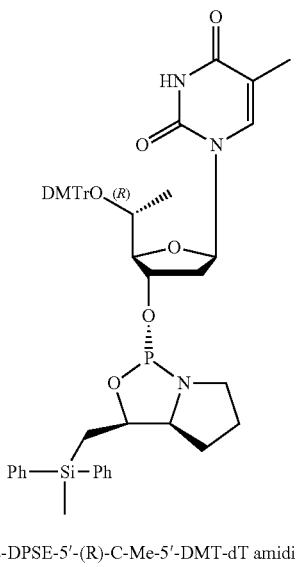

L-DPSE-5'-(R)-C-Me-5'-DMT-dT amidite

The 5'-(R)—C-Me-5'-OMT-dT (11.17 g, 20 mmol) was dried two times by co-evaporation with 80 mL of anhydrous toluene at 45° C. and kept at high vacuum for overnight. Then the dried 5'-(R)—C-Me-5'-OMT-dT was dissolved in dry THF (80 mL) in 500 mL three neck flasks under argon, followed by the addition of triethylamine (13.93 mL, 100 mmol) and the mixture was cooled to −40° C. To this cooled reaction mixture was added the solution of the crude L-DPSE-NOPCl (30 mmol, 1.4 eq, in THF 40 mL), from a stock through syringe dropwise (~15 min, maintaining the internal temperature −40- to −35° C.). The mixture was then gradually warmed to 5° C. After 30 min at 5° C., TLC and LC-MS analysis indicated the complete conversion of SM to product (total reaction time 2 h). The reaction mixture was cooled in an ice bath and the reaction quenched by addition of water (0.36 mL, 20 mmol). The mixture was stirred for 10 min followed by addition of anhydrous $Mg_2SO_4$ (3.0 g, 20 mmol). The reaction was filtered through Airfree, Schlenk filter tube, washed with dry THF (60 mL) and the solvent was evaporated under rotary evaporation at 28° C. to afford the crude product as a off-white solid which was dried under high vacuum for overnight. The dried crude product was purified by Combi-Flash Rf (Teledyne ISCO) using a 220 silica column (which was pre-deactivated with 3 column volume of ethyl acetate with 5% TEA) with ethyl acetate/hexane mixture contains 5% TEA as a solvent. Fractions were analyzed by TLC and LC-MS and pooled together. Solvent was evaporated in a rotary evaporator at 28° C. and the residue was dried under high vacuum to afford the product as a white solid. Yield: 16.3 g (91%). $^1$H NMR (400 MHz, Chloroform-d) δ 7.50-7.36 (m, 6H), 7.35-7.06 (m, 13H), 6.85 (d, J=1.4 Hz, 1H), 6.73 (dq, J=8.7, 3.2 Hz, 4H), 6.13 (dd, J=9.3, 5.3 Hz, 1H), 5.10 (td, J=7.8, 7.1, 3.4 Hz, 1H), 4.80 (dt, J=8.6, 5.8 Hz, 1H), 4.04 (q, J=7.1 Hz, 1H), 3.69 (d, J=2.3 Hz, 6H), 3.57-3.36 (m, 3H), 3.29-3.05 (m, 2H), 2.05 (dd, J=13.6, 5.5 Hz, 1H), 1.96 (s, 2H), 1.73-1.50 (m, 3H), 1.47-1.32 (m, 2H), 1.30 (d, J=1.2 Hz, 3H), 1.17 (t, J=7.2 Hz, 2H), 0.75 (d, J=6.5 Hz, 3H), 0.60 (s, 3H). $^{31}$P NMR (162 MHz, $CDCl_3$) δ 151.34 (s). MS: LCMS: Calculated, C51H56N3O8PSi, 897.3574; Observed +Ve mode: m/z: 898.52 [M+H]; 999.95 [M+$Et_3$N]. $^{13}$C NMR (101 MHz, $CDCl_3$) δ 171.12, 163.83, 158.65, 158.61, 150.21, 146.50, 136.96, 136.71, 136.59, 135.94, 135.54, 134.60, 134.34, 130.24, 130.15, 129.45, 129.39, 128.02, 127.96, 127.94, 127.88, 127.79, 126.86, 113.17, 113.11, 110.93, 89.27, 89.25, 86.48, 83.68, 79.09, 78.99, 77.42, 77.30, 77.10, 76.78, 71.78, 71.70, 70.26, 68.39, 68.36, 60.39, 55.24, 47.19, 46.83, 46.09, 39.48, 39.44, 27.35, 25.97, 25.93, 21.05, 18.33, 17.85, 17.81, 14.23, 11.73, 11.45.

Example 7-7. Synthesis of L-DPSE-5'-(S)—C-Me-5'-DMT-dT Amidite

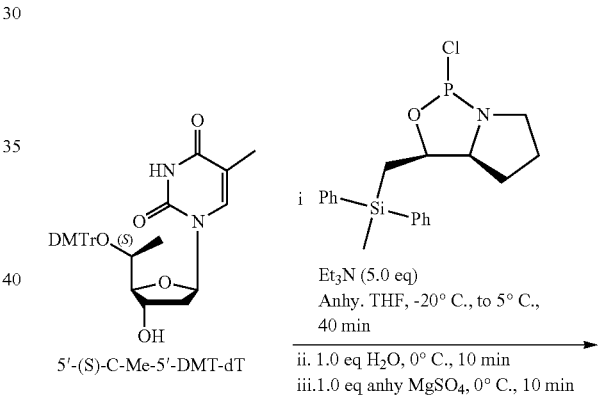

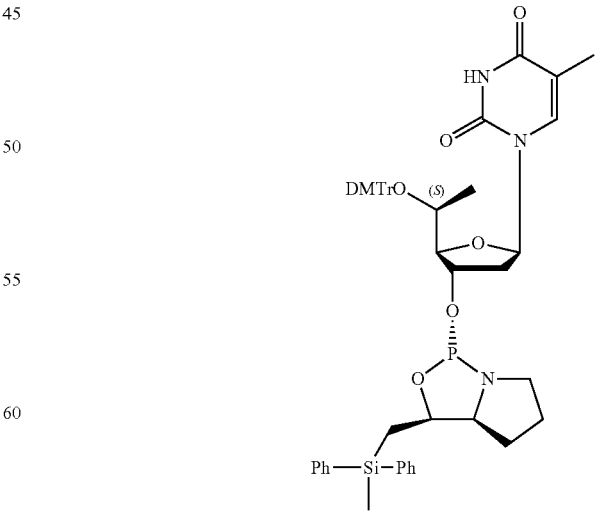

L-DPSE-5'-(S)-C-Me-5'-DMT-dT amidite

5'-(S)—C-Me-5'-OMT-dT (1.20 g, 2 mmol) was dried two times by co-evaporation with 20 mL of anhydrous toluene at 45° C. and kept at high vacuum for overnight. Then the dried 5'-(S)—C-Me-5'-OMT-dT was dissolved in dry THF (20 mL) in a 100 mL three neck flasks under argon, followed by the addition of triethylamine (1.4 mL, 10 mmol) and the mixture was cooled to −40° C. To this cooled reaction mixture was added the solution of the crude L-DPSE-NOPCl (3 mmol, 1.5 eq, in THF 3.0 mL) from a stock was through syringe dropwise ~5 min (maintaining the internal temperature ~40° C., then gradually warmed to 5° C.). After 30 min at 5° C., TLC and LC-MS analysis indicated complete conversion of SM to product (total reaction time 1.5 h). The reaction mixture was cooled in an ice bath and the reaction was quenched by addition of water (0.036 mL, 2 mmol). The mixture was stirred for 10 min, followed by addition of anhydrous MgSO$_4$ (0.3 g, 2 mmol). The reaction was filtered through Airfree, Schlenk filter tube and washed with dry THF (20 mL). The solvent was evaporated under rotary evaporation at 28° C. to provide the off-white solid which was dried under high vacuum for overnight. The dried crude product was purified by Combi-Flash Rf (Teledyne ISCO) using 40 g silica column (which was pre-deactivated with 3 column volume of ethyl acetate with 5% TEA) with ethyl acetate/hexane mixture containing 5% TEA as a solvent. After column purification, fractions were analyzed by TLC and LC-MS and were pooled together and evaporated in a rotary evaporator at 28° C. The residue was dried under high vacuum to afford L-DPSE-5'-(S)—C-Me-5'-DMT-dT amidite as a white solid. Yield: 1.27 g (70%). $^{31}$P NMR (162 MHz, CDCl$_3$) δ 149.73 (s). MS: LC-MS; Calculated: C51H56N3O8PSi, 897.3574; Observed +Ve mode: m/z: 898.56[M+H].

Example 7-8. Synthesis of L-DPSE-5'-DMT-5-C6-aminolinker Amidite—Incorporation of Desired Moieties Through Nucleobases

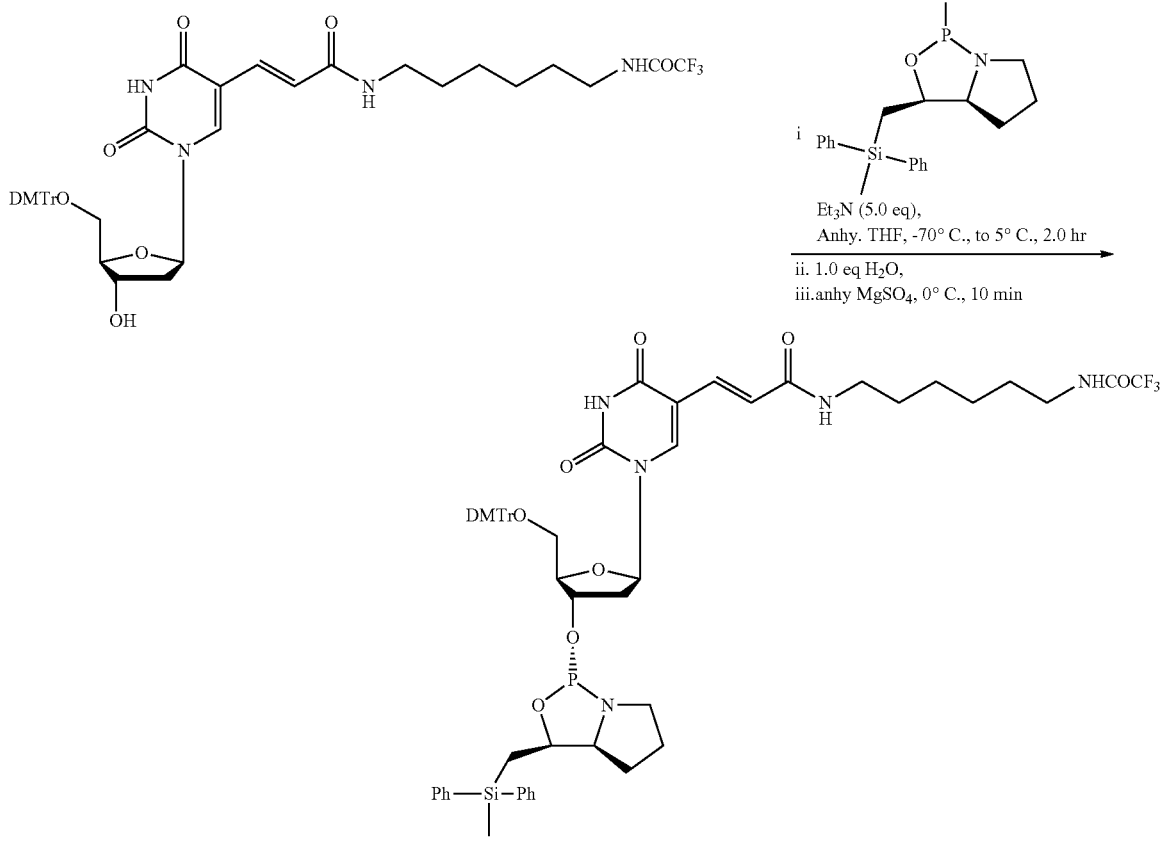

The 5'-DMT-5-C6 aminoTFA-dT (25 g, 31.5 mmol, from Berry& Associates Inc) was dried two times by co-evaporation with 100 mL of anhydrous toluene at 45° C. and kept at high vacuum for overnight. Then the dried material was dissolved in dry THF (100 mL) in 500 mL three neck flasks under argon, followed by the addition of triethylamine (21.92 mL, 157 mmol) and then was cooled to −70° C. To this cooled reaction mixture was added a solution of the crude L-DPSE-NOPCl (44 mmol, 1.4 eq, in THF 44 mL), from a stock via syringe dropwise (~15 min, maintaining the internal temperature ~60- to 50° C.). The mixture was gradually warmed to 5° C. After 30 min at 5° C., TLC and LC-MS analysis indicated complete conversion of SM to product (total reaction time 2 h). The reaction mixture was cooled in an ice bath and quenched by addition of water (0.56 mL, 31.5 mmol), and stirred for 10 min followed by added anhydrous Mg$_2$SO$_4$ (3.8 g, 31.5 mmol). The reaction was filtered through Airfree, Schlenk filter tube, washed with dry THF (80 mL), and evaporated under rotary evaporation at 28° C. to afford the crude product as off-white solid, which was dried under high vacuum for overnight. The dried crude product was purified by Combi-Flash Rf (Teledyne ISCO) using 220 silica column (which was pre-deactivated with 3 column volume of ethyl acetate with 5% TEA) with ethyl acetate/hexane mixture contains 5% TEA as a solvent. After column purification fractions were analyzed by TLC and LC-MS, and pooled together. Solvent was evaporated in a rotary evaporator at 28° C. and the residue was dried under high vacuum to afford the product as a white solid. Yield: 30 g (88%). MS: LC-MS; Calculated: C60H67F3N5O10PSi, 1133.4347; Observed in +Ve mode: 1235.55 (M+Et$_3$N). $^1$H NMR (400 MHz, Chloroform-d) δ 7.78 (s, 1H), 7.40 (ddd, J=9.8, 6.5, 2.2 Hz, 5H), 7.32 (d, J=7.3 Hz, 2H), 7.30-7.09 (m, 15H), 6.99 (d, J=15.5 Hz, 1H), 6.76 (dd, J=8.9, 2.7 Hz, 4H), 6.54 (d, J=15.5 Hz, 1H), 5.12 (t, J=6.1 Hz, 1H), 4.66-4.49 (m, 2H), 4.04 (q, J=7.1 Hz, 1H), 3.81 (q, J=3.0 Hz, 1H), 3.67 (s, 6H), 3.41 (ddt, J=14.8, 10.2, 7.7 Hz, 1H), 3.30-3.13 (m, 4H), 3.12-2.91 (m, 4H), 1.96 (s, 2H), 1.92-1.69 (m, 2H), 1.58 (ddt, J=15.1, 11.6, 8.0 Hz, 1H), 1.50-1.29 (m, 5H), 1.18 (tq, J=15.8, 8.8, 8.0 Hz, 9H), 0.52 (s, 3H). $^{31}$P NMR (162 MHz, CDCl$_3$) δ 150.88 (s). $^{13}$C NMR (101 MHz, CDCl$_3$) δ 171.18, 165.77, 161.89, 158.76, 158.74, 157.85, 157.49, 157.12, 156.76, 149.17, 144.52, 139.69, 136.68, 135.86, 135.53, 135.44, 134.54, 134.30, 131.15, 129.97, 129.89, 129.44, 129.38, 128.09, 127.93, 127.91, 127.18, 122.36, 120.31, 117.44, 114.58, 113.42, 113.39, 111.72, 110.53, 86.65, 86.04, 86.02, 85.67, 79.28, 79.19, 77.42, 77.31, 77.11, 76.79, 73.20, 73.12, 68.05, 68.02, 63.09, 60.41, 55.27, 46.96, 46.60, 45.81, 40.48, 39.56, 38.88, 29.33, 28.52, 27.23, 25.83, 21.04, 17.55, 17.52, 14.20.

Example 7-9. Synthesis of 5-Alkynyl thioacetate-5'-DMT-3'CNE-2'OMe-U Amidite

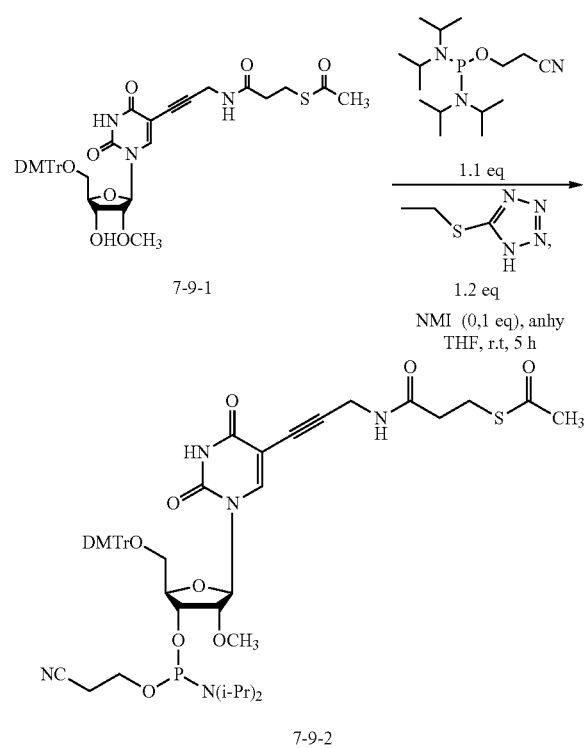

Compound 7-9-1 (5.0 g, 6.72 mmol) was co-evaporated with anhydrous toluene two times (40 mL×2) and dried under high vacuum for overnight. The dried yellow solid was dissolved in anhydrous THF (14 ml, ~0.5 mmol/mL) under argon and to the solution was added 5-ethylthio-1H-tetrazole (1.05 g, 8.07 mmol), N-methylimidazole (0.045 g, 0.044 mL, 0.67 mmol) followed by 2-cynoethyl-N,N,N',N'-tetraisopropylphosphordiamidite (2.23 g, 2.34 mL, 7.39 mmol). The reaction mixture was stirred at room temperature under argon for 5 h. TLC (solvent system: 40% CH$_3$CN/EtOAC/5% TEA) which was pre-equilibrated with the above solvent system indicated the completion of reaction at 5 h, which was also confirmed with LC-MS. The reaction mixture was diluted with EtOAc (100 mL) and the solution was transferred to separating funnel, washed with aq. saturated. NaHCO$_3$ solution (40 mL) and dried over anhydrous Mg$_2$SO$_4$. The dried solution was evaporated under rotary evaporation at bath temperature 28° C. to afford the crude product as off-yellow solid which was further dried under high vacuum for overnight. The dried crude product was purified in Combi-Flash Rf (Teledyne ISCO) using 80 g flash silica column, which was pre-deactivated with 2 column volume (CV 125 mL, 60 mL/min), of ethyl acetate with 5% TEA, followed by equilibration with 20% EtOAc/Hexane for 2 column volume. The compound was purified using Hexane/EtOAc/CH3CN mixture containing 5% TEA as a solvent system. After purification column fractions were analyzed by TLC and LC-MS. Desired fractions were pooled together and evaporated in a rotary evaporator at 28° C. and was dried under high vacuum afforded 7-9-2-CNE amidite as white solid. Yield: 4.8 g (76%). MS: LC-MS; Calculated: C48H58N5O11PS, 943.35; Observed in +Ve mode: m/z 1045.92 (M+Et3N). $^1$H NMR (400 MHz, Chloroform-d) δ 8.36-8.07 (m, 1H), 7.47-7.09 (m, 10H), 6.78 (dt, J=9.1, 3.8 Hz, 4H), 5.87 (dd, J=26.6, 3.1 Hz, 1H), 4.73 (d, J=14.9 Hz, 1H), 4.57-4.30 (m, 1H), 4.21-4.00 (m, 2H), 3.86-3.32 (m, 17H), 3.23 (ddd, J=13.0, 11.2, 2.5 Hz, 1H), 2.91 (td, J=7.0, 2.4 Hz, 2H), 2.54 (q, J=6.1 Hz, 1H), 2.27 (d, J=24.2 Hz, 4H), 1.96 (d, J=7.1 Hz, 3H), 1.21-0.82 (m, 14H). $^{31}$P NMR (162 MHz, CDCl$_3$) δ 150.60 (s), 150.24(s). $^{13}$C NMR (101 MHz, CDCl$_3$) δ 195.80, 169.61, 161.45, 158.70, 158.68, 149.06, 144.75, 144.61, 142.82, 135.67, 135.58, 135.48, 135.38, 130.18, 130.16, 130.12, 128.14, 128.11, 128.09, 128.02, 127.01, 117.69, 117.53, 113.42, 113.38, 113.34, 99.60, 99.33, 88.98, 88.95, 88.50, 88.06, 87.06, 86.85, 83.89, 82.99, 82.62, 77.34, 77.22, 77.02, 76.70, 74.55, 74.40, 69.74, 69.62, 62.04, 61.26, 60.38, 58.97, 58.59, 58.47, 58.45, 57.89, 57.68, 55.34, 55.31, 43.33, 43.21, 35.44, 35.41, 30.54, 29.95, 24.71, 24.65, 24.63, 24.58, 24.56, 24.49, 21.04, 20.50, 20.43, 20.38, 20.31, 14.20.

As readily appreciated by those skilled in the art, compound 7-9-2 can be utilized in oligonucleotide synthesis as a phosphoramidite in accordance with the present disclosure, thereby incorporating a protected thiol group into oligonucleotides. After deprotection, free thiol groups can be utilized to link oligonucleotide monomers to form multimers, by forming one or more disulfide bonds, in accordance with the present disclosure.

As appreciated by a person having ordinary skill in the art, many technologies (e.g., chemistry, reagents, linkers, methods, etc.) can be utilized to prepare oligonucleotides (including those with various 5'-end structures) and to incorporate various chemical moieties, e.g., carbohydrate moieties, lipid moieties, targeting moieties, etc., into oligonucleotides in accordance with the present disclosure, for example but not limited to those described in WO/2010/064146, WO/2011/005761, WO/2013/012758, WO/2014/010250, US2013/0178612, WO/2014/012081, WO/2015/107425, WO/2017/

Example 8. Preparation of WV-2652

To the corresponding oligonucleotide (5'-T*fA*mGfC*mUfU*mCfU*mUfG*mUfC*mCfA*mG*fC*mUqU*mU*mUmU-3' (SEQ ID NO: 3926)) attached to CPG (120 mg, 71 umol/g loading), 1 M diphenyl phosphite in dry pyridine (5 mL) was added then mixed at rt for 30 min. The support was washed with dry ACN (5 mL×3), followed by drying under vacuum. The dried support was then treated with pyridine-H₂O (1:1, v/v) (5 mL) with syringe and mixed at rt for 2 h, followed by washing with dry ACN (5 mL×5) and drying under vacuum. Aliquot of CPG (1 umol, 14.1 mg) was treated with AMA (400 uL) at 35° C. for 2 h. The mixture was isolated by IEX-purification to give WV-2652 (MW: 6968.9; MS Obs. 6966.7).

Example 9. Preparation of WV-2653

To the corresponding oligonucleotide (5'-T*fA*mGfC*mUfU*mCfU*mUfG*mUfC*mCfA*mG*fC*mUqU*mU*mUmU-3' (SEQ ID NO: 3926)) attached to CPG (120 mg, 71 umol/g loading), 1 M diphenyl phosphite in dry pyridine (5 mL) was added then mixed at rt for 30 min. The support was washed with dry ACN (5 mL×3), followed by drying under vacuum. The dried support was then treated with pyridine-H₂O (1:1, v/v) (5 mL) with syringe and mixed at rt for 2 h, followed by washing with dry ACN (5 mL×5) and drying under vacuum. Aliquot of CPG (1 umol, 14.1 mg) was treated with 0.15 M 3-Phenyl-1,2,4-dithiazoline-5-one in BSA-ACN (1:9, v/v) for 1 h. The support was mixed with AMA (400 uL) at 35° C. for 2 h. The mixture was isolated by IEX-purification to give WV-2653 (MW: 7000.9; MS Obs. 6997.3).

Example 10. Preparation of WV-2654

The corresponding oligonucleotide (5'-T*fA*mGfC*mUfU*mCfU*mUfG*mUfC*mCfA*mG*fC*mUqU*mU*mUmU-3' (SEQ ID NO: 3926)) attached to CPG (1 umol, 14.1 mg) was treated with 0.1 M n-Pr phosphoramidite (Phosphoramidous acid, N,N-bis(1-methylethyl)-, propyl 2-cyanoethyl ester) and 0.5 M ETT in ACN for 15 min, followed by the treatment with 1.1 M TBHP in decan-DCM (1:4, v/v) for 15 min. The support was mixed with AMA (400 uL) at 35° C. for 2 h. The mixture was isolated by IEX-purification to give WV-2654 (MW: 7026.9; MS Obs. 7022.0).

Example 11. Preparation of WV-2655

The corresponding oligonucleotide (5'-T*fA*mGfC*mUfU*mCfU*mUfG*mUfC*mCfA*mG*fC*mUqU*mU*mUmU-3' (SEQ ID NO: 3926)) attached to CPG (1 umol, 14.1 mg) was treated with 0.1 M n-Pr phosphoramidite (Phosphoramidous acid, N,N-bis(1-methylethyl)-, propyl 2-cyanoethyl ester) and 0.5 M ETT in ACN for 15 min, followed by the treatment with 0.15 M 3-Phenyl-1,2,4-dithiazoline-5-one in ACN for 15 min. The support was mixed with AMA (400 uL) at 35° C. for 2 h. The mixture was isolated by IEX-purification to give WV-2655 (MW: 7043.0; Obs. 7040.9).

Example 12. Preparation of WV-2656

To the corresponding oligonucleotide (5'-fA*mGfC*mUfU*mCfU*mUfG*mU fC*mCfA*mG*fC*mUqU*mU*mUmU-3' (SEQ ID NO: 3927)) attached to CPG (120 mg, 71 umol/g loading), 0.1 M Dimethyl C3 phosphoroamidite (Phosphoramidous acid, N,N-bis(1-methylethyl)-, 3-[bis(4-methoxyphenyl)phenylmethoxy]-2,2-dimethylpropyl 2-cyanoethyl ester) and 0.5 M ETT in dry ACN (5 mL) was added and mixed at rt for 15 min. The support was washed with dry ACN (5 mL×3). To the support, 0.1 M 1,2,4-dithiazole-5-thione in dry pyridine (5 mL) was added then mixed at rt for 15 min. The support was washed with dry ACN (5 mL×3). To the support, 3% TCA in DCM (5 mL) was added in continuous flow at rt for 2 min. The support was washed with dry ACN (5 mL×3). To the aliquot of CPG (2 umol, 28.1 mg), 1 M diphenyl phosphite in dry pyridine (1 mL) was added then mixed at rt for 30 min. The support was washed with dry ACN (2 mL×3), followed by drying under vacuum. The dried support was then treated with pyridine-H₂O (1:1, v/v) (1 mL) with syringe and mixed at rt for 2 h, followed by washing with dry ACN (5 mL×5) and drying under vacuum. The support was mixed with AMA (400 uL) at 35° C. for 2 h. The mixture was isolated by IEX-purification to give WV-2656 (MW: 6830.8; MS Obs. 6831.1).

Example 13. Preparation of WV-2657

To the corresponding oligonucleotide (5'-fA*mGfC*mUfU*mCfU*mUfG*mU fC*mCfA*mG*fC*mU*fU*mU*mUmU-3' (SEQ ID NO: 3927)) attached to CPG (120 mg, 71 umol/g loading), 0.1 M Dimethyl C3 phosphoroamidite (Phosphoramidous acid, N,N-bis(1-methylethyl)-, 3-[bis(4-methoxyphenyl)phenylmethoxy]-2,2-dimethylpropyl 2-cyanoethyl ester) and 0.5 M ETT in dry ACN (5 mL) was added and mixed at rt for 15 min. The support was washed with dry ACN (5 mL×3). To the support, 0.1 M 1,2,4-dithiazole-5-thione in dry pyridine (5 mL) was added then mixed at rt for 15 min. The support was washed with dry ACN (5 mL×3). To the support, 3% TCA in DCM (5 mL) was added in continuous flow at rt for 2 min. The support was washed with dry ACN (5 mL×3). To the aliquot of CPG (2 umol, 28.1 mg), 1 M diphenyl phosphite in dry pyridine (1 mL) was added then mixed at rt for 30 min. The support was washed with dry ACN (2 mL×3), followed by drying under vacuum. The dried support was then treated with pyridine-H₂O (1:1, v/v) (1 mL) with syringe and mixed at rt for 2 h, followed by washing with dry ACN (5 mL×5) and drying under vacuum. The support was treated with 0.15 M (1S)-(+)-(10-Camphorsulfonyl)-oxaziridine in BSA-ACN (1:9, v/v) for 1 h. The support was mixed with AMA (400 uL) at 35° C. for 2 h. The mixture was isolated by IEX-purification to give WV-2657 (MW: 6846.8; MS Obs. 6844.7).

Example 14. Preparation of WV-2658

To the corresponding oligonucleotide (5'-fA*mGfC*mUfU*mCfU*mUfG*mUfC*mCfA*mG*fC* mUqU*mU*mUmU-3' (SEQ ID NO: 3927)) attached to CPG (120 mg, 71 umol/g loading), 0.1 M Dimethyl C3 phosphoroamidite (Phosphoramidous acid, N,N-bis(1-methylethyl)-, 3-[bis(4-methoxyphenyl)phenylmethoxy]-2,2-dimethylpropyl 2-cyanoethyl ester) and 0.5 M ETT in dry ACN (5 mL) was added and mixed at rt for 15 min. The support was washed with dry ACN (5 mL×3). To the support, 0.1 M 1,2,4-dithiazole-5-thione in dry pyridine (5 mL) was added then mixed at rt for 15 min. The support was washed with dry ACN (5 mL×3). To the support, 3% TCA in DCM (5 mL) was added in continuous flow at rt for 2 min. The support was washed with dry ACN (5 mL×3). To the aliquot of CPG (2 umol, 28.1 mg), 1 M diphenyl phosphite in dry pyridine (1 mL) was added then mixed at rt for 30 min. The support was washed with dry ACN (2 mL×3), followed by drying under vacuum. The dried support was then treated with pyridine-H2O (1:1, v/v) (1 mL) with syringe and mixed at rt for 2 h, followed by washing with dry ACN (5 mL×5) and drying under vacuum. The support was treated with 0.15 M 3-Phenyl-1,2,4-dithiazoline-5-one in BSA-ACN (1:9, v/v) for 15 min. The support was mixed with AMA (400 uL) at 35° C. for 2 h. The mixture was isolated by IEX-purification to give WV-2658 (MW 6862.9; MS Obs. 6860.7).

Example 15. Preparation of WV-3122

Oligonucleotide WV-3122 was synthesized at a scale of 50 umol using standard cyanoethyl phosphoramidite chemistry up through the final T base and was left on CPG support with the DMT protecting group on (5'-T*fG*mUfC*mCfA*mGfC*mUfU*mUfA*mUfU*mG fGmGfAmG*T*mU-3' (SEQ ID NO: 3928)). The final phosphate (PO) was then added to the 5' end of the oligonucleotide on the synthesizer. Briefly, the DMT protecting group was removed using 3% trichloroacetic acid in dichloromethane. During the coupling step, equal volumes of bis-cyanoethyl-N,N-diisopropyl CED phosphoramidite (0.1M in acetonitrile, ChemGenes Corporation catalog No. CLP-1454) and 5-ethylthio tetrazole (0.5M in acetonitrile) were added with a contact time of 5 min. The coupling step was repeated. Oxidation was performed using 0.02M iodine in tetrahydrofuran/pyridine/water. The oligonucleotide was deprotected by first washing with 20% diethylamine in acetonitrile on support for 15 minutes. The support was washed with acetonitrile and dried. The oligonucleotide was then cleaved and further deprotected using ammonium hydroxide/ethanol (3:1 v/v) at 50° C. overnight. Target Mass 7062.0; Observed 7062.4.

Example 16. Preparation of WV-7645

Oligonucleotide WV-7645 was synthesized at a scale of 50 umol using standard cyanoethyl phosphoramidite chemistry up to the penultimate base (fG) and was left on CPG support with the DMT protecting group on (5'-fG*mUfC*mCfA*mGfC*mUfU*mUfA*mUfU*mG*fG* mG*fA*mG*fG*mC*T*mU-3' (SEQ ID NO: 3929)). The final base (5MRdT) was then added to the 5' end of the oligonucleotide on the synthesizer using standard coupling conditions. Briefly, the DMT protecting group was removed using 3% trichloroacetic acid in dichloromethane. During the coupling step, equal volumes of 5'-(R)—C-Me-5'-DMT-dT-CNE phosphoramidite (0.1 M in acetonitrile) and 5-ethylthio tetrazole (0.5 M in acetonitrile) were added with a contact time of 5 min. The coupling step was repeated. Sulfurization was performed using 0.1M DDTT in pyridine. The final phosphate (PO) was then added to the 5' end of the oligo on the synthesizer. The DMT protecting group was removed using 3% trichloroacetic acid in dichloromethane. During the coupling step, equal volumes of bis-cyanoethyl-N,N-diisopropyl CED phosphoramidite (0.1 M in acetonitrile, ChemGenes Corporation catalog No. CLP-1454) and 5-ethylthio tetrazole (0.5 M in acetonitrile) were added with a contact time of 5 min. The coupling step was repeated. Oxidation was performed using 0.02 M iodine in tetrahydrofuran/pyridine/water. The oligonucleotide was deprotected by first washing with 20% diethylamine in acetonitrile on support for 10 minutes. The support was washed with acetonitrile and dried. The oligonucleotide was then cleaved and further deprotected using ammonium hydroxide at 40° C. overnight, giving ca. 31 mg crude at 68% purity. The crude product was further purified to provide the final product. MW: 7839.6. MS Observed: 7838.6.

Example 17. Example Procedure for Incorporation of Amino Linker

Oligonucleotide WV-3973 was synthesized at a scale of 50 umol using standard cyanoethyl phosphoramidite chemistry up through the final Aeo base leaving the DMT protecting group on (5'-Aeo*Geo*m5Ceo*Teo*Teo*C*T*T*G*T*C*C*A*G*C* Teo*Teo*Teo*Aeo*Teo-3' (SEQ ID NO: 3930)). The amine linker was then added to the 5' end of the oligo on the synthesizer. Briefly, the DMT protecting group was removed using 3% trichloroacetic acid in dichloromethane. During the coupling step, equal volumes of TFA-amino C6 CED phosphoramidite (0.15M, ChemGenes Corporation catalog no. CLP-1553 or Glen Research catalog no. 10-1916) and 5-ethylthio tetrazole (0.5M in acetonitrile) were added with a contact time of 5 min. The coupling step was repeated. Oxidation was performed using 0.02M iodine in tetrahydrofuran/pyridine/water. The oligonucleotide was deprotected by first washing with 20% diethylamine in acetonitrile on support for 15 minutes. The support was washed with acetonitrile and dried. The oligo was then cleaved and further deprotected using ammonium hydroxide at 50° C. overnight. Target Mass: 7288.0. Observed: 7286.3.

Example 18. Example Procedure for Incorporation of Carbohydrate Moieties in Solution Phase—Preparation of WV-5287

A solution of a carbohydrate-containing carboxylic acid compound (2 equivalent), HATU (1.8 equivalent) and diisopropylethylamine (8 equivalent) in dry acetonitrile (or dry DMF) was vortexed for 2 minutes. To this solution was added a solution of oligonucleotide (1 equivalent) in water. Reaction mixture was vortexed for 2 minutes and kept for 60 minutes. By this time the reaction typically went to completion. The solvent was removed under vacuum and diluted with water appropriately and purified by RP column chromatography or IEX chromatography. In case carbohydrate (e.g., GalNAc) moieties were protected as acetates, $NH_3$ treatment was performed before purification. An example is described below.

Preparation of WV-5287—Example Incorporation of Carbohydrate Moieties by Conjugation with WV-2422

A solution of a carboxylic acid containing three carbohydrate moieties (see scheme below, 17 mg, 10.8 umol), HATU (3.7 mg, 9.72 umol), and DIPEA (8 ul, 43.2 umol) was thoroughly vortexed for 2 minutes in 3 mL dry DMF. To this solution was added WV-2422 (40.6 mg, 5.4 umol) in 1.5 mL water and the mixture was shaken for 60 minutes. Completion of the reaction was monitored by LC-MS (~1 hour). After the reaction was complete, solvent was removed under reduced pressure and the crude product was purified by IEX. Molecular weight calculated: 8961. Deconvoluted Mass: 8962.

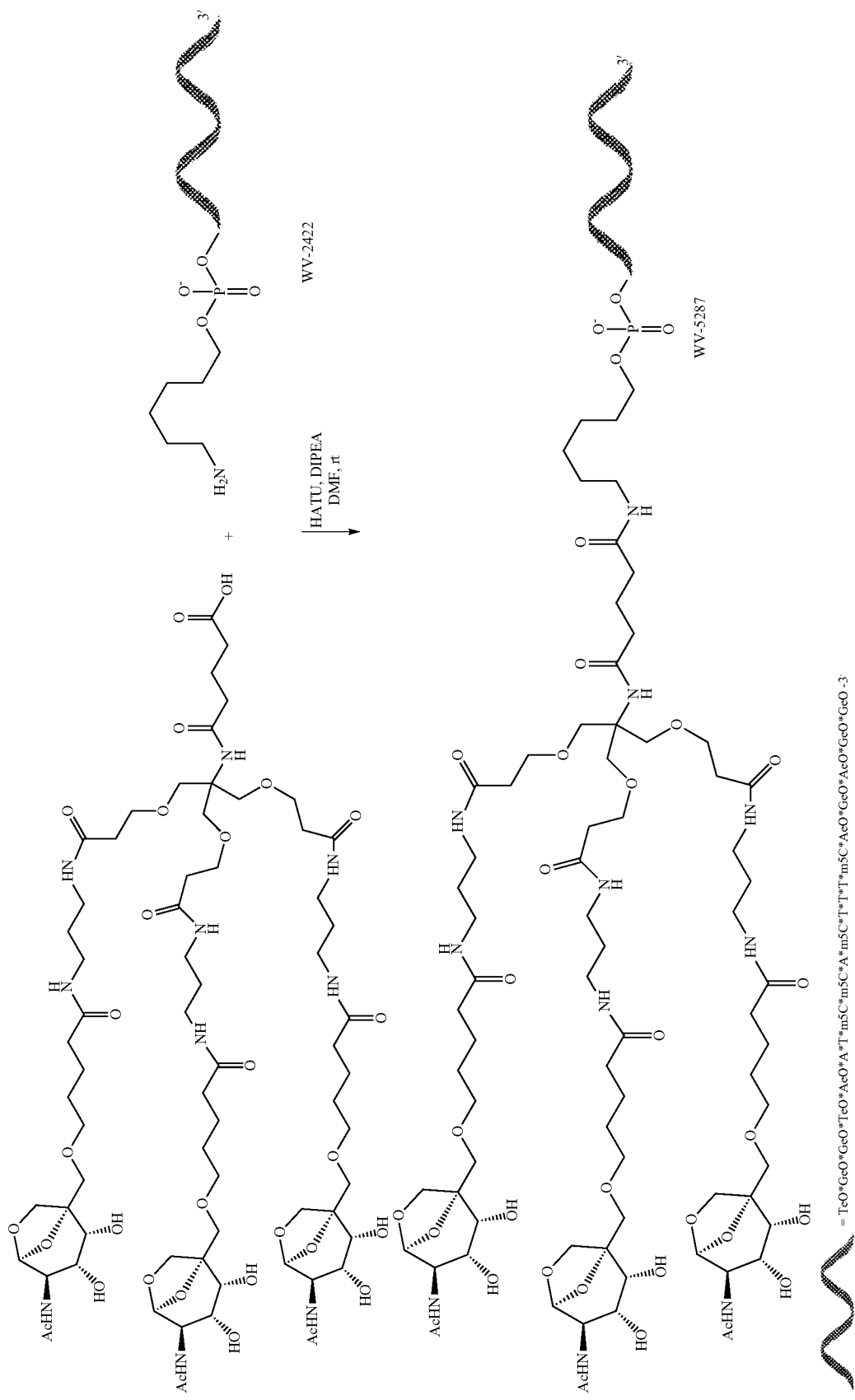

Example 19. Example Procedure for Incorporation of Carbohydrate Moieties in Solution Phase—Preparation of WV-3969

A solution of a carboxylic acid containing GalNac moieties (38 mg, 20 umol), HATU (7 mg, 17.9 umol), and DIPEA (15 ul, 80 umol) was thoroughly vortexed for 2 minutes in 4 ml dry AcCN. To this solution was added WV-2422 (50 mg, 6.7 umol) in 2 ml water and the mixture was shaken for 60 minutes. Completion of the reaction was monitored by LC-MS (~1 hour). After the reaction was complete, solvent was removed under reduced pressure. The crude product was dissolved in 30% ammonia solution and heated at 50° C. for three hours and the solvent was removed under vacuum. Crude product obtained was purified by IEX. Molecular weight calculated: 9025. Deconvoluted Mass: 9024.

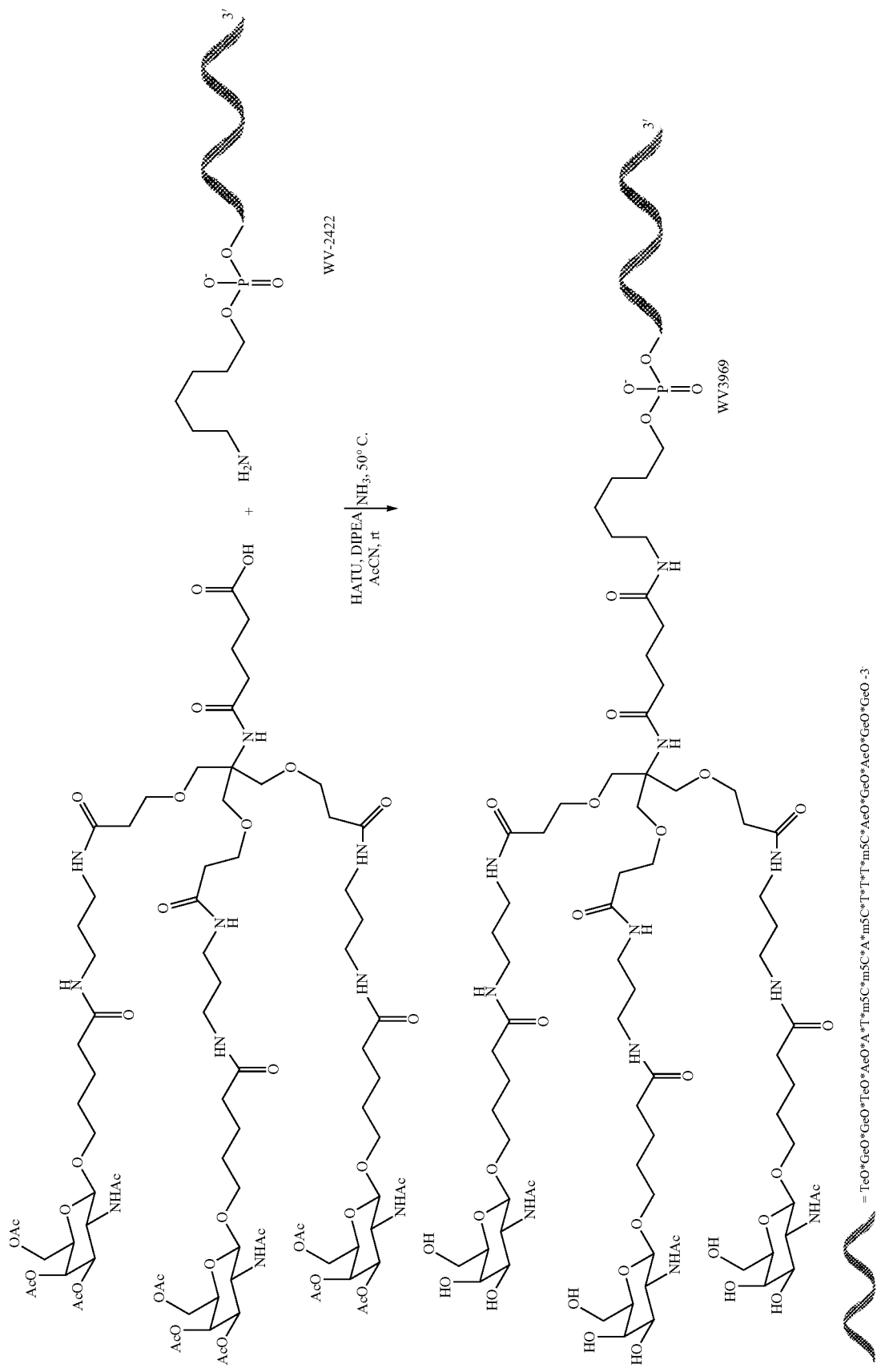

Example 20. Preparation of WV-8095

Synthesis of WV-8095 was performed iteratively on an ÄKTA OP100 synthesizer (GE healthcare) using a 12-mL stainless steel column reactor on a 250 umol scale using NittoPhase HL (Loading 190 umol/g, Kinovate Life Sciences). During synthesis, chain elongation consisted of four steps namely detritylation, coupling, oxidation/thiolation and capping. Detritylation was performed using 3% DCA in toluene with a UV watch command set at 436 nm. Following detritylation, 4 CV of ACN was used to wash off the detritylation reagent. Coupling was performed using 0.175 M amidite solutions in ACN and 0.6M CMIMT in ACN for stereo-defined monomers and 0.6 M ETT for standard amidites. All phosphoramidite and ETT solutions were prepared and dried over 3 Å molecular sieves for at least 3 hours prior to synthesis. The CMIMT solution was dried over Trap Pak sieves (Bioautomation) for 90 minutes prior to use. Coupling was performed by mixing 40% (by volume) of amidite solution with 60% of the activator in-line prior to addition to the column. The coupling mixture was then recirculated for a minimum of 8 minutes to enhance the coupling efficiency. Following coupling, the column was washed with no less than 2CV of ACN. The column was then treated with Capping B solution (acetic anhydride, lutidine, ACN) mixture for 2 CV to acetylate the chiral axillary amine for stereo-defined couplings. Following this step the column was washed with ACN for at least 2 CV. Thiolation was then performed with 0.1 M POS in ACN with a contact time of 6 min for 2 CV. After a 2 CV thio wash step using ACN, capping was performed using 0.5 CV of Capping A (20% N-methylimidazole in Acetonitrile (ACN)) and Capping B reagents mixed inline (1:1) followed by a 2 CV ACN wash. For cycles to form natural phosphate linkages, oxidation was performed using 1.1 M TBHP solution (in DCM and decane) for 2 min and 77 equivalents.

Cleavage and Deprotection of WV-8095: The DPSE auxiliary on WV-8095 were removed by treating the oligonucleotide bound solid support with a 1M solution of TEA.HF made by mixing TEA.3HF, TEA, DMF, and water in a v/v ratio of 10:9:61:20. The mixture was then heated at 50° C. for 90 min. The mixture was cooled (ice bath) and then filtered (10 micron). The cake was washed with ACN and water and dried under vacuum. The dry cake was then taken up in ammonia:methylamine mixture (1:1, 20 mL) and the mixture shaken at room temperature for 3.0 hrs. The mixture was then filtered (10 micron) and the cake washed with water (3×20 mL). The filtrate liquor was obtained and analyzed by UPLC and a purity of 23.69% FLP found. The mixture was then neutralized with acetic acid to a pH value 6.1. Quantitation was done using a Nano Drop one spectrophotometer (Thermo Scientific) and a yield of about 21,000 ODs obtained.

Purification of WV-8095: The crude WV-8095 was desalted on a 2K generated cellulose membrane until the conductivity was ≤3 mScm$^{-1}$. The desalted material (142 mL) was then diluted with 20 mM NaOH to 250 mL and loaded on to a Waters AP2 column (2 cm×20 cm) packed with TSKgel SuperQ 5PW (Tosoh Biosciences). Purification was performed on an ÄKTA 100 Explorer (GE Healthcare) using 20 mM NaOH and 2.5 M NaCl as eluents. Fractions were analyzed for purity. In some embodiments, purification after this initial purification may not be as high (for example, the pooled fraction having a purity of about 65%). If desired, further purification can be performed to increase purity. For example, a pooled fraction (162 mL, 7785 OD) was diluted to 1500 mL and re-purified on Source 15Q using the conditions described above, increasing the purity from about 65% to ≥83% with a yield of 2385 OD.

Desalting of WV-8095: The purified WV-8095 sample (2385 OD) was then desalted on 2K generated cellulose membrane with no material loss. The desalted material was then lyophilized to obtain 75 mg of WV-8095 as a white powder. MW (Calc.): 7953.95; MS (Found): 7953.2.

Example 21. Preparation of WV-8061

Triantennay GalNAc (30.4 mg, 1.6 eq), and HATU (5.44 mg, 1.5 eq.) were transferred into a 50-mL plastic tube. Anhydrous acetonitrile (1.5 mL) was then added to the tube to dissolve the mixture. This was followed by the addition of DIPEA (d=0.742, 16.86 uL, 10 eq) into the tube. The mixture was then shaken for 10 min at room temperature. This mixture was then added to WV-8095 (75 mg) dissolved in water (3.0 mL) and the mixture was shaken for 60 min at 37° C. The progress of the reaction was monitored by UPLC. It was found that the reaction was complete after 1 h. The reaction mixture was concentrated under vacuum (by speed vac) to remove acetonitrile. The resultant GalNAc-conjugated oligo WV-8061 was then treated with conc. ammonium hydroxide (2 mL) for 1 h at 37° C. The formation of the final product was monitored by UPLC. The ammonia hydroxide in the sample was evaporated under vacuum (by speed vac) overnight. The conjugated samples were dissolved in water and purified by reversed phase HPLC. Following purification the material was desalted and lyophilized to obtain WV-8061 with a yield of 1400 OD. MW (Calc.): 9562.8; MS (Found): 9561.7.

Example 22. Preparation of WV-8094—Example Vinyl Phosphonate Deprotection

DMT-5'-VP-dT amidite was utilized to incorporate 5'-VP-dT. To deprotect the 5'—VP group, after preparation of the oligonucleotide chain, into a plastic container with the oligonucleotide bound support (250 umol), a bright yellow mixture of TMSI, DCM and pyridine (125 mL) in the v/v ratio of 3:96:2 was added and the mixture shaken at room temperature for 30 min. The TMSI solution was then decanted and the solid support treated with a mixture of 2-Dodecane Thiol, TEA and ACN (125 mL×3) in the v/v ratio of 24:38:38. A final charge of the 2-Dodecane mixture was added and allowed to stand for 45 min. The mixture was then filtered, the support washed with ACN (50 mL×3) and then standard cleavage and base deprotection performed as described for WV-8095. MW (Calc.): 8028.9; MS (Found): 8030.2.

Example 23. Preparation of 5'-triazole

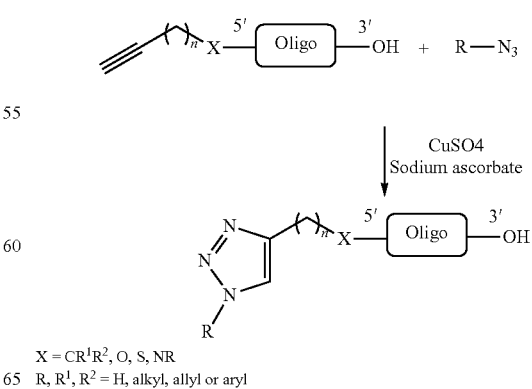

$X = CR^1R^2$, O, S, NR
R, $R^1$, $R^2$ = H, alkyl, allyl or aryl

A mixture of the corresponding azide (1.5 umol), 5'-alkynyl oligonucleotide (1 umol), CuSO$_4$ (10 umol) sodium ascorbate (100 umol) and trishydroxypropyltriazole (70 umol) in 0.2 M NaCl solution is stirred for 1 hour. After completion of reaction, purification of the crude product is done by RP-HPLC or IEX-HPLC. After HPLC purification, pure fractions are combined and solvent is removed under vacuum. Residue is dissolved in water, desalted and lyophilized to give the product.

In some embodiments, n is 0-10. In some embodiments, n is 1-10. In some embodiments, X is —C(R$^1$)(R$^2$)—, wherein each of R$^1$ and R$^2$ is independently R. In some embodiments, X is —O—. In some embodiments, X is —S—. In some embodiments, X is —NR—. In some embodiments, each of R, R$^1$ and R$^2$ is independently —H, or an optionally substituted group selected from alkyl, allyl and aryl. In some embodiments, each of R, R$^1$ and R$^2$ is independently —H, or an optionally substituted group selected from C$_{1-10}$ alkyl, C$_{3-10}$ allyl and C$_{6-10}$ aryl. In some embodiments, R is —H. In some embodiments, R$^1$ is —H. In some embodiments, R$^2$ is —H.

Example 24. Provided Technologies Provide High Activities

For ssRNAi, it has been widely accepted prior to the present disclosure that 5'-phosphorylation is required for activity. In some embodiments, the present disclosure, surprisingly, demonstrated that with features provided in the present disclosure, oligonucleotides without 5'-phosphorylation can deliver activities comparable to, or higher than, oligonucleotides of traditional ssRNAi designs with 5'-phosphorylation. For examples, see data provided in the Tables.

Example 25. Provided 5'-End Structures Provide High Activities

In some embodiments, the present disclosure provides various 5'-end structures. Among other things, the present disclosure demonstrated that oligonucleotides comprising provided 5'-end modifications can be highly active and/or stable, for example, when used as ssRNAi reagents. For example, as shown in Table 46, provided oligonucleotide WV-7645 demonstrated surprisingly high activity, with an IC50 as low as 7 pM.

Example 26. Provided Technologies Provide High Activity and/or Selectivity/Specificity Among other things, the present disclosure provides technologies that can achieve high activity and/or selectivity/specificity, including knockdown of target gene expression (e.g., mRNA level) and/or target protein level. As demonstrated herein, including, but not limited to, the data in the Tables below, provided technologies can selectively reduce the level of one mRNA but not a homologous mRNA which differs from it by only one base. Thus, in some embodiments, the present disclosure provides technologies that can achieve allele-specific reduction of levels of transcripts/products of a disease-associated allele, while maintaining levels of transcripts/products of a normal allele; see, e.g., Table 61. Oligonucleotides are described in detail in Table 1A.

Tables 2 and 3 show the activity of oligonucleotides to APOB. Without wishing to be bound by any particular theory, the present disclosure suggests that some oligonucleotides may be capable of mediating knockdown via a RNaseH-mediated mechanism (e.g., ONT-41) or a RISC-mediated ssRNAi (single-stranded RNA interference) mechanism (e.g., WV-2112, WV-2146, and WV-2147); and some oligonucleotides have a hybrid format (e.g., WV-2113, WV-2148 and WV-2149), wherein a hybrid format comprises structures associated with both RNaseH-mediated knockdown and RISC-mediated single-stranded RNA interference.

Table 2. Table 2 shows the IC$_{50}$ and 95% CI (confidence interval) (nM) for a single-stranded RNAi agent, WV-2112, which targets APOB. A reference oligonucleotide was ONT-41, which is equivalent to Mipomersen, which acts via a RNase H mechanism, rather than single-stranded RNA interference. Cells used were Hep3B, and oligonucleotides for APOB assays were delivered using Lipofectamine® 2000 transfection reagent (ThermoFisher, Grand Island, N.Y.).

TABLE 2

Activity of APOB oligonucleotide.

| Oligonucleotide | IC50 (nM) | 95% CI (nM) |
|---|---|---|
| ONT-41 | 1.0 | 0.52 to 1.93 |
| WV-2112 | 1.73 | 0.92 to 3.22 |

Table 3. Table 3 shows the in vitro potency (Tables 3A, 3B and 3C) and IC$_{50}$ (Table 3D) for different single-stranded RNAi agents, which target APOB, in Hep3B (or 3b or 3B) cells (tested at 48 hours). Tested oligonucleotides are: ONT-41, WV-2112, WV-2113, WV-2146, WV-2147, WV-2113, WV-2148, and WV-2149. ONT-41 is an antisense oligonucleotide which knocks down the target transcript via a RNase H-knockdown; other tested oligonucleotides are single-stranded RNAi agents. Cells used were Hep3B, and oligonucleotides were delivered using Lipofectamine® 2000 transfection reagent (ThermoFisher, Grand Island, N.Y.). Table 3D presents the IC50 of various oligonucleotides. In some experiments described herein, the designation of an oligonucleotide is followed by a prefix such as 3b, –3b; –Huh, _Huh, and the like, indicating that the oligonucleotide was tested in Hep3B; or Huh7 cells, respectively.

Table 3A. Activity of APOB Oligonucleotides.

In Tables 3A, B and C and other tables wherein the Conc. is indicated as (exp 10): the Conc. is presented as an exponent (exp) of 10; e.g., 1.398 indicates 10$^{1.398}$ nM. In various columns, data from replicate experiments is shown. In Tables 3A, B and C and other tables wherein the activity level has a high number around 1: Numbers indicate residual mRNA level, wherein 1 represents 100% mRNA level or no knockdown and O represents 0% mRNA level or 100% knockdown (e.g., 0.020 in column 2, row 2 represents 2.0% residual mRNA level relative to control, or 98.0% knockdown).

TABLE 3A

Activity of APOB oligonucleotides.

| Conc. (exp 10) (nM) | ONT-41 | | WV-2112 | | WV-2113 | |
|---|---|---|---|---|---|---|
| 1.398 | 0.020 | 0.021 | 0.111 | 0.105 | 0.028 | 0.025 |
| 0.792 | 0.063 | 0.101 | 0.263 | 0.245 | 0.152 | 0.139 |
| 0.204 | 0.296 | 0.407 | 0.537 | 0.694 | 0.436 | 0.458 |
| −0.398 | 0.842 | 0.738 | 0.803 | 0.928 | 0.713 | 0.754 |
| −1.000 | 0.903 | 0.819 | 1.066 | 1.112 | 0.872 | 0.884 |
| −1.602 | 0.825 | 1.052 | 0.974 | 1.183 | 0.819 | 0.988 |

TABLE 3A-continued

Activity of APOB oligonucleotides.

| Conc. (exp 10) (nM) | ONT-41 | | WV-2112 | | WV-2113 | |
|---|---|---|---|---|---|---|
| −2.204 | 1.135 | 0.988 | 1.052 | 1.208 | 0.916 | 1.135 |
| −2.824 | 1.037 | 1.143 | 1.096 | 1.081 | 0.988 | 1.225 |

Table 3B. Activity of APOB Oligonucleotides.

TABLE 3B

Activity of APOB oligonucleotides.

| Conc. (exp 10) (nM) | WV-2112 | | WV-2146 | | WV-2147 | |
|---|---|---|---|---|---|---|
| 1.398 | 0.111 | 0.105 | 0.127 | 0.088 | 0.180 | 0.162 |
| 0.792 | 0.263 | 0.245 | 0.308 | 0.245 | 0.436 | 0.313 |
| 0.204 | 0.537 | 0.694 | 0.600 | 0.579 | 0.579 | 0.564 |
| −0.398 | 0.803 | 0.928 | 0.825 | 0.733 | 0.903 | 0.749 |
| −1.000 | 1.066 | 1.112 | 1.052 | 0.808 | 1.016 | 0.759 |
| −1.602 | 0.974 | 1.183 | 0.884 | 1.183 | 0.854 | 1.096 |
| −2.204 | 1.052 | 1.208 | 0.988 | 0.954 | 0.797 | 0.941 |
| −2.824 | 1.096 | 1.081 | 0.995 | 0.922 | 1.052 | 0.922 |

Table 3C. Activity of APOB Oligonucleotides.

TABLE 3C

Activity of APOB oligonucleotides.

| Conc. (exp 10) (nM) | WV-2113 | | WV-2148 | | WV-2149 | |
|---|---|---|---|---|---|---|
| 1.398 | 0.028 | 0.025 | 0.006 | 0.005 | 0.021 | 0.016 |
| 0.792 | 0.152 | 0.139 | 0.037 | 0.019 | 0.072 | 0.037 |
| 0.204 | 0.436 | 0.458 | 0.278 | 0.224 | 0.335 | 0.298 |
| −0.398 | 0.713 | 0.754 | 0.537 | 0.508 | 0.708 | 0.529 |
| −1.000 | 0.872 | 0.884 | 0.781 | 0.625 | 0.754 | 0.583 |
| −1.602 | 0.819 | 0.988 | 0.675 | 1.089 | 0.786 | 0.928 |
| −2.204 | 0.916 | 1.135 | 0.831 | 0.713 | 0.825 | 0.759 |
| −2.824 | 0.988 | 1.225 | 1.023 | 0.872 | 0.890 | 0.775 |

Table 3D. Activity of APOB Oligonucleotides. IC50 is represented in nM.

TABLE 3D

Activity of APOB oligonucleotides. IC50 is represented in nM.

| Oligonucleotide | IC 50 (nM) |
|---|---|
| ONT-41 | 1.00 |
| WV-2112 | 1.70 |
| WV-2113 | 1.60 |

As shown in Tables 4 to 11, various oligonucleotides were constructed and tested for their ability to mediate knockdown of ACVR2b in vitro. Without wishing to be bound by any theory, the present disclosure suggests that at least some of the oligonucleotides in Tables 4 to 11 may be capable of mediating RISC-mediated ssRNAi activity.

Table 4. Tables 4A to 4D show the in vitro potency for different single-stranded RNAi agents, which target ACVR2B. Tested oligonucleotides are: Table 4A, WV-3755 to WV-3764; Table 4B, WV-3981 to WV-3985 and WV-4007 to WV-4011; Table 4C, WV-4012 to WV-4017 and WV-4264 to WV-4267; and Table 4D, WV-4268 to WV-4277. Cells used were rhabdomyosarcoma RD cells and oligonucleotides for ACVR2B assays were delivered using Lipofectamine® 2000 transfection reagent (ThermoFisher, Grand Island, N.Y.).

In Tables 4 to 11, including various parts thereof (e.g., A, B, C, D, etc.): Oligonucleotides were tested at 1, 5 and 25 nM. Data from replicate experiments are shown. Numbers indicate residual mRNA level (e.g., 1.135 in column 2, row 2 represents 113.5% residual mRNA level relative to control, or no knockdown).

TABLE 4A

Activity of ACVR2B oligonucleotides.

| | 1 nM | | 5 nM | | 25 nM | |
|---|---|---|---|---|---|---|
| WV-3755 | 1.135 | 0.948 | 1.477 | 1.584 | 1.112 | 1.477 |
| WV-3756 | 1.225 | 0.837 | 1.782 | 1.045 | 1.457 | 1.269 |
| WV-3757 | 0.854 | 0.719 | 1.151 | 0.714 | 0.854 | 0.765 |
| WV-3758 | 0.652 | 0.891 | 0.749 | 0.719 | 1.016 | 1.112 |
| WV-3759 | 0.719 | 0.770 | 0.948 | 1.135 | 0.843 | 1.260 |
| WV-3760 | 1.128 | 0.825 | | 0.734 | 0.916 | 1.059 |
| WV-3761 | 1.277 | 1.135 | 0.849 | 0.935 | 0.600 | 0.326 |
| WV-3762 | 1.350 | 0.942 | 0.961 | 0.481 | 0.481 | 0.269 |
| WV-3763 | 1.379 | 0.814 | 0.754 | 0.885 | 0.781 | 0.596 |
| WV-3764 | 1.089 | 0.849 | 1.082 | 0.849 | 1.009 | 0.744 |

TABLE 4B

Activity of ACVR2B oligonucleotides.

| | 1 nM | | 5 nM | | 25 nM | |
|---|---|---|---|---|---|---|
| WV-3981 | 1.488 | 1.341 | 0.982 | 1.269 | 1.794 | 1.286 |
| WV-3982 | 1.045 | 1.002 | 1.260 | 0.909 | 1.128 | 0.968 |
| WV-3983 | 0.903 | 0.916 | 0.754 | 1.112 | 0.530 | 0.922 |
| WV-3984 | 1.408 | 0.885 | 1.135 | 0.442 | 1.059 | 0.825 |
| WV-3985 | 0.729 | 1.175 | 1.360 | 0.982 | 1.398 | 0.995 |
| WV-4007 | 1.573 | 0.471 | 0.572 | 0.604 | | 0.427 |
| WV-4008 | 0.849 | 0.948 | 1.159 | 0.975 | 0.786 | 0.600 |
| WV-4009 | 0.739 | 0.808 | 0.592 | 0.621 | 0.685 | 0.396 |
| WV-4010 | 0.369 | | 0.288 | | | |
| WV-4011 | 0.410 | 0.278 | 0.433 | 0.165 | | 0.152 |

TABLE 4C

Activity of ACVR2B oligonucleotides.

| | 1 nM | | 5 nM | | 25 nM | |
|---|---|---|---|---|---|---|
| WV-4012 | 0.613 | 0.421 | 0.235 | 0.245 | 0.087 | 0.098 |
| WV-4013 | 0.626 | 0.530 | 0.385 | 0.407 | 0.111 | 0.117 |
| WV-4014 | 0.526 | 0.879 | 0.349 | 0.522 | 0.410 | 0.232 |
| WV-4015 | 0.564 | 1.045 | 0.352 | 0.445 | 0.396 | 0.217 |
| WV-4016 | 1.089 | 0.760 | 0.825 | 0.639 | 0.247 | 0.382 |
| WV-4017 | 0.803 | 0.724 | 0.541 | 0.639 | 0.302 | 0.235 |
| WV-4264 | | 1.617 | | 1.857 | 2.757 | 1.651 |
| WV-4265 | 1.217 | 1.217 | 1.135 | 1.234 | 1.067 | 1.097 |
| WV-4266 | 0.390 | 0.471 | 0.639 | 0.866 | 0.808 | 0.515 |
| WV-4267 | 1.023 | 0.860 | 0.843 | 0.639 | 0.643 | 0.604 |

TABLE 4D

Activity of ACVR2B oligonucleotides.

| | 1 nM | | 5 nM | | 25 nM | |
|---|---|---|---|---|---|---|
| WV-4268 | 0.719 | 1.030 | 1.089 | 0.955 | 1.128 | 1.225 |
| WV-4269 | 0.897 | 0.820 | 0.724 | 0.626 | 0.342 | 0.522 |
| WV-4270 | 0.714 | 0.729 | 0.484 | 0.382 | 0.234 | 0.132 |
| WV-4271 | 1.628 | 0.442 | 0.572 | 0.270 | | 0.177 |
| WV-4272 | 1.104 | 0.404 | 0.468 | 0.245 | 0.090 | 0.347 |
| WV-4273 | 1.617 | 0.552 | 0.359 | 0.251 | 0.300 | 0.749 |

TABLE 4D-continued

Activity of ACVR2B oligonucleotides.

| | 1 nM | | 5 nM | | 25 nM | |
|---|---|---|---|---|---|---|
| WV-4274 | 0.885 | 0.452 | 0.354 | 0.352 | 0.214 | 0.464 |
| WV-4275 | 1.447 | 0.714 | 1.120 | 0.471 | 0.477 | 0.342 |
| WV-4276 | 1.437 | 0.961 | 0.909 | 0.765 | 0.872 | 0.458 |
| WV-4277 | 0.572 | 0.792 | 0.424 | 0.652 | 0.626 | 0.501 |

Table 5. Tables 5A and B show the in vitro potency for different single-stranded RNAi agents, which target ACVR2B. Tested oligonucleotides are: Table 5A, WV-4010, WV-4270, WV-4011, and WV-4271; and Table 5B, WV-4012, WV-4272, WV-4013, and WV-4273.

TABLE 5A

Activity of ACVR2B oligonucleotides.

| | 1 nM | | 5 nM | | 25 nM | |
|---|---|---|---|---|---|---|
| WV-4010 | 0.369 | | 0.288 | | | |
| WV-4270 | 0.714 | 0.729 | 0.484 | 0.382 | 0.234 | 0.132 |
| WV-4011 | 0.410 | 0.278 | 0.433 | 0.165 | | 0.152 |
| WV-4271 | 1.628 | 0.442 | 0.572 | 0.270 | | 0.177 |

TABLE 5B

Activity of ACVR2B oligonucleotides.

| | 1 nM | | 5 nM | | 25 nM | |
|---|---|---|---|---|---|---|
| WV-4012 | 0.613 | 0.421 | 0.235 | 0.245 | 0.087 | 0.098 |
| WV-4272 | 1.104 | 0.404 | 0.468 | 0.245 | 0.090 | 0.347 |
| WV-4013 | 0.626 | 0.530 | 0.385 | 0.407 | 0.111 | 0.117 |
| WV-4273 | 1.617 | 0.552 | 0.359 | 0.251 | 0.300 | 0.749 |

Table 6. Tables 6A to C show the in vitro potency for different single-stranded RNAi agents, which target ACVR2B. Tested oligonucleotides are: Table 6A, WV-3755, WV-3756, WV-3981, and WV-4264; Table 6B, WV-3757, WV-3758, WV-3982, and WV-4265; and Table 6C, WV-3759, WV-3760, WV-3983, and WV-4266.

TABLE 6A

Activity of ACVR2B oligonucleotides.

| | 1 nM | | 5 nM | | 25 nM | |
|---|---|---|---|---|---|---|
| WV-3755 | 1.135 | 0.948 | 1.477 | 1.584 | 1.112 | 1.477 |
| WV-3756 | 1.225 | 0.837 | 1.782 | 1.045 | 1.457 | 1.269 |
| WV-3981 | 1.488 | 1.341 | 0.982 | 1.269 | 1.794 | 1.286 |
| WV-4264 | | 1.617 | | 1.857 | 2.757 | 1.651 |

TABLE 6B

Activity of ACVR2B oligonucleotides.

| | 1 nM | | 5 nM | | 25 nM | |
|---|---|---|---|---|---|---|
| WV-3757 | 0.854 | 0.719 | 1.151 | 0.714 | 0.854 | 0.765 |
| WV-3758 | 0.652 | 0.891 | 0.749 | 0.719 | 1.016 | 1.112 |
| WV-3982 | 1.045 | 1.002 | 1.260 | 0.909 | 1.128 | 0.968 |
| WV-4265 | 1.217 | 1.217 | 1.135 | 1.234 | 1.067 | 1.097 |

TABLE 6C

Activity of ACVR2B oligonucleotides.

| | 1 nM | | 5 nM | | 25 nM | |
|---|---|---|---|---|---|---|
| WV-3759 | 0.719 | 0.770 | 0.948 | 1.135 | 0.843 | 1.260 |
| WV-3760 | 1.128 | 0.825 | | 0.734 | 0.916 | 1.059 |
| WV-3983 | 0.903 | 0.916 | 0.754 | 1.112 | 0.530 | 0.922 |
| WV-4266 | 0.390 | 0.471 | 0.639 | 0.866 | 0.808 | 0.515 |

Table 7. Tables 7A and B show the in vitro potency for different single-stranded RNAi agents, which target ACVR2B. Tested oligonucleotides are: Table 7A, WV-4014, WV-4274, WV-4015, and WV-4275; and Table 7B, WV-4016, WV-4276, WV-4017, and WV-4277.

TABLE 7A

Activity of ACVR2B oligonucleotides.

| | 1 nM | | 5 nM | | 25 nM | |
|---|---|---|---|---|---|---|
| WV-4014 | 0.526 | 0.879 | 0.349 | 0.522 | 0.410 | 0.232 |
| WV-4274 | 0.885 | 0.452 | 0.354 | 0.352 | 0.214 | 0.464 |
| WV-4015 | 0.564 | 1.045 | 0.352 | 0.445 | 0.396 | 0.217 |
| WV-4275 | 1.447 | 0.714 | 1.120 | 0.471 | 0.477 | 0.342 |

TABLE 7B

Activity of ACVR2B oligonucleotides.

| | 1 nM | | 5 nM | | 25 nM | |
|---|---|---|---|---|---|---|
| WV-4016 | 1.089 | 0.760 | 0.825 | 0.639 | 0.247 | 0.382 |
| WV-4276 | 1.437 | 0.961 | 0.909 | 0.765 | 0.872 | 0.458 |
| WV-4017 | 0.803 | 0.724 | 0.541 | 0.639 | 0.302 | 0.235 |
| WV-4277 | 0.572 | 0.792 | 0.424 | 0.652 | 0.626 | 0.501 |

Table 8. Table 8 shows the in vitro potency for different single-stranded RNAi agents, which target ACVR2B. Tested oligonucleotides are: WV-3761, WV-3762, WV-3984, and WV-4267.

TABLE 8

Activity of ACVR2B oligonucleotides.

| | 1 nM | | 5 nM | | 25 nM | |
|---|---|---|---|---|---|---|
| WV-3761 | 1.277 | 1.135 | 0.849 | 0.935 | 0.600 | 0.326 |
| WV-3762 | 1.350 | 0.942 | 0.961 | 0.481 | 0.481 | 0.269 |
| WV-3984 | 1.408 | 0.885 | 1.135 | 0.442 | 1.059 | 0.825 |
| WV-4267 | 1.023 | 0.860 | 0.843 | 0.639 | 0.643 | 0.604 |

Table 9. Table 9 shows the in vitro potency for different single-stranded RNAi agents, which target ACVR2B. Tested oligonucleotides are: WV-4007, WV-4009, WV-4008, and WV-4269.

TABLE 9

Activity of ACVR2B oligonucleotides.

| | 1 nM | | 5 nM | | 25 nM | |
|---|---|---|---|---|---|---|
| WV-4007 | 1.573 | 0.471 | 0.572 | 0.604 | | 0.427 |
| WV-4009 | 0.739 | 0.808 | 0.592 | 0.621 | 0.685 | 0.396 |
| WV-4008 | 0.849 | 0.948 | 1.159 | 0.975 | 0.786 | 0.600 |
| WV-4269 | 0.897 | 0.820 | 0.724 | 0.626 | 0.342 | 0.522 |

Table 10. Table 10 shows the in vitro potency for different single-stranded RNAi agents, which target ACVR2B. Tested oligonucleotides are: WV-3763, WV-3764, WV-3985, and WV-4268.

TABLE 10

Activity of ACVR2B oligonucleotides.

| | 1 nM | | 5 nM | | 25 nM | |
|---|---|---|---|---|---|---|
| WV-3763 | 1.379 | 0.814 | 0.754 | 0.885 | 0.781 | 0.596 |
| WV-3764 | 1.089 | 0.849 | 1.082 | 0.849 | 1.009 | 0.744 |
| WV-3985 | 0.729 | 1.175 | 1.360 | 0.982 | 1.398 | 0.995 |
| WV-4268 | 0.719 | 1.030 | 1.089 | 0.955 | 1.128 | 1.225 |

Table 11. Table 11 shows the in vitro potency for different single-stranded RNAi agents, which target ACVR2B. Tested oligonucleotides are: WV-4010, WV-4012, WV-4014, WV-4016, WV-3755; WV-3757, WV-3759, WV-3761, WV-4007, and WV-3763. Oligonucleotides WV-3755, WV-3757, WV-3759, WV-3761, WV-4007, and WV-3763 are cross-reactive.

TABLE 11

Activity of ACVR2B oligonucleotides.

| | 25 nM | | 5 nM | | 1 nM | |
|---|---|---|---|---|---|---|
| WV-4010 | | | 0.288 | | 0.369 | |
| WV-4012 | 0.087 | 0.098 | 0.235 | 0.245 | 0.613 | 0.421 |
| WV-4014 | 0.410 | 0.232 | 0.349 | 0.522 | 0.526 | 0.879 |
| WV-4016 | 0.247 | 0.382 | 0.825 | 0.639 | 1.089 | 0.760 |
| WV-3755 | 1.112 | 1.477 | 1.477 | 1.584 | 1.135 | 0.948 |
| WV-3757 | 0.854 | 0.765 | 1.151 | 0.714 | 0.854 | 0.719 |
| WV-3759 | 0.843 | 1.260 | 0.948 | 1.135 | 0.719 | 0.770 |
| WV-3761 | 0.600 | 0.326 | 0.849 | 0.935 | 1.277 | 1.135 |
| WV-4007 | | 0.427 | 0.572 | 0.604 | 1.573 | 0.471 |
| WV-3763 | 0.781 | 0.596 | 0.754 | 0.885 | 1.379 | 0.814 |

As shown in Tables 12 to 47, various oligonucleotides were constructed and tested for their ability to mediate knockdown of APOC3, including in vitro. Without wishing to be bound by any theory, the present disclosure suggests that at least some of the oligonucleotides in Tables 12 to 47 may be capable of mediating RISC-mediated ssRNAi activity. In addition, some of the oligonucleotides in these tables have a hybrid format.

Table 12. Table 12 shows the IC$_{50}$ for different single-stranded RNAi agents, which target APOC3. Tested oligonucleotides are: WV-1275, WV-1277, WV-1828, WV-1829, WV-1830 and WV-1831. CI, confidence interval. Cells used were Hep3B, and oligonucleotides for APOC3 were delivered using Lipofectamine® 2000 transfection reagent (ThermoFisher, Grand Island, N.Y.).

TABLE 12

Activity of APOC3 oligonucleotides.

| Oligonucleotide | IC50 (nM) |
|---|---|
| WV-1275 | 1.35 |
| WV-1277 | 1.94 |
| WV-1828 | 0.43 |
| WV-1829 | 0.67 |
| WV-1830 | 0.689 |
| WV-1831 | 0.986 |

Table 13. Table 13 shows the in vitro potency for different single-stranded RNAi agents, which target APOC3. Tested oligonucleotides are: WV-2110, WV-3068, WV-2817, WV-2818, WV-2720, WV-2721, and WV-3021.

In Tables 13, 14, 20 and others: the Conc. in the first column is presented as an exponent (exp) of 10; e.g., 1.398 indicates $10^{1.398}$ nM. In various columns, data from replicate experiments is shown. Numbers indicate residual mRNA level (e.g., 0.254 in column 2, row 2 represents 25.4% residual mRNA level relative to control, or 74.6% knockdown).

TABLE 13

Activity of APOC3 oligonucleotides.

| Conc. (exp 10) (nM) | WV-2110 | | WV-3068 | | WV-2817 | | WV-2818 | |
|---|---|---|---|---|---|---|---|---|
| 1.398 | 0.254 | 0.263 | 0.085 | 0.089 | 0.276 | 0.224 | 0.176 | 0.219 |
| 0.792 | 0.308 | 0.288 | 0.094 | 0.084 | 0.219 | 0.187 | 0.155 | 0.121 |
| 0.204 | 0.563 | 0.587 | 0.203 | 0.179 | 0.280 | 0.390 | 0.171 | 0.181 |
| −0.398 | 0.797 | 0.848 | 0.382 | 0.387 | 0.515 | 0.508 | 0.409 | 0.374 |
| −1.000 | 0.988 | 1.037 | 0.595 | 0.629 | 0.791 | 0.713 | 0.595 | 0.634 |
| −1.602 | 1.008 | 1.015 | 0.884 | 0.830 | 0.994 | 1.001 | 0.921 | 0.896 |
| −2.204 | 0.909 | 0.884 | 0.934 | 0.890 | 1.015 | 1.022 | 0.941 | 0.988 |
| −2.824 | 0.941 | 1.081 | 0.842 | 0.954 | 0.842 | 0.902 | 0.836 | 0.902 |

| Conc. (exp 10) (nM) | WV-2720 | | WV-2721 | | WV-3021 | |
|---|---|---|---|---|---|---|
| 1.398 | 0.328 | 0.330 | 0.328 | 0.272 | 0.265 | 0.205 |
| 0.792 | 0.356 | 0.304 | 0.337 | 0.298 | 0.199 | 0.144 |
| 0.204 | 0.490 | 0.508 | 0.571 | 0.522 | 0.245 | 0.229 |
| −0.398 | 0.890 | 0.842 | 0.842 | 0.769 | 0.424 | 0.415 |
| −1.000 | 0.921 | 0.947 | 0.915 | 0.915 | 0.718 | 0.661 |
| −1.602 | 1.051 | 1.015 | 1.073 | 0.974 | 0.941 | 0.866 |
| −2.204 | 1.066 | 1.073 | 1.066 | 0.915 | 1.051 | 0.902 |
| −2.824 | 0.915 | 1.022 | 0.830 | 0.981 | 0.860 | 0.988 |

Table 14. Table 14 shows the in vitro potency different single-stranded RNAi agents, which target APOC3. Tested oligonucleotides are: WV-2817 and WV-3021.

TABLE 14

Activity of APOC3 oligonucleotides.

| Conc. (exp 10) (nM) | WV-2817 | | WV-3021 | |
|---|---|---|---|---|
| 1.398 | 0.276 | 0.224 | 0.265 | 0.205 |
| 0.792 | 0.219 | 0.187 | 0.199 | 0.144 |
| 0.204 | 0.280 | 0.390 | 0.245 | 0.229 |
| −0.398 | 0.515 | 0.508 | 0.424 | 0.415 |
| −1.000 | 0.791 | 0.713 | 0.718 | 0.661 |
| −1.602 | 0.994 | 1.001 | 0.941 | 0.866 |
| −2.204 | 1.015 | 1.022 | 1.051 | 0.902 |
| −2.824 | 0.842 | 0.902 | 0.860 | 0.988 |

Table 15. Table 15 shows in vitro potency, including knockdown of mRNA (Table 15A) and protein levels (Table 15B) of APOC3, for two single-stranded RNAi agents: WV-1868 and WV-2110.

In Tables 15 and others: the Conc. in the first column is presented in nM. In various columns, data from replicate experiments are shown. In Tables 15 and others wherein the highest activity number is around 100: Numbers indicate residual mRNA level, e.g., 100.000 in column 2, row 2 represents 100.000% residual mRNA level relative to control, or 0% knockdown; and 0.000 would indicate 0% residual mRNA level or 100% knockdown

TABLE 15A

Activity of APOC3 oligonucleotides.

| Conc. (nM) | WV-1868 | | WV-2110 | |
|---|---|---|---|---|
| 0 | 100.000 | 100.000 | 100.000 | 100.000 |
| 0.1 | 101.965 | 112.356 | 91.261 | 78.899 |
| 0.4 | 97.136 | 81.117 | 64.086 | 66.807 |
| 1.6 | 62.767 | 64.531 | 33.173 | 32.043 |
| 6.2 | 32.043 | 29.282 | 19.725 | 19.053 |
| 25 | 15.692 | 11.810 | 19.862 | 20.279 |

TABLE 15A

Activity of APOC3 oligonucleotides.

| Conc. (nM) | WV-1868 | | WV-2110 | |
|---|---|---|---|---|
| 0 | 96.73199783 | 103.268 | 104.7948 | 95.2052 |
| 0.1 | 98.21632145 | 85.76992 | 82.96123 | 82.66324 |
| 0.4 | 65.44366917 | 64.85707 | 41.62211 | 43.6669 |
| 1.6 | 24.87594999 | 23.73695 | 12.00211 | 12.84661 |
| 6.2 | 0.022395917 | 0.022396 | 0.242648 | 1.803896 |
| 25 | 0.022396 | 0.022396 | 0.242648 | 2.337392 |

Table 16. Table 16 shows the $IC_{50}$ for different single-stranded RNAi agents, which all target the same sequence in APOC3, in Hep3B cells. Tested oligonucleotides are: WV-3068, WV-2818, WV-2817, WV-2721, WV-2720, WV-2110, and WV-3021. Results of two experiments are shown.

TABLE 16

Activity of APOC3 oligonucleotides.

| Oligonucleotide | Experiment 1: IC50 (nM) | Experiment 2: IC50 (nM) |
|---|---|---|
| WV-1868 | 1.90 | 0.578 |
| WV-2110 | 0.583 | 0.172 |
| WV-3068 | 0.318 | 0.051 |
| WV-2817 | 0.182 | 0.039 |
| WV-2818 | 0.317 | 0.059 |
| WV-2720 | 0.555 | 0.173 |
| WV-2721 | 1.15 | 0.432 |
| WV-3021 | 0.115 | 0.021 |

Table 17. Table 17 shows the $IC_{50}$ and 95% CI (confidence interval) (pM) for different single-stranded RNAi agents, which both target the same sequence in APOC3. Tested oligonucleotides are: WV-1307 and WV-1308.

TABLE 17

Activity of APOC3 oligonucleotides.

| Oligonucleotide | IC 50 (pM) | 95% CI (pM) |
|---|---|---|
| WV-1307 | 1581 | 634 to 3941 |
| WV-1308 | 235 | 192 to 288 |

Table 18. Table 18 shows the $IC_{50}$ and 95% CI (pM) for different single-stranded RNAi agents, which target the same sequence in APOC3. Tested oligonucleotides are: WV-2134, WV-1308, and WV-2420. WV-2134 is an antisense oligonucleotide which knocks down the target via RNase H-mediated knockdown; WV-1308 and WV-2420 are single-stranded RNAi agents.

TABLE 18

Activity of APOC3 oligonucleotides.

| Oligonucleotide | IC 50 (pM) | 95% CI (pM) |
|---|---|---|
| WV-2134 | 815 | 521 to 2798 |
| WV-1308 | 197 | 353 to 1716 |
| WV-2420 | 51 | 90 to 233 |

Table 19. Table 19 shows the $IC_{50}$ for different single-stranded RNAi agents, which target the same sequence in APOC3, in in Hep3B cells (tested at 48 hours). Tested oligonucleotides are: WV-2110, WV-2716, WV-2717, WV-2718, and WV-2719.

TABLE 19

Activity of APOC3 oligonucleotides.

| Oligonucleotide | IC 50 (pM) |
|---|---|
| WV-2110 | 160 |
| WV-2716 | 1456 |
| WV-2717 | 1841 |
| WV-2718 | 4585 |
| WV-2719 | 5645 |

Table 20. Table 20 shows the in vitro potency for different single-stranded RNAi agents, which target the same sequence in APOC3, in in Hep3B cells (tested at 48 hours). Tested oligonucleotides are: WV-2110, WV-2712, WV-2713, WV-2714, and WV-2715. IC50 of various oligonucleotides: WV-2110, 160 pM; WV-2712, 1743 pM; and WV-2713, 950 pM.

TABLE 20

Activity of APOC3 oligonucleotides.

| Conc. (exp 10) (nM) | WV-2110 | | WV-2712 | | WV-2713 | |
|---|---|---|---|---|---|---|
| 1.398 | 0.260 | 0.269 | 0.136 | 0.171 | 0.097 | 0.166 |
| 0.792 | 0.262 | 0.228 | 0.202 | 0.310 | 0.203 | 0.224 |
| 0.204 | 0.241 | 0.248 | 0.579 | 0.684 | 0.480 | 0.442 |
| −0.398 | 0.459 | 0.453 | 0.848 | 0.961 | 0.890 | 0.808 |
| −1.000 | | 0.711 | 1.150 | 1.008 | 0.759 | |
| −1.602 | 0.900 | 1.077 | | 1.175 | | 1.119 |
| −2.204 | 0.978 | 1.077 | 0.981 | 1.008 | 1.285 | 1.303 |
| −2.824 | 1.005 | 1.005 | 1.119 | 0.961 | 0.884 | 1.088 |

| Conc. (exp 10) (nM) | WV-2714 | | WV-2715 | |
|---|---|---|---|---|
| 1.398 | 0.903 | 0.842 | 0.981 | 0.764 |
| 0.792 | 1.066 | 1.081 | 0.988 | 1.066 |
| 0.204 | | 1.166 | 1.008 | 1.166 |
| −0.398 | 1.088 | 1.285 | 1.208 | 1.233 |
| −1.000 | 1.023 | 1.119 | 1.368 | 1.259 |
| −1.602 | 0.967 | 1.378 | 1.030 | 1.191 |
| −2.204 | 0.988 | 1.135 | 1.015 | 1.191 |
| −2.824 | 0.974 | 1.023 | 0.866 | 0.941 |

Table 21. Table 21 shows the $IC_{50}$ and 95% CI for different single-stranded RNAi agents, which target APOC3. Tested oligonucleotides are: WV-1868, WV-2110, and WV-2111. WV-1868 is an antisense oligonucleotide (operating through RNase H-mediated knockdown), while other tested oligonucleotides are RNAi agents.

TABLE 21

Activity of APOC3 oligonucleotides.

| Oligonucleotide | IC 50 (pM) | 95% CI (pM) |
|---|---|---|
| WV-1868 | 266 | 176 to 403 |
| WV-2110 | 64 | 37 to 110 |
| WV-2111 | 163 | 64 to 412 |

Table 22. Table 22 shows the $IC_{50}$ and 95% CI (pM) for different single-stranded RNAi agents, which target overlapping sequences in APOC3, in in Hep3B cells (tested at 48 hours). Tested oligonucleotides are: WV-2110, WV-2693, WV-2696, WV-2697, WV-2698, and WV-2699.

TABLE 22

Activity of APOC3 oligonucleotides.

| Conc. (exp 10) (nM) | WV-2110 | | WV-2693 | | WV-2696 | | WV-2697 | |
|---|---|---|---|---|---|---|---|---|
| 1.398 | 0.313 | 0.336 | 0.345 | 0.318 | 0.368 | 0.309 | 0.542 | 0.375 |
| 0.792 | 0.301 | 0.296 | 0.286 | 0.348 | 0.307 | 0.307 | 0.370 | 0.282 |
| 0.204 | 0.322 | 0.311 | 0.341 | 0.394 | 0.413 | 0.311 | 0.440 | 0.419 |
| −0.398 | 0.499 | 0.520 | 0.437 | 0.581 | 0.495 | 0.492 | 0.710 | 0.735 |
| −1.000 | 0.756 | 0.782 | 0.788 | 0.740 | 0.662 | 0.695 | 0.886 | 0.788 |
| −1.602 | 1.011 | | 0.799 | 0.997 | 0.924 | 0.844 | 1.011 | 1.145 |
| −2.204 | | 1.047 | 0.911 | 1.122 | 0.977 | 0.821 | 1.061 | 1.186 |
| −2.824 | 0.970 | 0.983 | 0.886 | 0.937 | 1.069 | 0.893 | | 0.997 |

| Conc. (exp 10) (nM) | WV-2697 | | | WV-2698 | | WV-2699 | |
|---|---|---|---|---|---|---|---|
| 1.398 | 0.542 | 0.375 | 0.305 | 0.256 | 0.373 | 0.282 | |
| 0.792 | 0.370 | 0.282 | 0.275 | 0.239 | 0.305 | 0.249 | |
| 0.204 | 0.440 | 0.419 | 0.391 | 0.341 | 0.428 | 0.368 | |
| −0.398 | 0.710 | 0.735 | 0.585 | 0.506 | 0.667 | 0.662 | |
| −1.000 | 0.886 | 0.788 | | 0.761 | | 0.788 | |
| −1.602 | 1.011 | 1.145 | 0.827 | 0.893 | 0.905 | 0.844 | |
| −2.204 | 1.061 | 1.186 | 1.069 | 0.804 | 1.054 | | |
| −2.824 | | 0.997 | 0.963 | 0.821 | 0.950 | 0.839 | |

Table 23. Table 23 shows the $IC_{50}$ and 95% CI (pM) for different single-stranded RNAi agents, which target APOC3, in Hep3B cells (tested at 48 hours). Tested oligonucleotides are: WV-2110, WV-2154, and WV-2155. The latter two oligonucleotides comprise at 2'-deoxy T at the penultimate (second-to-last) or antepenultimate (third-to-last) nucleotide (N26 or N25, if wz=1).

TABLE 23

Activity of APOC3 oligonucleotides.

| Oligonucleotide | IC 50 (pM) | 95% CI (pM) |
|---|---|---|
| WV-2110 | 64 | 37 to 110 |
| WV-2154 | 120 | 71 to 202 |
| WV-2155 | 74 | 22 to 255 |

Table 24. Table 24 shows the $IC_{50}$ and 95% CI for different single-stranded RNAi agents, which target APOC3, in Hep3B cells (tested at 48 hours). Tested oligonucleotides are: WV-2111, WV-2156, and WV-2157.

TABLE 24

Activity of APOC3 oligonucleotides.

| Oligonucleotide | IC 50 (pM) | 95% CI (pM) |
|---|---|---|
| WV-2111 | 163 | 63 to 416 |
| WV-2156 | 118 | 43 to 325 |
| WV-2157 | 245 | 111 to 540 |

Table 25. Table 25 shows the in vitro potency and $IC_{50}$ for different single-stranded RNAi agents, which target APOC3, in PCH (Primary Cyno Hepatocytes). Tested oligonucleotides are: WV-1868, WV-2110, WV-3068 and WV-3069. WV-1868 is an antisense oligonucleotide (operating through RNase H-mediated knockdown), while other tested oligonucleotides are RNAi agents. The penultimate nucleotide (e.g., at position N26) in WV-3068 (nucleotide 20) or WV-3069 (nucleotide 24) comprises a AMC6T (GalNAc). Gym indicates the oligonucleotide was delivered via gymnotic delivery. IC50 of various oligonucleotides: WV-1868, 4.06 nM; WV-2110, 1.58 nM; and WV-3068, 0.24 nM.

TABLE 25

Activity of APOC3 oligonucleotides

| Conc. (exp 10) (nM) | WV-1868 | | WV-2110 | | WV-3068 | |
|---|---|---|---|---|---|---|
| 1.398 | 0.120 | 0.107 | 0.210 | 0.225 | 0.071 | 0.062 |
| 0.792 | 0.384 | 0.366 | 0.262 | 0.247 | 0.065 | 0.071 |
| 0.204 | 0.763 | 0.732 | 0.578 | 0.532 | 0.177 | 0.152 |
| −0.398 | 0.882 | 0.966 | 0.835 | 0.801 | 0.341 | 0.328 |
| −1.000 | 0.966 | 0.946 | 0.895 | 0.959 | 0.574 | 0.637 |
| −1.602 | 1.094 | 1.014 | | 0.986 | 0.858 | 0.784 |
| −2.204 | 0.870 | 0.858 | 0.858 | 0.835 | 0.823 | 0.763 |
| −2.824 | 0.914 | 0.939 | 0.933 | 0.823 | 0.818 | 0.829 |

| Conc. (exp 10) (nM) | WV-3068-Gym | WV-3069 |
|---|---|---|
| 1.398 | 0.594 | 0.590 | 0.170 |
| 0.792 | 0.642 | 0.655 | 0.179 |
| 0.204 | 0.752 | 0.747 | 0.381 |
| −0.398 | 0.768 | 0.707 | 0.737 |
| −1.000 | 0.702 | 0.790 | 0.742 |
| −1.602 | 0.806 | 0.841 | 0.889 |
| −2.204 | 0.823 | 0.784 | 1.000 |
| −2.824 | 0.707 | 0.758 | 0.876 |

Table 26. Table 26 shows the $IC_{50}$ for different single-stranded RNAi agents, which target APOC3, in Hep3B cells (tested at 48 hours). Tested oligonucleotides are: WV-1868, WV-2110, WV-3068, WV-2818, WV-2817, WV-2721, WV-2720, WV-2110, WV-3021.

TABLE 26

Activity of APOC3 oligonucleotides.

| Oligonucleotide | IC50 (nM) |
|---|---|
| WV-1868 | 1.90 |
| WV-2110 | 0.583 |
| WV-3068 | 0.318 |
| WV-2817 | 0.182 |
| WV-2818 | 0.317 |
| WV-2720 | 0.555 |
| WV-2721 | 1.15 |
| WV-3021 | 0.115 |

Table 27. Table 27 shows the $IC_{50}$ for different single-stranded RNAi agents, which target APOC3, in PCH (Primary Cyno Hepatocytes). Tested oligonucleotides are: WV-2110 and WV-3068; and WV-2420 and WV-2386.

TABLE 27

Activity of APOC3 oligonucleotides.

| Oligonucleotide | IC50 (nM) |
|---|---|
| WV-2110 | 1.29 |
| WV-3068 | 0.20 |
| WV-2386 | 1.60 |
| WV-2420 | 0.13 |

Table 28. Table 28 shows the $IC_{50}$ for different single-stranded RNAi agents, which target APOC3, in Hep3B cells (tested at 48 hours). Tested oligonucleotides are: WV-2420, WV-2652, WV-2653, and WV-2654. Various oligonucleotides comprise at the 5' end a PO (WV-2420); PH or H-phosphonate (WV-2652); PS or phosphorothioate (WV-2653); or C3 PO (Mod022), as defined in the legend of Table 1A (WV-2654).

TABLE 28

Activity of APOC3 oligonucleotides.

| Oligonucleotide | IC 50 (pM) |
|---|---|
| WV-2420 | 50 |
| WV-2652 | 300 |
| WV-2653 | 104 |
| WV-2654 | 1000 |

Table 29. Tables 29A and 29B show the in vitro potency and $IC_{50}$ for different single-stranded RNAi agents, which target APOC3, in Hep3B cells (tested at 48 hours). Tested oligonucleotides are: WV-1308, WV-2114, WV-2150, WV-2151, WV-2114, WV-2152, and WV-2153.

TABLE 29A

Activity of APOC3 oligonucleotides.

| Conc. (exp 10) (nM) | WV-1308 | | WV-2114 | |
|---|---|---|---|---|
| 0.792 | 0.133 | 0.124 | 0.092 | 0.087 |
| 0.204 | 0.184 | 0.164 | 0.265 | 0.256 |
| -0.398 | 0.329 | 0.326 | 0.557 | 0.538 |
| -1.000 | 0.584 | 0.622 | 0.809 | 0.826 |
| -1.602 | 0.685 | 0.867 | 0.714 | 0.936 |
| -2.204 | 0.892 | 0.844 | 0.879 | 0.826 |
| -2.807 | 0.956 | 0.936 | 0.809 | 0.962 |

TABLE 29B

Activity of APOC3 oligonucleotides.

| Oligonucleotide | IC 50 (pM) | 95% CI (pM) |
|---|---|---|
| WV-1308 | 144 | 88 to 235 |
| WV-2114 | 628 | 333 to 1183 |

In addition, in one experiment, WV-2150 and WV-2151 demonstrated in vitro activity that was similar to WV-1308 (data not shown); and in a different experiment, WV-2152 and WV-2153 demonstrated in vitro activity slightly better than that of WV-2114 (data not shown).

Table 30. Table 30 shows the in vitro potency of single-stranded RNAi agents to APOC3: WV-1275, WV-1828, and WV-1308.

TABLE 30

Activity of APOC3 oligonucleotides.

| Oligonucleotide | IC50 (nM) |
|---|---|
| WV-1275 | 1.5 |
| WV-1828 | 0.44 |
| WV-1308 | 0.067 |

Table 31. Table 31 shows the in vitro potency and $IC_{50}$ for different single-stranded RNAi agents, which target APOC3, in Hep3B cells (tested at 48 hours). Tested oligonucleotides are: WV-2420, WV-2655, WV-2656, WV-2657, and WV-2658. Various oligonucleotides comprise at the 5' end a PO (WV-2420), C3 PS (Mod022*) (WV-2655), C3dimethyl PH (WV-2656), C3dimethyl PO (WV-2657), or C3dimethyl PS (WV-2658).

TABLE 31

Activity of APOC3 oligonucleotides.

| Conc. (exp 10) (nM) | WV-2420 | | WV-2655 | |
|---|---|---|---|---|
| 0.792 | 0.208 | 0.119 | 0.561 | 0.568 |
| 0.204 | 0.211 | 0.186 | 0.832 | 0.782 |
| -0.398 | 0.318 | 0.282 | 1.090 | 0.886 |
| -1.000 | 0.481 | 0.458 | 0.956 | 0.923 |
| -1.602 | 0.850 | 0.798 | 0.880 | 0.787 |
| -2.204 | 0.936 | 0.949 | 1.121 | 0.923 |
| -2.806 | 1.244 | 0.949 | 0.943 | 0.911 |

| Conc. (exp 10) (nM) | WV-2656 | | WV-2567 | | WV-2658 | |
|---|---|---|---|---|---|---|
| 0.792 | 0.917 | 0.695 | 0.667 | 0.667 | 0.541 | 0.468 |
| 0.204 | 0.969 | 0.776 | 0.793 | 0.740 | 0.776 | 0.735 |
| -0.398 | 1.032 | 0.917 | 0.956 | 0.868 | 0.793 | 0.826 |
| -1.000 | 1.083 | 0.898 | 1.025 | 0.856 | 0.930 | 0.892 |
| -1.602 | 1.400 | 1.261 | 1.553 | 1.553 | 1.699 | 1.288 |
| -2.204 | 0.862 | 0.838 | 0.874 | 0.729 | 0.880 | 0.793 |
| -2.806 | 0.963 | 0.838 | 0.917 | 0.923 | 1.003 | 0.904 |

Table 32. Table 32 shows the $IC_{50}$ for different single-stranded RNAi agents, which target APOC3: WV-2110, WV-3122, WV-3124 to WV-3127, and WV-3133 to WV-3137.

TABLE 32

Activity of APOC3 oligonucleotides.

| Oligonucleotide | IC50 (nM) |
|---|---|
| WV-2110 | 0.8185 |
| WV-3122 | 0.3884 |
| WV-3124 | 0.9753 |
| WV-3125 | ~1.709 |
| WV-3126 | 1.469 |
| WV-3127 | 3.466 |
| WV-3133 | 2.44 |
| WV-3134 | 6.81 |
| WV-3135 | 1.473 |
| WV-3136 | 1.176 |
| WV-3137 | 13.9 |

Table 33. Table 33 shows the in vitro potency and $IC_{50}$ for different single-stranded RNAi agents, which target APOC3: WV-1868, WV-2110, and WV-3068. Data from replicate experiments are shown. The penultimate nucleotide of WV-3068 comprises a TGaNC6T.

TABLE 33

Activity of APOC3 oligonucleotides.

| Oligonucleotide | IC50 (nM) | IC50 (nM) |
|---|---|---|
| WV-1868 | 4.06 | 3.36 |
| WV-2110 | 1.58 | 1.29 |
| WV-3068 | 0.24 | 0.20 |

Table 34. Table 34 shows the in vitro potency and $IC_{50}$ for different single-stranded RNAi agents, which target APOC3: WV-1868, WV-2110, WV-3068, WV-2817, WV-2818, WV-2720, WV-2721, and WV-3021. The penultimate nucleotide of various oligonucleotides is or comprises a 2'-deoxy T (WV-3021 and WV-2817), aminomodifier (WV-2818), or TGaNC6T (WV-3068).

TABLE 34

Activity of APOC3 oligonucleotides.

| Oligonucleotide | IC50 (nM) |
|---|---|
| WV-1868 | 3.36 |
| WV-2110 | 1.29 |
| WV-3068 | 0.20 |
| WV-2817 | 0.25 |
| WV-2818 | 0.17 |
| WV-2720 | 0.9 |
| WV-2721 | 1.06 |
| WV-3021 | 0.17 |

Table 35. Table 35 shows the in vitro potency and $IC_{50}$ for different single-stranded RNAi agents, which target APOC3: WV-2110, WV-3068, WV-2420, and WV-2386.

TABLE 35

Activity of APOC3 oligonucleotides.

| Oligonucleotide | IC50 (nM) |
|---|---|
| WV-2110 | 0.583 |
| WV-3068 | 0.318 |
| WV-2386 | 2.80 |
| WV-2420 | 0.27 |

Additional testing was performed on the in vitro potency for different single-stranded RNAi agents, which target APOC3: WV-3242, WV-5289, WV-5291, WV-5293, WV-5295, WV-5297, WV-5299, and WV-5301.

In one experiment, WV-2110, WV-2154 and WV-2155 all had substantial and substantially similar activity in vitro (data not shown). WV-2155 comprises a 2'-deoxy T at the antepenultimate nucleotide; WV-2154 comprises a 2'-deoxy T at the penultimate nucleotide; and WV-2110 comprises 2'-OMe at both the penultimate and antepenultimate nucleotides In one experiment, WV-3242, WV-5289, WV-5291, WV-5293, WV-5295, WV-5297, and WV-5299 all demonstrated substantial and substantially identical activity in vitro; these various oligonucleotides all comprise a penultimate nucleotide comprising a 2'-deoxy T and have various different lengths (data not shown). WV-5301 showed some in vitro activity, though lower than the other oligonucleotides tested in that experiment.

Table 37. Table 37 shows the in vitro potency and $IC_{50}$ for different single-stranded RNAi agents, which target APOC3: WV-2817, WV-5288, WV-5290, WV-5292, WV-5294, and WV-5296. These various oligonucleotides comprise a 2'-deoxy T at the penultimate nucleotide and have various lengths.

TABLE 37

Activity of APOC3 oligonucleotides.

| Oligonucleotide | IC50 (nM) |
|---|---|
| WV-2817 | 0.066 |
| WV-5288 | 0.032 |
| WV-5290 | 0.003 |
| WV-5292 | 0.053 |
| WV-5294 | 0.012 |
| WV-5296 | 0.013 |
| WV-5298 | 0.015 |

Table 38. Table 38 shows the in vitro potency and $IC_{50}$ for different single-stranded RNAi agents, which target APOC3: WV-5290, WV-5291, WV-6431 to WV-6438, WV-6763, and WV-2477. In various oligonucleotides, the post-seed region comprises a stretch of nucleotides having patterns of modification of: mfmf, mfmfmfm, mmmmmmm, or MMMMMMM, wherein m is 2'-OMe, f is 2'-F, and M is 2'-MOE. In some oligonucleotides, the penultimate nucleotide is 2'-deoxy T.

TABLE 38

Activity of APOC3 oligonucleotides.

| Oligonucleotide | IC50 (nM) | 95% CI (nM) |
|---|---|---|
| WV-5290 | 0.106 | 0.074-0.151 |
| WV-5291 | 0.318 | 0.214-0.473 |
| WV-6431 | 0.112 | 0.063-0.202 |
| WV-6432 | 0.105 | 0.056-0.195 |
| WV-6433 | 0.145 | 0.092-0.228 |
| WV-6434 | 0.293 | 0.165-0.520 |
| WV-6435 | 0.136 | 0.091-0.204 |
| WV-6436 | 0.124 | 0.088-0.174 |
| WV-6437 | 0.209 | 0.156-0.281 |
| WV-6438 | 0.212 | 0.158-0.285 |
| WV-6763 | 0.079 | 0.062-0.100 |

Table 39. Table 39 shows the in vitro potency for different single-stranded RNAi agents, which target APOC3: WV-5291, WV-6411 to 6430, WV-6764, WV-6765, and WV-2477. Various oligonucleotides have different base sequences and different patterns of 2'-F, 2'-OMe and 2'-MOE. Some oligonucleotides comprise a 2'-deoxy T at the penultimate nucleotide.

TABLE 39

Activity of APOC3 oligonucleotides.

| nM | WV-5291 | | WV-6411 | | WV-6412 | | WV-6413 | | WV-6414 | | WV-6415 | |
|---|---|---|---|---|---|---|---|---|---|---|---|---|
| 30.0 | 8.1 | 6.2 | 25.5 | 27.5 | 25.0 | 28.3 | 23.8 | 28.8 | 27.6 | 26.1 | 27.3 | 23.3 |
| 10.0 | 19.6 | 16.5 | 39.6 | 32.1 | 38.9 | 38.0 | 38.5 | 41.1 | 41.9 | 40.9 | 39.3 | 37.8 |
| 3.3 | 20.7 | 24.6 | 26.2 | 26.8 | 27.2 | 27.9 | 29.5 | 32.2 | 31.9 | 28.4 | 27.9 | 30.4 |
| 1.1 | 27.8 | 33.1 | 27.6 | 25.9 | 26.5 | 25.8 | 24.6 | 27.3 | 29.6 | 28.6 | 27.7 | 31.0 |
| 0.4 | 45.9 | 48.9 | 39.0 | 39.1 | 38.0 | 38.3 | 37.7 | 38.0 | 45.6 | 44.6 | 39.4 | 42.0 |

TABLE 39-continued

Activity of APOC3 oligonucleotides.

| | | | | | | | | | | | |
|---|---|---|---|---|---|---|---|---|---|---|---|
| 0.1 | 81.3 | 92.7 | 75.0 | 77.5 | 64.4 | 70.6 | 64.9 | 63.4 | 76.5 | 81.1 | 77.1 |
| 0.0 | 100.3 | 93.2 | 87.3 | 95.2 | 102.5 | 91.7 | 84.8 | 80.4 | 92.6 | 92.8 | 100.0 | 93.4 |
| 0.0 | 102.1 | 82.7 | 97.9 | 106.3 | 104.0 | 106.0 | 91.7 | 100.5 | 103.2 | 97.0 | 107.5 | 96.5 |
| 0.0 | 97.0 | 101.6 | 111.5 | 107.4 | 108.9 | 106.9 | 97.6 | 107.6 | 107.8 | 96.4 | 102.8 | 97.4 |
| 0.0 | 103.5 | 100.8 | 116.3 | 110.0 | 102.8 | 97.6 | 97.9 | 104.5 | 102.7 | 100.6 | 100.9 | 103.0 |
| 0.0 | 87.6 | 101.8 | 109.5 | 109.7 | 99.2 | 101.2 | 100.2 | 111.5 | 108.9 | 97.5 | 103.7 | 101.8 |

| nM | WV-6416 | | WV-6417 | | WV-6418 | | WV-6419 | | WV-6420 | |
|---|---|---|---|---|---|---|---|---|---|---|
| 30.0 | 29.1 | 31.1 | 26.4 | 21.9 | 30.5 | 26.0 | 35.5 | 33.7 | 17.4 | 13.9 |
| 10.0 | 47.5 | 45.3 | 43.7 | 41.2 | 49.4 | 47.4 | 52.9 | 50.9 | 22.9 | 22.5 |
| 3.3 | 31.2 | 36.6 | 31.9 | 30.2 | 38.5 | 35.3 | 43.3 | 37.7 | 23.4 | 22.6 |
| 1.1 | 33.9 | 38.4 | 30.7 | 31.2 | 38.9 | 31.0 | 36.7 | 34.8 | 31.9 | 26.5 |
| 0.4 | 54.3 | 54.1 | 44.4 | 45.0 | 52.9 | 42.4 | 48.1 | 48.2 | 45.8 | 44.5 |
| 0.1 | 83.0 | 92.1 | 77.1 | 79.1 | 93.2 | 71.6 | 74.7 | 75.0 | 75.3 | 79.0 |
| 0.0 | 97.4 | 101.2 | 102.0 | 99.5 | 102.4 | 87.7 | 96.5 | 92.9 | 94.7 | 107.4 |
| 0.0 | 107.5 | 108.4 | 109.9 | 98.7 | 111.2 | 106.5 | 106.9 | 96.9 | 96.1 | 95.9 |
| 0.0 | 103.9 | 108.7 | 110.8 | 106.0 | 118.1 | 85.0 | 99.8 | 113.2 | 93.6 | 102.2 |
| 0.0 | 102.5 | 108.3 | 109.5 | 107.2 | 114.1 | 104.7 | 104.9 | 99.3 | 101.0 | 113.9 |
| 0.0 | 108.4 | 103.5 | 111.6 | 98.3 | 102.6 | 96.7 | 104.3 | 104.2 | 101.3 | 108.5 |

| nM | WV-6421 | | WV-6422 | | WV-6423 | | WV-6424 | | WV-6425 | |
|---|---|---|---|---|---|---|---|---|---|---|
| 30.0 | 24.1 | 17.4 | 17.5 | 11.4 | 18.6 | 13.3 | 18.1 | 10.7 | 32.0 | 14.5 |
| 10.0 | 27.4 | 25.7 | 24.3 | 20.6 | 22.7 | 20.3 | 23.0 | 19.8 | 30.8 | 23.1 |
| 3.3 | 27.8 | 25.1 | 29.2 | 24.9 | 30.7 | 24.0 | 24.7 | 20.2 | 33.8 | 23.7 |
| 1.1 | 34.8 | 33.4 | 39.0 | 34.0 | 44.0 | 43.2 | 29.2 | 31.2 | 44.6 | 32.3 |
| 0.4 | | | 56.7 | 53.3 | 72.3 | 67.6 | 48.8 | 42.2 | 71.5 | 52.6 |
| 0.1 | 76.4 | 73.7 | 88.7 | 82.2 | 95.7 | 85.9 | 86.4 | 65.6 | 102.5 | 79.1 |
| 0.0 | 99.3 | 85.6 | 102.7 | 93.7 | 99.9 | 89.2 | 97.5 | 81.0 | 117.7 | 96.3 |
| 0.0 | 112.1 | 92.3 | 109.1 | 94.9 | 101.5 | 100.4 | 103.5 | 94.7 | 115.4 | 96.0 |
| 0.0 | 102.1 | 110.0 | 111.0 | 112.5 | 107.5 | 101.5 | 111.7 | 96.5 | 105.8 | 101.5 |
| 0.0 | 105.6 | 97.4 | 99.7 | 100.6 | 106.2 | 105.2 | 101.3 | 105.2 | 102.5 | 98.4 |
| 0.0 | 113.5 | 96.3 | 123.0 | 105.0 | 90.2 | 98.5 | 96.4 | 99.1 | 98.2 | 96.1 |

| nM | WV-6426 | | WV-6427 | | WV-6428 | | WV-6429 | | WV-6430 | |
|---|---|---|---|---|---|---|---|---|---|---|
| 30.0 | 10.5 | 10.8 | 9.3 | 8.3 | 12.5 | 12.5 | 13.5 | 12.6 | 14.2 | 15.7 |
| 10.0 | 17.9 | 15.6 | 16.6 | 15.7 | 16.7 | 21.9 | 18.2 | 20.0 | 19.6 | 17.5 |
| 3.3 | 22.7 | 19.1 | 20.2 | 15.7 | 20.0 | 21.3 | 22.9 | 19.1 | 25.0 | 23.2 |
| 1.1 | 31.9 | 26.4 | 26.8 | 23.4 | 33.5 | 26.7 | 34.1 | 27.0 | 33.4 | 30.8 |
| 0.4 | 55.1 | 44.6 | 41.5 | 37.9 | 48.5 | 47.2 | 52.9 | 39.9 | 49.2 | 39.1 |
| 0.1 | 96.5 | 85.7 | 70.7 | 62.0 | 82.6 | 71.3 | 81.1 | 63.1 | 67.9 | 60.3 |
| 0.0 | 104.1 | 93.5 | 81.4 | 85.9 | 91.2 | 91.2 | 88.7 | 81.5 | 95.3 | 80.3 |
| 0.0 | 116.2 | 115.7 | 105.0 | 93.9 | 98.2 | 88.1 | 94.8 | 89.1 | 88.9 | 91.3 |
| 0.0 | 120.4 | 97.5 | 109.9 | 97.6 | 101.5 | 98.3 | 98.2 | 97.4 | 100.2 | 90.8 |
| 0.0 | 109.0 | 94.1 | 106.2 | 100.8 | 102.8 | 97.6 | 104.9 | 97.8 | 96.8 | 91.6 |
| 0.0 | 109.3 | 98.0 | 108.5 | 92.8 | 112.4 | 108.9 | 99.4 | 96.0 | 96.0 | 99.7 |

| nM | WV-6764 | | WV-6765 | | WV-2477 | |
|---|---|---|---|---|---|---|
| 30.0 | 16.2 | 20.4 | 15.8 | 12.5 | 96.7 | 84.3 |
| 10.0 | 29.7 | 32.1 | 24.5 | 25.0 | 97.4 | 101.1 |
| 3.3 | 31.2 | 31.9 | 33.1 | 28.8 | 100.1 | 103.7 |
| 1.1 | 46.9 | 36.7 | 43.6 | 42.9 | 112.0 | 104.5 |
| 0.4 | 79.7 | 65.9 | 77.0 | 68.1 | 115.1 | 110.4 |
| 0.1 | 93.1 | 90.4 | 90.1 | 87.7 | 110.1 | 103.6 |
| 0.0 | 100.2 | 99.0 | 108.1 | 105.5 | 98.5 | 105.1 |
| 0.0 | 107.7 | 98.1 | 110.5 | 96.4 | 106.7 | 108.2 |
| 0.0 | 105.2 | 98.4 | 96.8 | 105.4 | 101.7 | 103.6 |
| 0.0 | 98.1 | 99.0 | 88.3 | 97.9 | 95.4 | 101.5 |
| 0.0 | 96.0 | 92.9 | 91.8 | 98.7 | 93.1 | 99.9 |

Table 40. Table 40 shows the in vivo potency for different single-stranded RNAi agents, which target APOC3: WV-4161, WV-3122, WV-6766, and WV-3247. Oligonucleotides were prepared in a LNP (lipid nanoparticle). Numbers indicate % APOC3 mRNA remaining (hAPOC3/mHPRT), wherein 59.44 in the first column, second row, indicates 59.44% mRNA remaining. Animals were treated 2×10mpk. Oligonucleotides comprise, at the 5' end, a OH (WV-4161), 5'-phosphate (PO) (WV-3122), or 5'-vinyl phosphonate (WV-6766 and WV-3247). Various oligonucleotides comprise different patterns of PO or PS in the post-seed region, and a 2'-deoxy T at the penultimate nucleotide.

TABLE 40

Activity of APOC3 oligonucleotides.

| PBS | LNP-4161 | LNP-3122 | LNP-6766 | LNP-3247 |
|---|---|---|---|---|
| 59.44 | 102.24 | 31.05 | 30.68 | 9.78 |
| 149.41 | 79.13 | 150.39 | 27.9 | 7.44 |
| 128.09 | 46.99 | 52.1 | 17.64 | 45.69 |
| 109.48 | 71.57 | 97.15 | 56.76 | 15.48 |
| 53.59 | 55.19 | 33.26 | 18.76 | 21.88 |

Table 41. Table 41 shows the in vivo potency for different LNP formulated single-stranded RNAi agents, which target APOC3: WV-4161, WV-3122, WV-6766, and WV-3247. Dose: IV 2×10 mpk on Day 1 and Day 4.

TABLE 41

Activity of APOC3 oligonucleotides.
Serum hApoC3 Protein.

| Day | PBS | | | | | | | | | |
|---|---|---|---|---|---|---|---|---|---|---|
| 1 | 12.92 | 14.05 | 10 | 9.94 | 7.03 | 6.87 | 6.95 | 7.08 | 9.71 | 12 |
| 8 | 11.5 | 11.57 | 7.43 | 7.54 | 6.57 | 8.28 | 5.21 | 4.69 | 10.45 | 10.44 |
| 15 | 9.53 | 12.67 | 8.22 | 6.62 | 6.9 | 8.81 | 2.29 | 2.29 | 6.95 | 9.15 |

| Day | LNP-4161 | | | | | | | | | |
|---|---|---|---|---|---|---|---|---|---|---|
| 1 | 5.35 | 5.81 | 7.35 | 9.29 | 9.75 | 11.5 | 9.82 | 6.01 | 12.54 | 11.65 |
| 8 | 1.8 | 2.22 | 0.25 | 0.32 | 2.48 | 2.55 | 0.98 | 1.02 | 5.27 | 4.48 |
| 15 | 1.12 | 1.44 | 0.08 | 0.08 | 0.91 | 1.21 | 4.54 | 4.52 | 5.77 | 4.69 |

| Day | LNP-3122 | | | | | | | | | |
|---|---|---|---|---|---|---|---|---|---|---|
| 1 | 4.59 | 4.3 | 7.22 | 7.02 | 6.56 | 8.9 | 8.57 | 9.56 | 8.4 | 12.04 |
| 8 | 2.78 | 2.64 | 3.23 | 3.17 | 2.64 | 2.7 | 5.46 | 4.99 | 5.79 | 5.69 |
| 15 | 0.27 | 0.23 | 3.5 | 2.97 | 0.88 | 0.91 | 3.26 | 3.58 | 0.74 | 0.86 |

| Day | LNP-6766 | | | | | | | | | |
|---|---|---|---|---|---|---|---|---|---|---|
| 1 | 6.75 | 9.24 | 7.22 | 8.83 | 5.47 | 5.19 | 10.39 | 11.88 | 9.07 | 11.14 |
| 8 | 3.98 | 0.14 | 3.14 | 3.05 | 0.48 | 0.5 | 6.15 | 4.91 | 3.96 | 3.07 |
| 15 | 1.62 | 1.89 | 1.43 | 1.48 | 0.63 | 0.59 | 4.17 | 3.42 | 1.6 | 1.62 |

| Day | LNP-3247 | | | | | | | | | |
|---|---|---|---|---|---|---|---|---|---|---|
| 1 | 9.35 | 9.46 | 9.7 | 11.82 | 10.27 | 11.21 | 8.4 | 9.58 | 10.07 | 7.91 |
| 8 | 4.32 | 3.37 | 5.38 | 5.35 | 5.09 | 6.11 | 4.39 | 4.67 | 7.3 | 5.85 |
| 15 | 0.88 | 0.85 | 0.43 | 0.48 | 1.11 | 1.17 | 0.34 | 0.38 | 3.75 | 3.22 |

Table 42. Table 42 shows the in vivo potency, measured by changes in triglyceride levels, for different different LNP formulated single-stranded RNAi agents, which target APOC3: WV-4161, WV-3122, WV-6766, and WV-3247.

TABLE 42

Activity of APOC3 oligonucleotides.
Serum triglycerides.

| | PBS | | | | | LNP-4161 | | | | |
|---|---|---|---|---|---|---|---|---|---|---|
| 1 | 150.15 | 103.35 | 93.6 | 100.1 | 114.4 | 39 | 78 | 134.55 | 59.8 | 160.55 |
| 8 | 18.85 | 95.55 | 81.9 | 76.05 | 89.05 | 22.1 | −2.6 | 78 | 3.25 | 82.55 |
| 15 | 124.15 | 78 | 195.65 | 37.05 | 118.3 | 11.05 | −8.45 | 48.1 | 34.45 | 40.95 |
| | LNP-3122 | | | | | LNP-6766 | | | | |
| 1 | 53.95 | 74.1 | 104.65 | 83.85 | 81.9 | 118.3 | 78.65 | 42.25 | 130.65 | 94.9 |
| 8 | 29.25 | 49.4 | 71.5 | 56.55 | 63.7 | 98.8 | 34.45 | −1.3 | 74.1 | 68.9 |
| 15 | 17.55 | 45.5 | −1.95 | 30.55 | 3.9 | 92.3 | 22.1 | −1.3 | 61.1 | 37.7 |
| | LNP-3247 | | | | | | | | | |
| 1 | 102.05 | 68.9 | 48.1 | 124.15 | 39 | | | | | |
| 8 | 53.3 | 79.3 | 58.5 | 133.25 | 66.95 | | | | | |
| 15 | 13.65 | −6.5 | 1.3 | 28.6 | 94.9 | | | | | |

Additional experiments demonstrated the in vitro activity of different single-stranded RNAi agents, which target APOC3. In one experiment, oligonucleotides WV-5291, WV-6764, and WV-6765 all demonstrated substantial and substantially identical activity in vitro (data not shown). In another experiment, oligonucleotides WV-5290, WV-6431, and WV-6763 all demonstrated substantial and substantially identical activity in vitro (data not shown).

Table 45. Table 45 shows the stability after incubation in rat liver homogenate (24 h) for different single-stranded RNAi agents, which target APOC3: WV-2817, WV-5288, WV-5290, WV-6763, WV-6431, WV-3242, WV-5289, WV-5291, WV-6765, and WV-6764; and Table 45B, WV-1307, WV-1308. The various oligonucleotides differ in length and stereochemistry; in some oligonucleotides, several internucleotidic linkages are stereorandom phosphorothioates; in various oligonucleotides, stereorandom phosphorothioates and/or phosphodiesters are replaced by a phosphorothioate in the Sp configuration.

TABLE 45

Stability of APOC3 oligonucleotides.
Numbers are approximate (+2%).

| Oligonucleotide | Percentage of Full-Length Oligonucleotide at 24 Hr In Rat Liver Homogenate (approximate numbers) |
|---|---|
| WV-2817 | 4 |
| WV-5288 | 11 |
| WV-5290 | 16 |
| WV-6763 | 43 |
| WV-6431 | 73 |
| WV-3242 | 3 |
| WV-5289 | 8 |
| WV-5291 | 9 |
| WV-6765 | 26 |
| WV-6764 | 61 |

In one experiment, oligonucleotides WV-1307 and 1308 were both tested for their ability to knockdown APOC3 mRNA levels in vitro; both were capable of mediating knockdown of APOC3 mRNA levels in vitro. WV-1307 and WV-1308 differ in their pattern of 2'-F and 2'-OMe modifications.

Table 46. Tables 46A to 46N shows the in vitro potency of various oligonucleotides.

Table 46A shows the in vitro potency of various oligonucleotides in a single-stranded RNAi agent assay; oligonucleotides were derived from strong ASOs, medium ASOs, weak ASOs, dsRNAi agents, or ssRNA.
Numbers represent IC50 (nM) of various APOC3 ssRNAi agents derived from strong, medium and weak ASOs (generally operating from a RNaseH mechanism), or derived from dsRNA or ssRNA (generally operating from a RISC-mediated mechanism).

TABLE 46A

Activity of oligonucleotides.

| ssRNAs derived from: | IC50 of APOC3 ssRNAi agents |||||||||||
|---|---|---|---|---|---|---|---|---|---|---|---|
| | chemistry #2 ||| chemistry #4 |||| chemistry #6 ||||
| strong ASO | 25 | 15 | 6.2 | 4 | 4 | 6.2 | 1.3 | 1.6 | 15 | 15.5 | 15.9 | 1.6 |
| mediumASO | 6.2 | 6.8 | 4 | 15 | 1.6 | 1.2 | 4 | 15 | 1.6 | 4 | 4.8 | 15 |
| weak ASO | 100 | 102 | 25 | 103 | 110 | 15 | 12 | 95 | 120 | 95 | 15 | 110 |
| dsRNA | 100 | | | | 101 | | | | 102 | | | |
| ssRNA | 25 | 100 | | | 1.6 | 30 | | | 15 | 20 | | |

Chemistry #2 has a 5' PO and a pattern of 2' modifications of fmfmfmfmfmfmfmfmfmfmm, wherein f is 2'-F and m is 2'-OMe, and a backbone pattern which is all O, where O is PO.

Chemistry #4 has a 5' PO and a pattern of 2' modifications of fmfmfmfmfmfmfmfmfmfmm, wherein f is 2'-F and m is 2'-OMe, and a backbone pattern which is XOXOXOXOXOXOXOXOXOXO, where X is stereorandom PS and O is PO.

Chemistry #6 has a 5' PO and a pattern of 2' modifications of fmfmfmfmfmfmfmfmfmfmm, wherein f is 2'-F and m is 2'-OMe, and a backbone pattern which is OOOOOOOOOOOOOXXXXXXX, where X is stereorandom PS and O is PO.

The data show that single-stranded RNAi agents derived from double-stranded RNAi agents were generally not efficacious, and generally had lower activity than ssRNAi agents derived from strong ASOs which mediate knockdown via a RNaseH-mediated mechanism (e.g., WV-1275 and WV-1277).

Various ssRNAi agents to APOC3 were constructed which had various 5' ends. These 5' ends include:

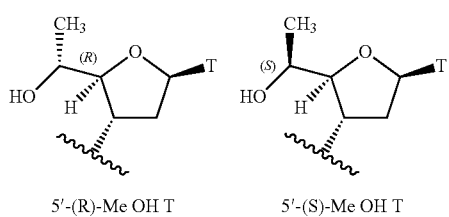

5'-(R)-Me OH T          5'-(S)-Me OH T

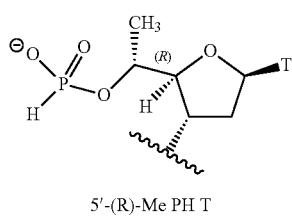

5'-(R)-Me PH T

-continued

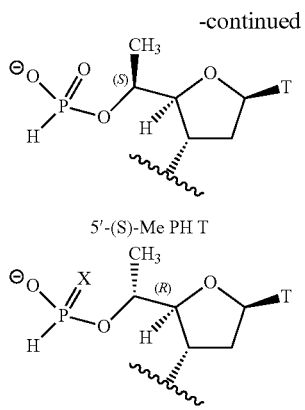

5'-(S)-Me PH T

X = O 5'-(R)-Me PO T
X = S 5'-(R)-Me PS T

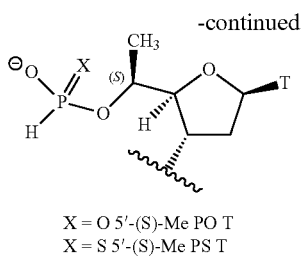

X = O 5'-(S)-Me PO T
X = S 5'-(S)-Me PS T

The term 5'-Me generically includes 5'-(S)-Me [or 5MS or S(c)] and 5'-(R)-Me [or 5MR or R(c)]. 5MSdT is the same as 5'-(S)-Me OH T. PO5MSdT is the same as 5'-(S)-Me PO T. PH5MSdT is the same as 5'-(S)-Me PH T. PS5MSdT is the same as 5'-(S)-Me PS T. 5MRdT is the same as 5'-(R)-Me OH T. PO5MRdT is the same as 5'-(R)-Me PO T. PH5MRdT is the same as 5'-(R)-Me PH T. PS5MRdT is the same as 5'-(R)-Me PS T. 5-Me indicates a moiety which is 5'-(R)-Me, 5'-(S)-Me or 5'-Me which is stereorandom.

Tested oligonucleotides having any of these various 5' ends include: WV-7635, WV-7637, WV-7639, WV-7641, WV-7643, WV-7645, WV-7647, WV-7649, WV-6439, WV-7636, WV-7638, WV-7640, WV-7642, WV-7542, WV-7644, WV-7646, WV-7648, WV-7650, and WV-7542; detailed descriptions of these oligonucleotides can be found in Table 1A.

Activity of these various ssRNAi agents is shown in Tables 2A, 2B, 2C and 2D.

Various hybrid oligonucleotides were constructed. Without wishing to be bound by any particular theory, the present disclosure suggests that, in at least some cases, a hybrid oligonucleotide comprises a structure suitable for an oligonucleotide which operates via a RNaseH-mediated mechanism, e.g., a contiguous stretch of nucleotides which are 2'-deoxy, and also a structure suitable for an oligonucleotide which operates via a RISC-mediated mechanism, such as a seed region; and the present disclosure suggests that, in at least some cases, a hybrid oligonucleotide is capable of knocking down gene expression via a RNaseH-mediated and/or a RISC-mediated mechanism. Hybrid oligonucleotides constructed include: WV-7523, WV-7525, WV-7527, WV-7524, WV-7526, and WV-7528. These oligonucleotides were tested in vitro for ability to knockdown gene expression in comparison with oligonucleotides including: WV-7672, WV-7521, WV-6763, WV-6431, WV-6439, WV-7673, WV-7522, WV-6765, WV-6764, and WV-6439. The results are shown in the Tables 46H and 46I, below.

TABLE 46H

Activity of Oligonucleotides.

| Conc (exp 10) (nM) | WV-7672 | | WV-7521 | | WV-7523 | | WV-7525 | |
|---|---|---|---|---|---|---|---|---|
| 1.000 | 0.243 | 0.150 | 0.231 | 0.230 | 0.214 | 0.208 | 0.267 | 0.227 |
| 0.523 | 0.204 | 0.173 | 0.315 | 0.254 | 0.293 | 0.278 | 0.336 | 0.227 |
| 0.046 | 0.273 | 0.237 | 0.495 | 0.382 | 0.511 | 0.477 | 0.497 | 0.383 |
| −0.431 | 0.580 | 0.347 | 0.769 | 0.656 | 0.773 | 0.629 | 0.583 | 0.539 |
| −0.908 | 0.782 | 0.790 | 1.054 | 0.926 | 1.305 | 1.151 | 0.908 | 0.852 |
| −1.386 | 1.042 | 1.093 | 0.925 | 1.451 | 1.258 | 1.191 | 1.100 | 1.057 |
| −1.863 | 1.141 | 1.144 | 1.057 | 1.096 | 1.046 | 1.382 | 1.346 | 1.172 |
| −2.340 | 1.040 | 1.120 | 1.025 | 1.405 | 1.119 | 1.218 | 1.208 | 1.305 |
| −2.817 | 1.023 | 0.937 | 1.022 | 1.028 | 0.882 | 1.114 | 1.080 | 1.071 |
| −3.294 | 1.045 | 1.266 | 1.062 | 1.199 | 1.050 | 1.187 | 0.980 | 1.072 |
| −3.771 | 1.072 | 0.984 | 0.928 | 1.026 | 1.023 | 1.005 | 0.941 | 1.079 |

| Conc (exp 10) (nM) | WV-7527 | | WV-6763 | | WV-6431 | | WV-6439 (Control) | |
|---|---|---|---|---|---|---|---|---|
| 1.000 | 0.379 | 0.373 | 0.225 | 0.250 | 0.288 | 0.255 | 0.224 | 0.209 |
| 0.523 | 0.500 | 0.428 | 0.269 | 0.218 | 0.209 | 0.207 | 0.207 | 0.148 |
| 0.046 | 0.736 | 0.617 | 0.221 | 0.164 | 0.224 | 0.183 | 0.226 | 0.217 |
| −0.431 | 1.018 | 0.958 | 0.247 | 0.178 | 0.269 | 0.224 | 0.504 | 0.402 |
| −0.908 | 0.938 | 1.231 | 0.351 | 0.269 | 0.472 | 0.406 | 0.642 | 0.653 |
| −1.386 | 1.231 | 1.326 | 0.531 | 0.489 | 0.719 | 0.768 | 0.937 | 0.959 |
| −1.863 | 1.208 | 1.383 | 0.790 | 0.649 | 0.838 | 0.961 | 1.148 | 1.205 |
| −2.340 | 1.136 | 1.162 | 0.873 | 0.881 | 1.321 | 1.136 | 1.127 | 1.035 |
| −2.817 | 1.106 | 1.084 | 1.080 | 0.962 | 1.119 | 1.311 | 1.141 | 1.035 |
| −3.294 | 0.961 | 1.132 | 1.124 | 1.101 | 0.985 | 1.270 | 0.984 | 0.972 |
| −3.771 | 1.073 | 1.203 | 1.164 | 0.936 | 1.059 | 1.309 | 0.968 | 0.871 |

TABLE 46I

Activity of oligonucleotides.

| Conc (exp 10) (nM) | WV-7673 | | WV-7522 | | WV-7524 | | WV-7526 | |
|---|---|---|---|---|---|---|---|---|
| 1.000 | 0.126 | 0.091 | 0.276 | 0.194 | 0.206 | 0.176 | 0.268 | 0.173 |
| 0.523 | 0.191 | 0.105 | 0.352 | 0.256 | 0.383 | 0.315 | 0.381 | 0.250 |
| 0.046 | 0.283 | 0.193 | 0.620 | 0.435 | 0.643 | 0.505 | 0.588 | 0.474 |
| −0.431 | 0.484 | 0.382 | 0.846 | 0.608 | 0.910 | 0.558 | 0.648 | 0.626 |

TABLE 46I-continued

| | | | | Activity of oligonucleotides. | | | | |
|---|---|---|---|---|---|---|---|---|
| −0.908 | 0.804 | 0.717 | 1.041 | 1.143 | 1.085 | 0.992 | 1.154 | 0.951 |
| −1.386 | 1.169 | 0.965 | 1.196 | 1.176 | 1.169 | 1.074 | 1.199 | 1.263 |
| −1.863 | 1.136 | 1.120 | 1.217 | 1.116 | 1.173 | 1.336 | 1.242 | 1.312 |
| −2.340 | 1.136 | 1.475 | 1.224 | 1.565 | 1.140 | 1.716 | 1.162 | 1.095 |
| −2.817 | 0.901 | 0.962 | 1.060 | 1.074 | 1.151 | 1.120 | 1.136 | 1.104 |
| −3.294 | 1.023 | 1.255 | 1.035 | 1.367 | 1.137 | 1.228 | 1.148 | 1.036 |
| −3.771 | 1.022 | 1.017 | 0.925 | 0.984 | 1.094 | 0.963 | 0.993 | 0.947 |

| Conc (exp 10) (nM) | WV-7528 | | WV-6765 | | WV-6764 | | WV-6439 (Control) | |
|---|---|---|---|---|---|---|---|---|
| 1.000 | 0.349 | 0.281 | 0.156 | 0.086 | 0.088 | 0.061 | 0.220 | 0.194 |
| 0.523 | 0.473 | 0.372 | 0.220 | 0.143 | 0.186 | 0.119 | 0.225 | 0.149 |
| 0.046 | 0.697 | 0.550 | 0.303 | 0.143 | 0.304 | 0.168 | 0.276 | 0.193 |
| −0.431 | 0.862 | 0.836 | 0.488 | 0.396 | 0.400 | 0.293 | 0.440 | 0.310 |
| −0.908 | 1.083 | 1.087 | 0.776 | 0.566 | 0.812 | 0.601 | 0.735 | 0.585 |
| −1.386 | 1.401 | 1.156 | 1.197 | 0.851 | 1.100 | 0.911 | 0.990 | 0.876 |
| −1.863 | 1.262 | 1.242 | 1.121 | 1.196 | 1.233 | 1.129 | 1.211 | 1.047 |
| −2.340 | 1.786 | 1.213 | 1.221 | 1.027 | 1.301 | 1.303 | 1.226 | 1.082 |
| −2.817 | 1.183 | 1.042 | 1.059 | 1.132 | 1.220 | 1.010 | 1.191 | 1.021 |
| −3.294 | 1.073 | 1.190 | 1.024 | 1.315 | 1.048 | 1.247 | 1.123 | 1.066 |
| −3.771 | 0.943 | 1.065 | 1.094 | 1.033 | 1.146 | 1.042 | 0.968 | 0.880 |

Tables 46J and 46K show in vitro efficacy of various oligonucleotides in Hep3B cells. Various oligonucleotides comprise stereorandom phosphorothioates or stereocontrolled phosphorothioates.

TABLE 46J

| | | | Activity of oligonucleotides | | | | | |
|---|---|---|---|---|---|---|---|---|
| Conc (exp 10) (nM) | WV-7672 | | WV-7521 | | WV-7523 | | WV-7525 | |
| 1.000 | 0.243 | 0.150 | 0.231 | 0.230 | 0.214 | 0.208 | 0.267 | 0.227 |
| 0.523 | 0.204 | 0.173 | 0.315 | 0.254 | 0.293 | 0.278 | 0.336 | 0.227 |
| 0.046 | 0.273 | 0.237 | 0.495 | 0.382 | 0.511 | 0.477 | 0.497 | 0.383 |
| −0.431 | 0.580 | 0.347 | 0.769 | 0.656 | 0.773 | 0.629 | 0.583 | 0.539 |
| −0.908 | 0.782 | 0.790 | 1.054 | 0.926 | 1.305 | 1.151 | 0.908 | 0.852 |
| −1.386 | 1.042 | 1.093 | 0.925 | 1.451 | 1.258 | 1.191 | 1.100 | 1.057 |
| −1.863 | 1.141 | 1.144 | 1.057 | 1.096 | 1.046 | 1.382 | 1.346 | 1.172 |
| −2.340 | 1.040 | 1.120 | 1.025 | 1.405 | 1.119 | 1.218 | 1.208 | 1.305 |
| −2.817 | 1.023 | 0.937 | 1.022 | 1.028 | 0.882 | 1.114 | 1.080 | 1.071 |
| −3.294 | 1.045 | 1.266 | 1.062 | 1.199 | 1.050 | 1.187 | 0.980 | 1.072 |
| −3.771 | 1.072 | 0.984 | 0.928 | 1.026 | 1.023 | 1.005 | 0.941 | 1.079 |

| Conc (exp 10) (nM) | WV-7527 | | WV-6763 | | WV-6431 | | WV-6439 (Control) | |
|---|---|---|---|---|---|---|---|---|
| 1.000 | 0.379 | 0.373 | 0.225 | 0.250 | 0.288 | 0.255 | 0.224 | 0.209 |
| 0.523 | 0.500 | 0.428 | 0.269 | 0.218 | 0.209 | 0.207 | 0.207 | 0.148 |
| 0.046 | 0.736 | 0.617 | 0.221 | 0.164 | 0.224 | 0.183 | 0.226 | 0.217 |
| −0.431 | 1.018 | 0.958 | 0.247 | 0.178 | 0.269 | 0.224 | 0.504 | 0.402 |
| −0.908 | 0.938 | 1.231 | 0.351 | 0.269 | 0.472 | 0.406 | 0.642 | 0.653 |
| −1.386 | 1.231 | 1.326 | 0.531 | 0.489 | 0.719 | 0.768 | 0.937 | 0.959 |
| −1.863 | 1.208 | 1.383 | 0.790 | 0.649 | 0.838 | 0.961 | 1.148 | 1.205 |
| −2.340 | 1.136 | 1.162 | 0.873 | 0.881 | 1.321 | 1.136 | 1.127 | 1.035 |
| −2.817 | 1.106 | 1.084 | 1.080 | 0.962 | 1.119 | 1.311 | 1.141 | 1.035 |
| −3.294 | 0.961 | 1.132 | 1.124 | 1.101 | 0.985 | 1.270 | 0.984 | 0.972 |
| −3.771 | 1.073 | 1.203 | 1.164 | 0.936 | 1.059 | 1.309 | 0.968 | 0.871 |

TABLE 46K

Activity of oligonucleotides.

| Conc (exp 10) (nM) | WV-7673 | | WV-7522 | | WV-7524 | | WV-7526 | |
|---|---|---|---|---|---|---|---|---|
| 1.000 | 0.126 | 0.091 | 0.276 | 0.194 | 0.206 | 0.176 | 0.268 | 0.173 |
| 0.523 | 0.191 | 0.105 | 0.352 | 0.256 | 0.383 | 0.315 | 0.381 | 0.250 |
| 0.046 | 0.283 | 0.193 | 0.620 | 0.435 | 0.643 | 0.505 | 0.588 | 0.474 |
| −0.431 | 0.484 | 0.382 | 0.846 | 0.608 | 0.910 | 0.558 | 0.648 | 0.626 |
| −0.908 | 0.804 | 0.717 | 1.041 | 1.143 | 1.085 | 0.992 | 1.154 | 0.951 |
| −1.386 | 1.169 | 0.965 | 1.196 | 1.176 | 1.169 | 1.074 | 1.199 | 1.263 |
| −1.863 | 1.136 | 1.120 | 1.217 | 1.116 | 1.173 | 1.336 | 1.242 | 1.312 |
| −2.340 | 1.136 | 1.475 | 1.224 | 1.565 | 1.140 | 1.716 | 1.162 | 1.095 |
| −2.817 | 0.901 | 0.962 | 1.060 | 1.074 | 1.151 | 1.120 | 1.136 | 1.104 |
| −3.294 | 1.023 | 1.255 | 1.035 | 1.367 | 1.137 | 1.228 | 1.148 | 1.036 |
| −3.771 | 1.022 | 1.017 | 0.925 | 0.984 | 1.094 | 0.963 | 0.993 | 0.947 |

| Conc (exp 10) (nM) | WV-7528 | | WV-6765 | | WV-6764 | | WV-6439 (Control) | |
|---|---|---|---|---|---|---|---|---|
| 1.000 | 0.349 | 0.281 | 0.156 | 0.086 | 0.088 | 0.061 | 0.220 | 0.194 |
| 0.523 | 0.473 | 0.372 | 0.220 | 0.143 | 0.186 | 0.119 | 0.225 | 0.149 |
| 0.046 | 0.697 | 0.550 | 0.303 | 0.143 | 0.304 | 0.168 | 0.276 | 0.193 |
| −0.431 | 0.862 | 0.836 | 0.488 | 0.396 | 0.400 | 0.293 | 0.440 | 0.310 |
| −0.908 | 1.083 | 1.087 | 0.776 | 0.566 | 0.812 | 0.601 | 0.735 | 0.585 |
| −1.386 | 1.401 | 1.156 | 1.197 | 0.851 | 1.100 | 0.911 | 0.990 | 0.876 |
| −1.863 | 1.262 | 1.242 | 1.121 | 1.196 | 1.233 | 1.129 | 1.211 | 1.047 |
| −2.340 | 1.786 | 1.213 | 1.221 | 1.027 | 1.301 | 1.303 | 1.226 | 1.082 |
| −2.817 | 1.183 | 1.042 | 1.059 | 1.132 | 1.220 | 1.010 | 1.191 | 1.021 |
| −3.294 | 1.073 | 1.190 | 1.024 | 1.315 | 1.048 | 1.247 | 1.123 | 1.066 |
| −3.771 | 0.943 | 1.065 | 1.094 | 1.033 | 1.146 | 1.042 | 0.968 | 0.880 |

Tables 46M and 46N show in vitro efficacy of various oligonucleotides in Hep3B cells. Tested oligonucleotides were: WV-6439, WV-7540, WV-7541, WV-7542, WV-7543, and WV-7544. Various oligonucleotides comprise a seed region which has a pattern of 2'-modifications of alternating 2'-F and 2'-OMe; a pattern with an initial 2'-F followed by 2'-OME; or a pattern of all 2'-OMe.

TABLE 46M

Activity of oligonucleotides.

| Conc (exp10) (nM) | WV-6439 | | WV-7540 | | WV-7541 | |
|---|---|---|---|---|---|---|
| 1 | 0.173 | 0.264 | 0.144 | 0.254 | 0.266 | 0.352 |
| 0.523 | 0.124 | 0.169 | 0.192 | 0.235 | 0.42 | 0.558 |
| 0.046 | 0.171 | 0.234 | 0.245 | 0.37 | 0.613 | 0.785 |
| −0.431 | 0.379 | 0.346 | 0.436 | 0.488 | 0.785 | 0.997 |
| −0.908 | 0.658 | 0.507 | 0.772 | 0.943 | 0.941 | 1.233 |
| −1.386 | 0.791 | 0.823 | 1.196 | 0.982 | 1.119 | 1.043 |
| −1.863 | 0.901 | 0.903 | 1.053 | 1.073 | 1.099 | 1.165 |
| −2.34 | 0.956 | 0.949 | 1.031 | 1.197 | 0.975 | 1.296 |
| −2.817 | 1.006 | 0.983 | 1.099 | 1.123 | 1.112 | 0.966 |
| −3.294 | 1.034 | 0.959 | 1.014 | 0.969 | 0.994 | 1.045 |

TABLE 46N

Activity of oligonucleotides.

| Conc (exp10) (nM) | WV-7542 | | WV-7543 | | WV-7544 | |
|---|---|---|---|---|---|---|
| 1 | 0.043 | 0.104 | 0.090 | 0.150 | 0.128 | 0.188 |
| 0.523 | 0.082 | 0.156 | 0.143 | 0.249 | 0.236 | 0.417 |
| 0.046 | 0.168 | 0.257 | 0.223 | 0.365 | 0.402 | 0.756 |
| −0.431 | 0.367 | 0.462 | 0.368 | 0.797 | 0.697 | 1.024 |
| −0.908 | 0.552 | 0.854 | 0.601 | 0.968 | 0.858 | 1.094 |
| −1.386 | 0.959 | 1.046 | 0.879 | 1.327 | 0.975 | 1.121 |
| −1.863 | 0.919 | 1.233 | 1.021 | 1.341 | 1.003 | 1.101 |
| −2.34 | 1.157 | | 1.185 | 1.150 | 1.054 | 1.351 |
| −2.817 | 1.064 | 1.297 | 1.136 | 1.064 | 1.104 | 0.956 |
| −3.294 | 1.013 | 0.993 | 0.975 | 0.946 | 0.914 | 0.919 |

As shown in Table 47, additional single-stranded RNAi agents to APOC3 were tested.

Numbers represent relative residual APOC3 mRNA level after oligonucleotide treatment (400 pM). The number 1 would represent 100% APOC3 mRNA level (relative to control); 0 would represent 0% APOC3 mRNA level or 100% knockdown. WV-2111 and WV-2389 have a hybrid format.

TABLE 47A

Activity of APOC3 oligonucleotides.

| Control | | WV-1868 | | WV-2110 | | WV-2388 | | WV-2111 | | WV-2389 | |
|---|---|---|---|---|---|---|---|---|---|---|---|
| 0.99 | 1.02 | 0.52 | 0.57 | 0.33 | 0.39 | 0.43 | 0.49 | 0.55 | 0.43 | 0.59 | 0.62 |

TABLE 47B

Activity of APOC3 oligonucleotides.

| Conc.(nM) (exp10) | WV-2113 | | WV-2148 | | WV-2149 | |
|---|---|---|---|---|---|---|
| 1.398 | 0.03 | 0.02 | 0.01 | 0.01 | 0.02 | 0.02 |
| 0.792 | 0.15 | 0.14 | 0.04 | 0.02 | 0.07 | 0.04 |
| 0.204 | 0.44 | 0.46 | 0.28 | 0.22 | 0.34 | 0.30 |
| −0.398 | 0.71 | 0.75 | 0.54 | 0.51 | 0.71 | 0.53 |
| −1.000 | 0.87 | 0.88 | 0.78 | 0.63 | 0.75 | 0.58 |
| −1.602 | 0.82 | 0.99 | 0.67 | 1.09 | 0.79 | 0.93 |
| −2.204 | 0.92 | 1.13 | 0.83 | 0.71 | 0.83 | 0.76 |
| −2.824 | 0.99 | 1.22 | 1.02 | 0.87 | 0.89 | 0.78 |

WV-2114, WV-2152, and WV-2153 have a hybrid format. Oligonucleotides which are repeated with different numbers indicate different replicates or experiments.

TABLE 47C

IC50 of various APOC3 oligonucleotides.

| Oligonucleotide | IC 50 (pM) |
|---|---|
| WV-1308 | 102 |
| WV-1308 | 144 |
| WV-1868 | 266 |
| WV-2110 | 64 |
| WV-2110 | 64 |
| WV-2111 | 163 |
| WV-2111 | 163 |
| WV-2114 | 705 |
| WV-2114 | 628 |
| WV-2150 | 70 |
| WV-2151 | 87 |
| WV-2152 | 427 |
| WV-2153 | 371 |
| WV-2154 | 120 |
| WV-2155 | 74 |
| WV-2156 | 118 |
| WV-2157 | 245 |

In this and various other tables wherein the conc. of the oligonucleotide is a negative number, the negative number (e.g., −3.77) indicates an exponent of 10 (exp 10) or log.

TABLE 47D

Activity of APOC3 oligonucleotides.

| Conc (exp10) nM | WV-7540 | | WV-8427 | | WV-8429 | |
|---|---|---|---|---|---|---|
| 1.00 | 0.13 | 0.15 | 0.20 | 0.17 | 0.14 | 0.15 |
| 0.52 | 0.16 | 0.25 | 0.22 | 0.26 | 0.15 | 0.19 |
| 0.05 | 0.27 | 0.32 | 0.37 | 0.35 | 0.26 | 0.22 |
| −0.43 | 0.40 | 0.47 | 0.40 | 0.54 | 0.28 | 0.30 |
| −0.91 | 0.56 | 0.64 | 0.63 | 0.71 | 0.45 | 0.49 |
| −1.39 | 0.69 | 0.80 | 0.80 | 0.92 | 0.61 | 0.71 |
| −1.86 | 0.73 | 0.92 | 0.91 | 0.97 | 0.79 | 0.96 |
| −2.34 | 0.69 | 0.84 | 1.00 | 0.98 | 1.01 | 0.95 |
| −2.82 | 0.72 | 0.92 | 1.00 | 1.04 | 0.95 | 1.01 |
| −3.29 | 0.77 | 1.34 | 0.91 | 1.60 | 0.97 | 0.95 |
| −3.77 | 0.64 | 1.05 | 0.88 | 1.25 | 1.31 | 0.96 |

| 1.00 | WV-8431 | | WV-6439 | | WV-6439 | |
|---|---|---|---|---|---|---|
| 0.52 | 0.17 | 0.17 | 0.21 | 0.21 | 0.19 | 0.19 |
| 0.05 | 0.21 | 0.21 | 0.17 | 0.17 | 0.18 | 0.18 |
| −0.43 | 0.23 | 0.23 | 0.22 | 0.22 | 0.19 | 0.19 |
| −0.91 | 0.29 | 0.29 | 0.23 | 0.23 | 0.27 | 0.27 |
| −1.39 | 0.49 | 0.49 | 0.52 | 0.52 | 0.40 | 0.40 |
| −1.86 | 0.75 | 0.75 | 0.74 | 0.74 | 0.57 | 0.57 |
| −2.34 | 0.90 | 0.90 | 0.91 | 0.91 | 0.70 | 0.70 |
| −2.82 | 1.00 | 1.00 | 0.99 | 0.99 | 0.80 | 0.80 |
| −3.29 | 1.06 | 1.06 | 1.05 | 1.05 | 0.94 | 0.94 |
| −3.77 | 1.12 | 1.12 | 0.95 | 0.95 | 0.98 | 0.98 |

TABLE 47D-continued

Activity of APOC3 oligonucleotides.

| 1.00 | WV-6431 | | WV-6439 Plate Control | |
|---|---|---|---|---|
| 0.52 | 0.21 | 0.21 | 0.20 | 0.20 |
| 0.05 | 0.28 | 0.28 | 0.21 | 0.21 |
| −0.43 | 0.18 | 0.18 | 0.23 | 0.23 |
| −0.91 | 0.23 | 0.23 | 0.29 | 0.29 |
| −1.39 | 0.41 | 0.41 | 0.54 | 0.54 |
| −1.86 | 0.67 | 0.67 | 0.67 | 0.67 |
| −2.34 | 0.73 | 0.73 | 0.75 | 0.75 |
| −2.82 | 0.85 | 0.85 | 0.85 | 0.85 |
| −3.29 | 1.05 | 1.05 | 0.77 | 0.77 |
| −3.77 | 0.90 | 0.90 | 0.86 | 0.86 |

TABLE 47E

Activity of APOC3 oligonucleotides.

| Conc (exp 10) nM | 7543 | | 8428 | | 8430 | |
|---|---|---|---|---|---|---|
| 1.00 | 0.18 | 0.18 | 0.18 | 0.19 | 0.24 | 0.21 |
| 0.52 | 0.24 | 0.25 | 0.20 | 0.23 | 0.33 | 0.33 |
| 0.05 | 0.39 | 0.39 | 0.37 | 0.37 | 0.46 | 0.40 |
| −0.43 | 0.57 | 0.53 | 0.49 | 0.50 | 0.65 | 0.56 |
| −0.91 | 0.68 | 0.69 | 0.76 | 0.78 | 0.84 | 0.66 |
| −1.39 | 0.88 | 0.82 | 0.88 | 0.93 | 0.91 | 0.84 |
| −1.86 | 0.93 | 0.87 | 0.94 | 1.06 | 1.13 | 0.95 |
| −2.34 | 0.94 | 0.83 | 0.99 | 1.13 | 1.18 | 0.93 |
| −2.82 | 0.99 | 0.87 | 1.00 | 1.00 | 1.01 | 0.92 |
| −3.29 | 0.95 | 0.83 | 1.01 | 1.06 | 1.16 | 1.02 |
| −3.77 | 1.11 | 0.80 | 1.00 | 1.02 | 1.03 | 0.99 |

| Conc (exp 10) | 8432 | | 7542 | | 6765 | |
|---|---|---|---|---|---|---|
| 1.00 | 0.21 | 0.20 | 0.09 | 0.14 | 0.16 | 0.17 |
| 0.52 | 0.24 | 0.25 | 0.14 | 0.15 | 0.21 | 0.21 |
| 0.05 | 0.33 | 0.36 | 0.23 | 0.27 | 0.26 | 0.25 |
| −0.43 | 0.47 | 0.55 | 0.37 | 0.40 | 0.46 | 0.38 |
| −0.91 | 0.73 | 0.71 | 0.59 | 0.63 | 0.66 | 0.66 |
| −1.39 | 0.85 | 0.86 | 0.82 | 0.85 | 0.94 | 0.82 |
| −1.86 | 0.97 | 0.95 | 0.96 | 1.09 | 0.95 | 1.04 |
| −2.34 | 1.08 | 1.06 | 1.13 | 1.53 | 0.98 | 1.02 |
| −2.82 | 0.95 | 1.10 | 1.02 | 0.92 | 0.99 | 1.11 |
| −3.29 | 1.00 | 0.99 | 1.05 | 1.46 | 0.96 | 1.07 |
| −3.77 | 0.97 | 1.08 | 1.01 | 1.20 | 0.91 | 1.02 |

| Conc (exp 10) | 6764 | | 6439 Plate Control | |
|---|---|---|---|---|
| 1.00 | 0.12 | 0.13 | 0.22 | 0.20 |
| 0.52 | 0.19 | 0.23 | 0.18 | 0.16 |
| 0.05 | 0.30 | 0.32 | 0.22 | 0.22 |
| −0.43 | 0.41 | 0.47 | 0.33 | 0.41 |
| −0.91 | 0.70 | 0.83 | 0.54 | 0.69 |
| −1.39 | 0.83 | 0.87 | 0.84 | 0.85 |
| −1.86 | 0.90 | 1.08 | 1.02 | 1.04 |
| −2.34 | 1.01 | 1.06 | 0.89 | 1.00 |
| −2.82 | 1.03 | 1.02 | 1.09 | 1.08 |
| −3.29 | 0.98 | 1.46 | 0.99 | 1.17 |
| −3.77 | 1.10 | 1.06 | 1.09 | 1.04 |

Oligonucleotides were also tested at 0.4 and 1 nM and 25 and 6.2 pM, at which concentrations, the oligonucleotides showed decreased ability to knock down APOC3 relative to the higher concentrations (data not shown).

TABLE 47F

Activity of APOC3 oligonucleotides.

| | 100 nM | | 25 nM | | 6.2 nM | |
|---|---|---|---|---|---|---|
| WV-1307 | 0.99619 | 0.7816 | 0.51566 | 0.47781 | 0.48785 | 0.46474 |
| WV-1308 | 0.72926 | 0.91035 | 0.32635 | 0.28411 | 0.21984 | 0.21984 |
| WV-1238 | 0.42765 | 0.63927 | 0.25962 | 0.21088 | 0.34978 | 0.25078 |
| WV-1240 | 0.3241 | 0.21531 | 0.1798 | 0.20229 | 0.36463 | 0.26325 |
| WV-1800 | 0.30239 | 0.31306 | 0.28019 | 0.18231 | 0.24392 | 0.31306 |
| WV-1801 | 0.50856 | 0.51925 | 0.73944 | 0.41596 | 0.35466 | 0.2389 |
| WV-1802 | 0.3109 | 0.23237 | 0.54506 | 0.45203 | 0.25962 | 0.22137 |
| WV-1803 | 0.3109 | 0.21531 | 0.30875 | 0.24057 | 0.14809 | 0.13346 |
| WV-1270 | 0.69472 | 0.8553 | 0.44891 | 0.34736 | 0.43663 | 0.45203 |
| WV-1272 | 0.64819 | 0.58015 | 0.40179 | 0.43663 | 0.66181 | 0.6175 |
| WV-1824 | 0.41885 | 0.57614 | 0.37488 | 0.37749 | 0.32862 | 0.54506 |
| WV-1825 | 0.48785 | 0.48785 | 0.40458 | 0.40179 | 0.38542 | 0.40179 |
| WV-1826 | 0.43062 | 0.38542 | 0.24905 | 0.33786 | 0.38011 | 0.36211 |
| WV-1827 | 0.69955 | 0.70932 | 0.37749 | 0.56039 | 0.48113 | 0.4981 |
| WV-1275 | 0.24 | 0.4 | 0.22 | 0.16 | 0.24 | 0.29 |
| WV-1277 | 0.1 | 0.11 | 0.15 | 0.1 | 0.19 | 0.24 |
| WV-1828 | 0.19405 | 0.26692 | 0.16431 | 0.14107 | 0.18874 | 0.17011 |
| WV-1829 | 0.23237 | 0.26325 | 0.2229 | 0.15762 | 0.23237 | 0.20511 |
| WV-1830 | 0.16318 | 0.19271 | 0.20654 | 0.12196 | 0.18874 | 0.16545 |
| WV-1831 | 0.13346 | 0.16431 | 0.12539 | 0.08505 | 0.15982 | 0.15225 |
| WV-1307 | 0.43 | 0.46 | 0.36 | 0.34 | 0.37 | 0.35 |
| WV-1308 | 0.28 | 0.27 | 0.11 | 0.12 | 0.16 | 0.16 |
| D73 | 0.04 | 0.03 | 0.04 | 0.03 | 0.06 | 0.06 |
| D74 | 0.02 | 0.02 | 0.02 | 0.02 | 0.07 | 0.05 |
| WV-1238 | 0.55 | 0.14 | 0.1 | 0.14 | 0.32 | 0.39 |
| WV-1240 | 0.18 | 0.18 | 0.28 | 0.24 | 0.55 | 0.5 |
| WV-1800 | 0.27 | 0.18 | 0.2 | 0.08 | 0.14 | 0.18 |
| WV-1801 | 0.58 | 0.38 | 0.34 | 0.59 | 0.25 | 0.23 |
| WV-1802 | 0.23 | 0.3 | 0.16 | 0.63 | 0.2 | 0.22 |
| WV-1803 | 0.15 | 0.19 | 0.17 | 0.14 | 0.11 | 0.13 |
| WV-1270 | 0.61 | 0.61 | 0.51 | 0.26 | 0.29 | 0.32 |
| WV-1272 | 0.49 | 0.51 | 0.42 | 0.36 | 0.51 | 0.73 |
| WV-1824 | 0.38 | 0.43 | 0.22 | 0.25 | 0.31 | 0.38 |
| WV-1825 | 0.4 | 0.33 | 0.15 | 0.4 | 0.29 | 0.32 |
| WV-1826 | 0.29 | 0.3 | 0.2 | 0.2 | 0.26 | 0.31 |
| WV-1827 | 0.97 | 0.53 | 0.46 | 0.39 | 0.44 | 0.48 |
| WV-1275 | 0.42 | 0.27 | 0.17 | 0.16 | 0.26 | 0.35 |
| WV-1277 | 0.1 | 0.08 | 0.09 | 0.09 | 0.26 | 0.28 |
| WV-1828 | 0.14 | 0.14 | 0.22 | 0.36 | 0.22 | 0.13 |
| WV-1829 | 0.2 | 0.2 | 0.14 | 0.23 | 0.14 | 0.19 |
| WV-1830 | 0.17 | 0.12 | 0.34 | 0.17 | 0.15 | 0.17 |
| WV-1831 | 0.1 | 0.11 | 0.11 | 0.07 | 0.12 | 0.14 |

TABLE 47G

Activity of APOC3 oligonucleotides.

| Log Conc.(nM) | H2O | | WV-4186 | | WV-4255 | |
|---|---|---|---|---|---|---|
| 25 | 1.13 | 0.87 | 0.03 | 0.03 | 0.04 | 0.04 |
| 6.25 | 1.13 | 0.59 | 0.1 | 0.04 | 0.31 | 0.21 |
| 1.5625 | 0.99 | 0.71 | 0.13 | 0.08 | 0.46 | 0.4 |
| 0.390625 | 0.86 | 0.94 | 0.25 | 0.33 | 0.73 | 0.82 |
| 0.097656 | 0.68 | 0.94 | 0.7 | 0.48 | 0.92 | 1.22 |
| 0.024414 | 0.77 | 0.9 | 0.6 | 0.58 | 0.9 | 1.08 |
| 0.006104 | 0.7 | 1.28 | 0.64 | 1.6 | 0.73 | 1.39 |
| 0.001526 | 0.76 | 0.94 | 0.9 | 0.91 | 0.76 | 1.03 |

| Log Conc.(nM) | WV-4245 | | WV-4260 | | WV-4250 | |
|---|---|---|---|---|---|---|
| 25 | 0.08 | 0.07 | | 0.04 | | 0.08 |
| 6.25 | 0.31 | 0.17 | 0.3 | 0.19 | 0.24 | 0.14 |
| 1.5625 | 0.41 | 0.56 | 0.52 | 0.39 | 0.38 | 0.37 |
| 0.390625 | 0.74 | 0.84 | 0.69 | 0.79 | 0.66 | 0.6 |
| 0.097656 | 0.73 | 0.96 | 0.9 | 1 | 0.99 | 0.98 |
| 0.024414 | 0.71 | 0.8 | 0.84 | 1.05 | 0.89 | 0.98 |
| 0.006104 | 0.77 | 1.75 | 0.72 | 1.4 | 0.72 | 1.26 |
| 0.001526 | 0.74 | 1.05 | 1.15 | 1.08 | 0.74 | 1.32 |

| Log Conc.(nM) | WV-4145 | | WV-4178 | | WV-4156 | |
|---|---|---|---|---|---|---|
| 25 | | 0.02 | | 0.02 | 0.02 | |
| 6.25 | 0.18 | 0.12 | 0.33 | 0.23 | 0.2 | 0.15 |

TABLE 47G-continued

Activity of APOC3 oligonucleotides.

| | | | | | | |
|---|---|---|---|---|---|---|
| 1.5625 | 0.36 | 0.32 | 0.63 | 0.47 | 0.36 | 0.32 |
| 0.390625 | 0.74 | 0.7 | 0.99 | 0.89 | 0.74 | 0.85 |
| 0.097656 | 0.84 | 1.08 | 0.87 | 1.11 | 0.92 | 0.97 |
| 0.024414 | 0.66 | 1.11 | 0.83 | 0.99 | 0.86 | 1.43 |
| 0.006104 | 0.82 | 1.3 | 0.86 | 1.47 | 0.93 | 1.51 |
| 0.001526 | 0.89 | 1.23 | 0.78 | 1.2 | 0.9 | 1.08 |

| Log Conc.(nM) | WV-4172 | | WV-4149 | | | |
|---|---|---|---|---|---|---|
| 25 | | 0.07 | 0.17 | 0.1 | | |
| 6.25 | 0.68 | 0.39 | 0.56 | 0.49 | | |
| 1.5625 | 0.77 | 0.78 | 0.84 | 0.76 | | |
| 0.390625 | 1.19 | 1.05 | 0.81 | 0.88 | | |
| 0.097656 | 0.93 | 1.16 | 0.85 | 0.9 | | |
| 0.024414 | 1.11 | 1.2 | 0.84 | 1.19 | | |
| 0.006104 | 1.17 | 1.47 | 1.91 | 1.08 | | |
| 0.001526 | 0.78 | 1.14 | 0.79 | 1.33 | | |

TABLE 47H

Activity of APOC3 oligonucleotides.

| Log Conc.(nM) | 25 | 6.25 | 1.562 | 0.390 | 0.0976 | 0.0244 | 0.00610 | 0.0015 |
|---|---|---|---|---|---|---|---|---|
| H2O | 0.74 | 0.83 | 1.09 | 0.9 | 1.35 | 1.25 | 0.93 | 1.13 |
| | 1.25 | 0.92 | 0.89 | 1.1 | 0.84 | 0.96 | 1.2 | 0.84 |
| WV-4186 | 0.08 | 0.05 | 0.13 | 0.24 | 0.42 | 0.67 | 0.96 | 1.23 |
| | 0.03 | 0.05 | 0.1 | 0.25 | 0.38 | 0.7 | 1.04 | 0.7 |
| WV-4182 | 0.1 | 0.51 | 0.79 | 1.14 | 1.32 | 1.36 | 1.42 | 1.16 |
| | 0.1 | 0.49 | 0.61 | 0.51 | 0.96 | 0.96 | 1 | 0.86 |
| WV-4160 | 0.12 | 0.55 | 0.82 | 1.19 | 1.22 | 1.39 | 1.18 | 1.44 |
| | 0.19 | 0.52 | 0.71 | 1.04 | 1.11 | 1.15 | 1.02 | 1.08 |
| WV-4256 | 0.2 | 0.77 | 1.17 | 1.5 | 1.3 | 1.5 | 1.34 | 1.63 |
| | 0.19 | 0.67 | 0.84 | 1.02 | 1.15 | 1.6 | 0.99 | 0.87 |
| WV-4246 | 0.18 | 0.98 | 1.47 | 1.44 | 1.48 | 1.38 | 1.23 | 1.38 |
| | 0.18 | 0.55 | 0.71 | 0.51 | 1.06 | 1.21 | 1.1 | 1.18 |
| WV-4261 | 0.13 | 0.84 | 1.05 | 1.19 | 0.96 | 1.82 | 1.62 | 1.61 |
| | 0.15 | 0.55 | 0.79 | 0.51 | 1.1 | 1.2 | 1.08 | 0.96 |
| WV-4251 | 0.09 | 0.72 | 1.06 | 1.25 | 1.31 | 1.44 | 1.51 | 1.63 |
| | 0.1 | 0.37 | 0.75 | 0.51 | 1.08 | 1.41 | 0.98 | 1.32 |
| WV-4257 | 0.13 | 0.77 | 0.95 | 1.56 | 1.54 | 1.19 | 1.69 | 1.8 |
| | 0.21 | 0.64 | 0.86 | 0.51 | 1.02 | 1.32 | 0.9 | 0.83 |
| WV-4247 | 0.05 | 0.46 | 0.78 | 1.23 | 1.32 | 1.55 | 1.3 | 1.43 |
| | 0.06 | 0.39 | 0.66 | 1.13 | 0.97 | 1.28 | 1.04 | 0.94 |
| WV-4262 | 0.13 | 0.62 | 1.07 | 1.34 | 1.05 | 1.3 | 1.36 | 1.65 |
| | 0.19 | 0.58 | 0.9 | 0.51 | 0.87 | 1.11 | 0.89 | 1.04 |
| WV-4252 | 0.04 | 0.3 | 0.5 | 1.02 | 1.02 | 1.11 | 1.04 | 1.22 |
| | 0.06 | 0.26 | 0.59 | 0.84 | 0.87 | 1.05 | 0.76 | 0.8 |
| Conc.(nM) | 25 | 6.25 | 1.56 | 0.3906 | 0.0976 | 0.0244 | 0.00610 | 0.00152 |
| H2O | 0.73 | 0.68 | 0.72 | | 1.13 | | 0.75 | 0.91 |
| | | | 0.52 | 1.22 | 0.83 | 0.97 | 0.76 | 0.87 |
| WV-4248 | 0.27 | 0.65 | 0.98 | | 1.03 | 0.87 | 0.91 | 0.98 |
| | 0.18 | 0.78 | | 1.19 | | 0.91 | 1.09 | 1.15 |
| WV-4162 | 0.14 | 0.08 | 0.29 | | 1.03 | 0.76 | 0.93 | 0.88 |
| | 0.07 | 0.08 | 0.29 | 0.83 | 0.87 | 1.14 | 1.09 | 1.04 |
| WV-4139 | 0.08 | 0.08 | 0.19 | | 1.02 | 1 | 1.15 | 1.16 |
| | 0.07 | 0.08 | 0.25 | 0.63 | 0.94 | 1.1 | 1.21 | |
| WV-4173 | 0.08 | 0.08 | 0.21 | | 0.94 | 0.8 | 0.95 | 1.3 |
| | 0.08 | 0.08 | 0.19 | 0.56 | 0.97 | 0.92 | 1.09 | 1.28 |
| WV-4150 | 0.05 | 0.08 | 0.15 | | 0.93 | 1.13 | 1.29 | 1.06 |
| | 0.05 | 0.1 | 0.21 | 0.31 | 0.8 | 1.31 | | |
| WV-4167 | 0.07 | 0.23 | 0.74 | | 0.85 | 1.13 | 1.09 | 1.13 |
| | 0.12 | 0.32 | 0.77 | 0.69 | 1.31 | | 1.19 | 1.41 |
| WV-4144 | 0.06 | 0.14 | 0.27 | | 0.91 | 0.91 | 0.72 | 1.05 |
| | 0.08 | 0.19 | 0.53 | 0.97 | 1.36 | 1.06 | 1.2 | 1.08 |
| WV-3137 | 0.07 | 0.25 | 0.42 | 1.02 | 1.18 | 0.95 | 0.92 | 0.86 |
| | 0.07 | 0.25 | 0.66 | 1.11 | 1.04 | 1.1 | 0.95 | 1.06 |
| WV-4155 | 0.07 | 0.1 | 0.16 | 0.67 | 0.77 | 0.75 | 0.87 | 0.81 |
| | 0.16 | 0.1 | 0.4 | 0.95 | | 1.02 | 0.68 | 1.06 |
| WV-4166 | 0.16 | 0.23 | 0.16 | 0.84 | 0.66 | 0.77 | 0.77 | 0.88 |
| | 0.15 | 0.27 | 0.68 | 0.76 | 1.06 | 0.79 | 0.79 | 0.88 |
| WV-4143 | 0.05 | 0.17 | 0.16 | | 0.7 | 0.74 | 0.86 | 0.97 |
| | 0.05 | 0.2 | 0.47 | 1.09 | 1.05 | 0.69 | 0.55 | 0.85 |
| Log Conc.(nM) | 25 | 6.25 | 1.5625 | 0.3906 | 0.0976 | 0.0244 | 0.0061 | 0.00152 |
| H2O | 0.78 | 0.75 | 0.78 | 0.95 | 0.7 | 0.84 | 1.01 | 1.06 |
| | 0.68 | 0.79 | 0.84 | 0.98 | 0.56 | | 0.57 | 0.68 |

TABLE 47H-continued

Activity of APOC3 oligonucleotides.

| | | | | | | | | |
|---|---|---|---|---|---|---|---|---|
| WV-4186 | 0.06 | 0.09 | 0.12 | 0.15 | 0.61 | 0.77 | 0.82 | 0.98 |
| | 0.05 | 0.12 | 0.14 | 0.23 | 0.38 | 0.69 | 1.17 | 0.83 |
| WV-4258 | 0.29 | 0.56 | 0.71 | 0.75 | 0.81 | 0.98 | 1.01 | 1.25 |
| | 0.34 | 0.45 | 0.87 | | 0.88 | 0.82 | 0.92 | |
| WV-4248 | 0.79 | 0.69 | 0.82 | 0.77 | 0.83 | 0.86 | 0.87 | 1.01 |
| | 0.93 | 0.87 | 0.77 | | 0.8 | 1.07 | 0.97 | 1.02 |
| WV-4263 | 0.72 | 0.64 | 0.85 | 0.93 | 0.95 | 1.01 | 1.03 | 0.91 |
| | 0.81 | 0.73 | | 0.9 | | 0.86 | 0.27 | 1 |
| WV-4253 | 0.75 | 0.84 | 0.88 | 0.85 | 0.83 | 0.71 | 0.65 | 0.98 |
| | 0.92 | 0.82 | 0.73 | 0.85 | 1.02 | 0.98 | 1.03 | 1.04 |
| WV-4161 | 0.22 | 0.22 | 0.39 | 0.65 | 1.03 | 0.99 | 0.71 | 1.08 |
| | 0.17 | 0.22 | 0.35 | 0.56 | 0.93 | 0.96 | 0.94 | 1 |
| WV-2817 | 0.2 | 0.23 | 0.34 | 1.26 | 0.79 | 0.82 | 1.05 | 1.12 |
| | 0.19 | 0.24 | 0.33 | 0.64 | 0.68 | | 0.94 | 1 |
| WV-3122 | 0.19 | 0.16 | 0.31 | | 0.79 | 0.78 | 1.08 | 0.96 |
| | 0.11 | 0.18 | 0.36 | 0.44 | 0.54 | 0.81 | 0.82 | 0.88 |
| WV-3021 | 0.28 | | 0.28 | 0.45 | 0.61 | 0.94 | 1.07 | 1.06 |
| | | 0.17 | 0.31 | 0.47 | 0.64 | 0.86 | 0.9 | 1.08 |
| WV-4171 | 0.32 | 0.62 | 0.86 | | 1 | 0.61 | 1.01 | 1.08 |
| | 0.23 | 0.69 | 1.08 | | 1.12 | 1.05 | 0.91 | 0.93 |
| WV-4148 | 0.32 | 0.52 | 0.92 | 0.83 | 1.26 | 0.73 | | 1.01 |
| | 0.22 | 0.59 | 1.16 | 1.1 | 0.86 | 1.12 | | 1.13 |
| Log Conc.(nM) | 25 | 6.25 | 1.5625 | 0.3906 | 0.0976 | 0.0244 | 0.00610 | 0.00152 |
| H2O | 0.78 | 0.86 | 0.71 | 0.67 | 0.9 | 0.65 | 0.73 | 0.92 |
| | 0.62 | 0.73 | 0.93 | 0.94 | | 0.87 | 0.72 | 0.78 |
| WV-4186 | | 0.07 | 0.18 | 0.2 | 0.32 | 0.68 | 0.69 | 0.7 |
| | 0.21 | 0.11 | 0.12 | 0.24 | 0.36 | 0.61 | 0.87 | 0.89 |
| WV-4181 | 0.24 | 0.85 | 0.75 | 0.74 | 0.96 | 0.81 | 0.82 | 1.05 |
| | 0.18 | 0.46 | 0.9 | 0.9 | | 0.76 | 1.09 | 0.85 |
| WV-4159 | 0.26 | 0.45 | | 0.75 | 0.8 | 0.98 | 0.91 | 0.92 |
| | 0.17 | 0.27 | | 0.76 | 0.75 | 0.87 | 0.92 | 0.98 |
| WV-4170 | 0.38 | 0.96 | 0.73 | 0.88 | 0.35 | 1.08 | 1.15 | 1.1 |
| | 0.3 | 0.6 | 0.88 | 0.94 | 0.85 | 1.09 | 0.84 | 1 |
| | 0.22 | 0.46 | 0.61 | 0.19 | 0.81 | 1.12 | 0.95 | 1.12 |
| WV-4147 | 0.2 | 0.34 | | | 0.8 | 0.58 | 0.76 | 1.03 |
| WV-4180 | 0.43 | 0.77 | 0.29 | 0.44 | 1 | 1.01 | 1.21 | 1.36 |
| | 0.41 | 0.46 | 0.65 | 0.32 | 0.91 | 0.44 | 1.01 | 0.93 |
| | 0.3 | 0.44 | | 0.91 | 0.54 | 0.93 | 0.82 | 1.22 |
| WV-4158 | 0.17 | 0.42 | 0.72 | 0.98 | | 1.07 | 1.11 | 1.01 |
| | 0.46 | 0.86 | 0.92 | 0.69 | 0.98 | 0.91 | 1.11 | 1.17 |
| WV-4169 | 0.34 | 0.63 | 0.96 | 1.12 | 0.78 | 1.09 | | 0.95 |
| | 0.27 | 0.56 | 0.72 | 0.83 | 0.84 | 0.86 | | 1.01 |
| WV-4146 | 0.16 | 0.45 | | 1.15 | 0.76 | 0.98 | 0.87 | 0.98 |
| | 0.56 | 0.75 | 1.12 | 1.15 | | | 0.75 | 1.04 |
| WV-4179 | 0.19 | 0.64 | 0.8 | 0.84 | 0.87 | 1.12 | 1.01 | 0.8 |
| | 0.2 | 0.33 | 0.72 | 0.85 | 1.25 | 0.87 | 1.03 | 0.99 |
| WV-4157 | 0.1 | 0.31 | 0.55 | 1.04 | 0.74 | 1.48 | 0.77 | 1.15 |
| LogConc.(nM) | 25 | 6.25 | 1.5625 | 0.390625 | 0.097656 | 0.024414 | 0.006104 | 0.001526 |
| H2O | 0.78 | 0.75 | 0.78 | 0.95 | 0.7 | 0.84 | 1.01 | 1.06 |
| | 0.68 | 0.79 | 0.84 | 0.98 | 0.56 | | 0.57 | 0.68 |
| WV-4186 | 0.06 | 0.09 | 0.12 | 0.15 | 0.61 | 0.77 | 0.82 | 0.98 |
| | 0.05 | 0.12 | 0.14 | 0.23 | 0.38 | 0.69 | 1.17 | 0.83 |
| WV-4258 | 0.29 | 0.56 | 0.71 | 0.75 | 0.81 | 0.98 | 1.01 | 1.25 |
| | 0.34 | 0.45 | 0.87 | | 0.88 | 0.82 | | 0.92 |
| WV-4248 | 0.79 | 0.69 | 0.82 | 0.77 | 0.83 | 0.86 | 0.87 | 1.01 |
| | 0.93 | 0.87 | 0.77 | | 0.8 | 1.07 | 0.97 | 1.02 |
| WV-4263 | 0.72 | 0.64 | 0.85 | 0.93 | 0.95 | 1.01 | 1.03 | 0.91 |
| | 0.81 | 0.73 | | 0.9 | | 0.86 | 0.27 | 1 |
| WV-4253 | 0.75 | 0.84 | 0.88 | 0.85 | 0.83 | 0.71 | 0.65 | 0.98 |
| | 0.92 | 0.82 | 0.73 | 0.85 | 1.02 | 0.98 | 1.03 | 1.04 |
| WV-4161 | 0.22 | 0.22 | 0.39 | 0.65 | 1.03 | 0.99 | 0.71 | 1.08 |
| | 0.17 | 0.22 | 0.35 | 0.56 | 0.93 | 0.96 | 0.94 | 1 |
| WV-2817 | 0.2 | 0.23 | 0.34 | 1.26 | 0.79 | 0.82 | 1.05 | 1.12 |
| | 0.19 | 0.24 | 0.33 | 0.64 | 0.68 | | 0.94 | 1 |
| WV-3122 | 0.19 | 0.16 | 0.31 | | 0.79 | 0.78 | 1.08 | 0.96 |
| | 0.11 | 0.18 | 0.36 | 0.44 | 0.54 | 0.81 | 0.82 | 0.88 |
| WV-3021 | 0.28 | | 0.28 | 0.45 | 0.61 | 0.94 | 1.07 | 1.06 |
| | | 0.17 | 0.31 | 0.47 | 0.64 | 0.86 | 0.9 | 1.08 |
| WV-4171 | 0.32 | 0.62 | 0.86 | | 1 | 0.61 | 1.01 | 1.08 |
| | 0.23 | 0.69 | 1.08 | | 1.12 | 1.05 | 0.91 | 0.93 |
| WV-4148 | 0.32 | 0.52 | 0.92 | 0.83 | 1.26 | 0.73 | | 1.01 |
| | 0.22 | 0.59 | 1.16 | 1.1 | 0.86 | 1.12 | | 1.13 |

As shown in Tables 48 to 60, various oligonucleotides were constructed and tested for their ability to mediate knockdown of APOC3, including in vitro. Without wishing to be bound by any theory, the present disclosure suggests that at least some of the oligonucleotides in Tables 48 to 60 may be capable of mediating knockdown via a RNaseH-mediated mechanism. FIG. 2 shows example formats of oligonucleotides. In some embodiments, oligonucleotides of these example formats can be RNase-H dependent antisense oligonucleotides (ASOs). In addition, some of the oligonucleotides in these tables have a hybrid format.

The oligonucleotide ID (identity) and position APOC3 is given. For example, WV-753 332 indicates oligonucleotide WV-753 at position 332 in the APOC3 gene. Oligonucleotides tested are: WV-692 to WV-777. In this table and various other tables, numbers indicate level of mRNA of APOC3/GAPDH, relative to untreated control, wherein 1 would represent no knockdown of APOC3 mRNA and 0 would represent 100% knockdown. Some oligonucleotides are not to target an intron of APOC3.

TABLE 48

In vitro efficacy of different ASOs which target APOC3.

| Oligonucleotide | 3 nM | 30 nM | Oligonucleotide | 3 nM | 30 nM |
|---|---|---|---|---|---|
| WV-753 332 | 0.690 | 0.075 | WV-747 151 | 0.773 | 0.464 |
| WV-744 499 | 0.634 | 0.111 | WV-705 210 | 0.803 | 0.467 |
| WV-754 333 | 0.581 | 0.112 | WV-759 142 | 0.775 | 0.469 |
| WV-742 225 | 0.576 | 0.125 | WV-772 149 | 0.905 | 0.473 |
| WV-755 334 | 0.568 | 0.150 | WV-703 159 | 0.823 | 0.480 |
| WV-743 226 | 0.607 | 0.161 | WV-706 81 | 0.831 | 0.480 |
| WV-737 193 | 0.744 | 0.161 | WV-704 160 | 0.774 | 0.483 |
| WV-769 168 | 0.695 | 0.176 | WV-709 109 | 0.769 | 0.488 |
| WV-722 267 | 0.842 | 0.179 | WV-774 115 | 0.734 | 0.490 |
| WV-738 221 | 0.634 | 0.182 | WV-702 158 | 0.771 | 0.491 |
| WV-715 330 | 0.601 | 0.182 | WV-765 319 | 0.889 | 0.493 |
| WV-721 230 | 0.766 | 0.190 | WV-713 153 | 0.825 | 0.512 |
| WV-741 224 | 0.685 | 0.200 | WV-762 310 | 0.859 | 0.528 |
| WV-723 501 | 0.542 | 0.204 | WV-711 111 | 0.897 | 0.533 |
| WV-750 186 | 0.758 | 0.210 | WV-710 110 | 0.801 | 0.536 |
| WV-749 183 | 0.691 | 0.217 | WV-776 2126 Intron | 0.834 | 0.539 |
| WV-720 229 | 0.687 | 0.232 | WV-764 318 | 0.899 | 0.542 |
| WV-752 188 | 0.759 | 0.233 | WV-763 312 | 0.905 | 0.558 |
| WV-739 222 | 0.725 | 0.236 | WV-708 108 | 0.889 | 0.559 |
| WV-714 155 | 0.789 | 0.240 | WV-696 162 | 1.043 | 0.561 |
| WV-767 321 | 0.767 | 0.246 | WV-712 112 | 0.736 | 0.570 |
| WV-717 165 | 0.716 | 0.258 | WV-693 13 | 0.748 | 0.588 |
| WV-751 187 | 0.782 | 0.260 | WV-775 314 | 0.856 | 0.600 |
| WV-736 190 | 0.743 | 0.261 | WV-778 557 Intron | 0.757 | 0.603 |
| WV-698 164 | 0.526 | 0.264 | WV-716 484 | 0.874 | 0.626 |
| WV-740 223 | 0.697 | 0.292 | WV-733 100 | 0.821 | 0.634 |
| WV-718 166 | 0.705 | 0.302 | WV-692 12 | 0.946 | 0.634 |
| WV-735 172 | 0.731 | 0.308 | WV-746 106 | 0.841 | 0.657 |
| WV-757 396 | 0.698 | 0.341 | WV-773 143 | 0.862 | 0.676 |
| WV-701 157 | 0.734 | 0.346 | WV-770 5 | 0.857 | 0.715 |
| WV-766 320 | 0.832 | 0.348 | WV-724 4 | 0.943 | 0.729 |
| WV-697 163 | 0.780 | 0.353 | WV-777 2593 Intron | 0.801 | 0.762 |
| WV-760 306 | 0.773 | 0.367 | WV-730 97 | 0.967 | 0.764 |
| WV-699 206 | 0.814 | 0.369 | WV-771 105 | 0.922 | 0.784 |
| WV-768 152 | 0.857 | 0.369 | WV-745 103 | 1.064 | 0.789 |
| WV-758 73 | 0.867 | 0.384 | WV-694 19 | 0.782 | 0.792 |
| WV-695 161 | 0.720 | 0.400 | WV-707 107 | 0.951 | 0.805 |
| WV-756 394 | 0.780 | 0.406 | WV-734 101 | 0.898 | 0.818 |
| WV-748 177 | 0.734 | 0.411 | WV-732 99 | 0.819 | 0.871 |
| WV-700 156 | 0.884 | 0.423 | WV-731 98 | 0.856 | 0.952 |
| WV-726 36 | 0.728 | 0.425 | WV-729 95 | 1.045 | 1.210 |
| WV-725 33 | 0.736 | 0.436 | WV-728 94 | 0.898 | 1.281 |
| WV-761 307 | 0.962 | 0.458 | WV-727 93 | 0.842 | 1.541 |
| WV-719 201 | 0.673 | 0.460 | | | |

The oligonucleotide ID (identity) and position APOC3 is given. For example, WV-840 499 indicates oligonucleotide WV-840 at position 499 in the APOC3 gene. Oligonucleotides tested are: WV-788 to WV-873.

TABLE 49

In vitro efficacy of different ASOs, which target APOC3.

| Oligonucleotide | 3 nM | 30 nM | Oligonucleotide | 3 nM | 30 nM |
|---|---|---|---|---|---|
| WV-840 499 | 0.387 | 0.099 | WV-794 164 | 0.613 | 0.379 |
| WV-849 332 | 0.448 | 0.109 | WV-851 334 | 0.477 | 0.387 |
| WV-853 396 | 0.668 | 0.123 | WV-871 314 | 0.628 | 0.394 |
| WV-838 225 | 0.356 | 0.146 | WV-807 111 | 0.795 | 0.400 |
| WV-852 394 | 0.650 | 0.166 | WV-809 153 | 0.768 | 0.405 |
| WV-839 226 | 0.455 | 0.167 | WV-822 36 | 0.593 | 0.418 |
| WV-837 224 | 0.466 | 0.172 | WV-806 110 | 0.741 | 0.428 |
| WV-833 193 | 0.681 | 0.174 | WV-868 149 | 0.871 | 0.442 |
| WV-831 172 | 0.570 | 0.181 | WV-805 109 | 0.761 | 0.442 |
| WV-819 501 | 0.319 | 0.189 | WV-870 115 | 0.741 | 0.442 |
| WV-847 187 | 0.553 | 0.204 | WV-855 142 | 0.687 | 0.453 |
| WV-848 188 | 0.620 | 0.210 | WV-810 155 | 0.729 | 0.454 |
| WV-845 183 | 0.586 | 0.225 | WV-796 156 | 0.677 | 0.454 |
| WV-863 321 | 0.632 | 0.227 | WV-802 81 | 0.901 | 0.469 |
| WV-791 161 | 0.843 | 0.229 | WV-798 158 | 0.799 | 0.475 |
| WV-811 330 | 0.576 | 0.244 | WV-808 112 | 0.754 | 0.475 |
| WV-836 223 | 0.379 | 0.245 | WV-858 310 | 0.712 | 0.480 |
| WV-801 210 | 0.826 | 0.246 | WV-789 13 | 0.826 | 0.494 |
| WV-832 190 | 0.695 | 0.250 | WV-821 33 | 0.652 | 0.501 |
| WV-818 267 | 0.730 | 0.251 | WV-788 12 | 0.763 | 0.520 |
| WV-813 165 | 0.707 | 0.251 | WV-804 108 | 0.692 | 0.534 |
| WV-834 211 | 0.525 | 0.256 | WV-820 4 | 0.774 | 0.553 |
| WV-816 229 | 0.549 | 0.256 | WV-872 2126 Intron | 0.674 | 0.558 |
| WV-850 333 | 0.508 | 0.257 | WV-874 557 Intron | 0.634 | 0.560 |
| WV-864 152 | 0.714 | 0.265 | WV-829 100 | 0.909 | 0.586 |
| WV-817 230 | 0.613 | 0.267 | WV-795 206 | 0.876 | 0.600 |
| WV-856 306 | 0.566 | 0.279 | WV-842 1076 | 0.752 | 0.617 |
| WV-862 320 | 0.647 | 0.280 | WV-866 5 | 0.767 | 0.622 |
| WV-861 319 | 0.751 | 0.288 | WV-830 101 | 0.809 | 0.636 |
| WV-854 73 | 0.605 | 0.289 | WV-843 151 | 0.705 | 0.657 |
| WV-844 177 | 0.777 | 0.299 | WV-873 2593 Intron | 0.883 | 0.672 |
| WV-865 168 | 0.552 | 0.304 | WV-869 143 | 0.647 | 0.680 |
| WV-799 159 | 0.802 | 0.307 | WV-841 103 | 0.974 | 0.708 |
| WV-857 307 | 0.681 | 0.315 | WV-803 107 | 0.815 | 0.716 |
| WV-792 162 | 0.917 | 0.320 | WV-790 19 | 0.942 | 0.784 |
| WV-815 201 | 0.679 | 0.330 | WV-859 312 | 0.729 | 0.785 |
| WV-846 186 | 0.576 | 0.330 | WV-867 105 | 0.756 | 0.838 |
| WV-800 160 | 0.940 | 0.331 | WV-826 97 | 0.757 | 0.876 |
| WV-812 484 | 0.684 | 0.335 | WV-828 99 | 0.630 | 0.885 |
| WV-835 222 | 0.455 | 0.336 | WV-827 98 | 0.719 | 1.015 |
| WV-793 163 | 0.906 | 0.349 | WV-825 95 | 1.070 | 1.121 |
| WV-814 166 | 0.714 | 0.350 | WV-823 93 | 1.013 | 1.289 |
| WV-860 318 | 0.690 | 0.370 | WV-824 94 | 0.846 | 1.331 |
| WV-797 157 | 0.841 | 0.372 | | | |

The oligonucleotide ID (identity) and position in APOC3 are provided. For example, WV-1434 172 indicates oligonucleotide WV-1434 at position 172 in the APOC3 gene (wherein the oligonucleotide designation and position are separated by ").

TABLE 50

In vitro efficacy of different ASOs which target APOC3.

| | 30 nM | 3 nM | | 30 nM | 3 nM |
|---|---|---|---|---|---|
| WV-1434"172 | 0.125 | 0.683 | WV-1407"108 | 0.441 | 0.669 |
| WV-1443"499 | 0.169 | 0.419 | WV-1415"484 | 0.442 | 0.703 |
| WV-1437"221 | 0.171 | 0.620 | WV-1462"312 | 0.446 | 0.833 |
| WV-1453"333 | 0.174 | 0.539 | WV-1463"318 | 0.458 | 1.022 |
| WV-1414"330 | 0.178 | 0.515 | WV-1471"149 | 0.468 | 0.963 |
| WV-1456"396 | 0.178 | 0.655 | WV-1445"106 | 0.473 | 0.884 |
| WV-1435"190 | 0.182 | 0.646 | WV-1469"5 | 0.490 | 0.817 |
| WV-1419"229 | 0.195 | 0.664 | WV-1479"792 Int | 0.514 | 0.981 |
| WV-1448"183 | 0.195 | 0.619 | WV-1391 "12 | 0.530 | 0.833 |
| WV-840 5-15 499 | 0.198 | 0.482 | WV-1392 "13 | 0.534 | 0.758 |
| WV-1442"226 | 0.208 | 0.615 | WV-1480"793 Int | 0.546 | 0.982 |
| WV-1455"394 | 0.213 | 0.671 | WV-1406"107 | 0.559 | 0.966 |
| WV-1440"224 | 0.219 | 0.523 | WV-1432"100 | 0.560 | 0.745 |
| WV-1451"188 | 0.224 | 0.626 | WV-1423"4 | 0.571 | 0.805 |
| WV-1439"223 | 0.228 | 0.539 | WV-1449"186 | 0.578 | 0.717 |
| WV-1459"306 | 0.229 | 0.697 | WV-1427"94 | 0.619 | 0.872 |
| WV-1454"334 | 0.231 | 0.641 | WV-1452"332 | 0.628 | 0.876 |
| WV-1421"267 | 0.233 | 0.627 | WV-1425"36 | 0.629 | 0.865 |
| WV-1395"162 | 0.237 | 0.797 | WV-1465"320 | 0.630 | 0.762 |
| WV-1466"321 | 0.238 | 0.598 | WV-1404"210 | 0.643 | 0.770 |
| WV-1450"187 | 0.241 | 0.769 | WV-1393"19 | 0.645 | 0.879 |
| WV-1422"501 | 0.243 | 0.525 | WV-1441"225 | 0.648 | 0.720 |
| WV-1402"159 | 0.258 | 0.658 | WV-1401"158 | 0.652 | 0.770 |
| WV-1405"81 | 0.261 | 0.714 | WV-1431"99 | 0.662 | 0.796 |
| WV-1416"165 | 0.268 | 0.549 | WV-1417"166 | 0.664 | 0.720 |
| WV-1418"201 | 0.275 | 0.658 | WV-1409"110 | 0.668 | 0.838 |
| WV-1438"222 | 0.277 | 0.501 | WV-1446"151 | 0.669 | 0.928 |
| WV-744 AIIDNA 499 | 0.288 | 0.896 | WV-1444"103 | 0.669 | 0.823 |
| WV-1458"142 | 0.290 | 0.588 | WV-1429"97 | 0.675 | 0.894 |
| WV-1394"161 | 0.292 | 0.581 | WV-1428"95 | 0.690 | 0.874 |
| WV-1424"33 | 0.296 | 0.519 | WV-1412"153 | 0.693 | 0.803 |
| WV-1474"314 | 0.300 | 0.584 | WV-1473"115 | 0.696 | 0.668 |
| WV-1461"310 | 0.310 | 0.718 | WV-1476"2593 Int | 0.697 | 1.073 |
| WV-1397"164 | 0.313 | 0.767 | WV-1420"230 | 0.711 | 0.525 |
| WV-1411"112 | 0.314 | 0.584 | WV-1396"163 | 0.718 | 0.880 |
| WV-1403"160 | 0.321 | 0.591 | WV-1436"193 | 0.719 | 0.970 |
| WV-1467"152 | 0.325 | 0.926 | WV-1433"101 | 0.724 | 0.395 |
| WV-1464"319 | 0.326 | 0.524 | WV-1457"73 | 0.729 | 1.001 |
| WV-1410"111 | 0.329 | 0.426 | WV-1426"93 | 0.760 | 0.832 |
| WV-1413"155 | 0.337 | 0.714 | WV-1468"168 | 0.769 | 0.971 |
| WV-1408"109 | 0.364 | 0.753 | WV-1430"98 | 0.782 | 0.829 |
| WV-1447"177 | 0.365 | 0.759 | WV-1470"105 | 0.800 | 0.618 |
| WV-1400"157 | 0.371 | 0.604 | WV-1460"307 | 0.804 | 0.880 |
| WV-1477"557 Int | 0.386 | 0.790 | WV-1481"796 Int | 0.810 | 1.319 |
| WV-1398"206 | 0.397 | 0.619 | TR Only" | 0.974 | 0.961 |
| WV-1399"156 | 0.410 | 0.753 | WV-1478"780 Int | 0.992 | 1.403 |
| WV-1472"143 | 0.418 | 0.776 | TR Only" | 1.026 | 1.039 |
| WV-1475"2126 Int | 0.419 | 0.881 | | | |

The oligonucleotide ID (identity) and position in APOC3 are provided. FOXO1 ASOs were also tested (data not shown).

TABLE 51

In vitro efficacy of different ASOs, which target APOC3.

| | 3 nM | 30 nM | 3 nM | 30 nM |
|---|---|---|---|---|
| WV-779 780 | 0.981 | 0.695 | 0.113 | 0.013 |
| WV-780 792 | 0.921 | 0.623 | 0.096 | 0.003 |
| WV-781 793 | 0.877 | 0.568 | 0.061 | 0.049 |
| WV-782 796 | 0.818 | 0.546 | 0.071 | 0.060 |
| WV-783 1130 | 0.886 | 0.709 | 0.086 | 0.057 |
| WV-784 2649 | 0.872 | 0.419 | 0.139 | 0.022 |
| WV-785 2734 | 0.876 | 0.756 | 0.115 | 0.056 |
| WV-786 2771 | 0.871 | 0.770 | 0.017 | 0.017 |
| WV-787 2803 | 0.896 | 0.681 | 0.003 | 0.042 |
| WV-875 | 0.922 | 0.559 | 0.139 | 0.014 |
| WV-876 | 0.782 | 0.493 | 0.052 | 0.007 |
| WV-877 | 0.865 | 0.510 | 0.014 | 0.024 |
| WV-878 | 0.717 | 0.462 | 0.232 | 0.025 |
| WV-879 | 0.887 | 0.795 | 0.027 | 0.020 |
| WV-880 | 0.719 | 0.361 | 0.152 | 0.020 |
| WV-881 | 0.888 | 0.790 | 0.053 | 0.084 |
| WV-882 | 0.909 | 0.665 | 0.197 | 0.060 |
| WV-883 | 0.900 | 0.630 | 0.100 | 0.079 |

The oligonucleotide ID (identity) and position in APOC3 are provided.

TABLE 52

In vitro efficacy of different ASOs, which target APOC3.

| Conc (exp 10) (nM) | WV-744 499 | | WV-753 332 | | WV-742 225 | |
|---|---|---|---|---|---|---|
| 1.778  | 0.11 | −0.01 | −0.07 | −0.06 | −0.08 | −0.01 |
| 1.301  | 0.18 | 0.17  | 0.07  | 0.02  | 0.06  | 0.01 |
| 0.824  | 0.47 | 0.32  | 0.32  | 0.27  | 0.24  | 0.15 |
| 0.347  | 0.76 | 0.59  | 0.64  | 0.59  | 0.66  | 0.57 |
| −0.130 | 1.01 | 0.90  | 0.88  | 0.73  | 0.91  | 0.65 |
| −0.607 | 1.26 | 0.99  | 0.95  | 0.81  | 0.97  | 0.80 |
| −1.085 | 1.02 | 1.02  | 1.03  | 0.85  | 0.90  | 0.94 |
| −1.562 |      |       |       |       |       |      |

| Conc (exp 10) (nM) | WV-737 193 | | WV-840 499 | | WV-849 332 | |
|---|---|---|---|---|---|---|
| 1.778  | −0.01 | −0.06 | −0.04 | −0.03 | −0.05 | −0.08 |
| 1.301  | 0.09  | 0.09  | 0.01  | 0.01  | 0.05  | 0.05 |
| 0.824  | 0.57  | 0.38  | 0.18  | 0.11  | 0.16  | 0.16 |
| 0.347  | 0.82  | 0.76  | 0.37  | 0.32  | 0.44  | 0.41 |
| −0.130 | 0.91  | 0.85  | 0.65  | 0.57  | 0.73  | 0.68 |
| −0.607 | 1.07  | 1.06  | 1.04  | 0.76  | 1.09  | 0.89 |
| −1.085 | 1.02  | 1.07  | 0.92  | 0.97  | 1.00  | 0.83 |
| −1.562 |       |       |       |       |       |      |

| Conc (exp 10) (nM) | WV-838 225 | | WV-833 193 | | WV-1443 499 | |
|---|---|---|---|---|---|---|
| 1.778  | −0.07 | −0.07 | 0.01 | 0.00 | 0.10 | 0.19 |
| 1.301  | 0.04  | −0.01 | 0.09 | 0.06 | 0.32 | 0.21 |
| 0.824  | 0.13  | 0.09  | 0.34 | 0.27 | 0.30 | 0.26 |
| 0.347  | 0.40  | 0.30  | 0.68 | 0.61 | 0.43 | 0.45 |
| −0.130 | 0.71  | 0.74  | 0.94 | 0.98 | 0.81 | 0.64 |
| −0.607 | 1.00  | 0.95  | 1.16 | 0.95 | 0.95 | 0.71 |
| −1.085 | 1.08  | 1.06  | 1.09 | 0.99 | 0.88 | 0.92 |
| −1.562 |       |       |      |      | 1.04 | 1.19 |

| Conc (exp 10) (nM) | WV-1452 332 | | WV-1441 225 | | WV-1436 193 | |
|---|---|---|---|---|---|---|
| 1.778  | 0.02 | 0.01 | 0.13 | 0.05 | 0.07 | 0.09 |
| 1.301  | 0.10 | 0.10 | 0.18 | 0.15 | 0.28 | 0.26 |
| 0.824  | 0.27 | 0.34 | 0.37 | 0.31 | 0.57 | 0.68 |
| 0.347  | 0.63 | 0.44 | 0.73 | 0.55 | 0.78 | 0.82 |
| −0.130 | 0.86 | 0.80 | 0.89 | 0.82 | 0.84 | 0.97 |
| −0.607 | 1.11 | 0.88 | 1.07 | 1.00 | 1.12 | 0.95 |
| −1.085 | 0.92 | 0.93 | 0.94 | 0.95 | 0.72 | 1.05 |
| −1.562 | 1.43 | 0.89 | 1.27 | 0.96 | 0.83 | 1.03 |

| Conc (exp 10) (nM) | WV-437 | |
|---|---|---|
| 1.778  | 1.37 | 1.43 |
| 1.301  | 1.21 | 1.18 |
| 0.824  | 0.99 | 1.03 |
| 0.347  | 1.25 | 1.25 |
| −0.130 | 1.14 | 1.06 |
| −0.607 | 1.49 | 1.20 |
| −1.085 | 1.46 | 1.44 |
| −1.562 |      |      |

|        | WV-744 499 | WV-753 332 | WV-742 225 | WV-737 931 | WV-840 499 | WV-849 332 |
|---|---|---|---|---|---|---|
| 1.778  | 0.08 | 0.01 | 0.05 | 0.04 | 0.00 | 0.02 |
| 1.301  | 0.01 | 0.04 | 0.03 | 0.00 | 0.01 | 0.00 |
| 0.824  | 0.11 | 0.03 | 0.06 | 0.14 | 0.05 | 0.00 |
| 0.347  | 0.12 | 0.03 | 0.06 | 0.04 | 0.03 | 0.02 |
| −0.130 | 0.08 | 0.11 | 0.19 | 0.04 | 0.06 | 0.04 |
| −0.607 | 0.19 | 0.09 | 0.12 | 0.01 | 0.20 | 0.14 |
| −1.085 | 0.00 | 0.13 | 0.03 | 0.04 | 0.04 | 0.12 |

|        | WV-838 225 | WV-833 193 | WV-1443 499 | WV-1452 332 | WV-1441 225 | WV-1436 193 | WV-437 |
|---|---|---|---|---|---|---|---|
| 1.778  | 0.00 | 0.01 | 0.07 | 0.01 | 0.05 | 0.02 | 0.04 |
| 1.301  | 0.04 | 0.02 | 0.08 | 0.01 | 0.02 | 0.02 | 0.02 |
| 0.824  | 0.03 | 0.05 | 0.03 | 0.05 | 0.04 | 0.08 | 0.02 |
| 0.347  | 0.07 | 0.05 | 0.01 | 0.13 | 0.13 | 0.03 | 0.00 |
| −0.130 | 0.02 | 0.03 | 0.12 | 0.05 | 0.05 | 0.10 | 0.05 |
| −0.607 | 0.04 | 0.15 | 0.17 | 0.16 | 0.05 | 0.12 | 0.20 |

TABLE 52-continued

In vitro efficacy of different ASOs, which target APOC3.

| | | | | | | | |
|---|---|---|---|---|---|---|---|
| −1.085 | 0.02 | 0.07 | 0.03 | 0.01 | 0.01 | 0.24 | 0.01 |
| −1.562 | | | 0.10 | 0.39 | 0.22 | 0.14 | |

The oligonucleotide ID (identity) and position in APOC3 are provided.

TABLE 53

In vitro efficacy screening of different ASOs which target APOC3.

| | 30 nM | 10 nM | 3 nM | | 30 nM | 10 nM | 3 nM |
|---|---|---|---|---|---|---|---|
| WV-1863 330 | 0.068 | 0.128 | 0.303 | WV-1874 223 | 0.190 | 0.215 | 0.362 |
| WV-1878 499 | 0.072 | 0.122 | 0.204 | WV-1875 224 | 0.197 | 0.257 | 0.326 |
| WV-1864 165 | 0.076 | 0.219 | 0.566 | WV-1852 164 | 0.202 | 0.272 | 0.659 |
| WV-1886 394 | 0.079 | 0.184 | 0.360 | WV-1856 159 | 0.209 | 0.489 | 0.732 |
| WV-1870 172 | 0.083 | 0.120 | 0.236 | WV-1851 162 | 0.233 | 0.537 | 0.846 |
| WV-1887 396 | 0.086 | 0.287 | 0.587 | WV-1858 81 | 0.247 | 0.296 | 0.667 |
| WV-1868 501 | 0.094 | 0.091 | 0.141 | WV-1888 142 | 0.248 | 0.522 | 0.716 |
| WV-1883 332 | 0.104 | 0.182 | 0.271 | WV-1865 201 | 0.248 | 0.342 | 0.724 |
| WV-1885 334 | 0.109 | 0.255 | 0.325 | WV-1890 310 | 0.252 | 0.645 | 0.626 |
| WV-1884 333 | 0.118 | 0.223 | 0.352 | WV-1869 33 | 0.258 | 0.380 | 0.578 |
| WV-1876 225 | 0.126 | 0.257 | 0.343 | WV-1850 161 | 0.258 | 0.444 | 0.781 |
| WV-1880 183 | 0.135 | 0.354 | 0.541 | WV-1893 152 | 0.267 | 0.695 | 0.630 |
| WV-1867 267 | 0.135 | 0.315 | 0.464 | WV-1891 319 | 0.284 | 0.553 | 0.632 |
| WV-1871 190 | 0.138 | 0.164 | 0.410 | WV-1857 160 | 0.285 | 0.525 | 1.059 |
| WV-1873 222 | 0.147 | 0.251 | 0.383 | WV-1862 155 | 0.294 | 0.635 | 0.645 |
| WV-1872 221 | 0.149 | 0.237 | 0.367 | WV-1855 157 | 0.308 | 0.611 | 0.743 |
| WV-1889 306 | 0.160 | 0.284 | 0.550 | WV-1853 206 | 0.328 | 0.405 | 0.875 |
| WV-1879 177 | 0.168 | 0.370 | 0.596 | WV-1860 111 | 0.337 | 0.727 | 0.652 |
| WV-1892 321 | 0.169 | 0.485 | 0.618 | WV-1854 156 | 0.337 | 0.628 | 0.685 |
| WV-1881 187 | 0.174 | 0.218 | 0.390 | WV-1861 112 | 0.373 | 0.568 | 0.603 |
| WV-1882 188 | 0.182 | 0.350 | 0.586 | WV-1859 109 | 0.456 | 0.627 | 0.644 |
| WV-1866 229 | 0.186 | 0.261 | 0.415 | Control | 1.013 | 1.191 | 0.806 |
| | | | | WV-744 | 0.070 | 0.207 | 0.381 |
| | | | | WV-840 | 0.051 | 0.115 | 0.169 |
| | | | | WV-1443 | 0.205 | 0.246 | 0.194 |

Table 54 shows in vitro efficacy of different ASOs, which target APOC3. Oligonucleotides tested are: WV-1868, WV-1878, WV-1887, WV-1886, WV-1885, WV-1884, WV-1883, WV-1863, WV-1876, WV-1871, WV-1870 and WV-1864.

TABLE 54

Activity of oligonucleotides.

| Conc (exp 10) (nM) | WV-1868 | | WV-1878 | | WV-1887 | | WV-1886 | |
|---|---|---|---|---|---|---|---|---|
| 1.477 | 0.114 | 0.072 | 0.138 | 0.100 | 0.098 | 0.123 | 0.182 | 0.123 |
| 1.000 | 0.150 | 0.102 | 0.119 | 0.142 | 0.321 | 0.405 | 0.175 | 0.357 |
| 0.523 | 0.208 | 0.222 | 0.191 | 0.264 | 0.556 | 1.242 | 0.448 | 0.860 |
| 0.046 | 0.307 | 0.372 | 0.521 | 0.539 | 0.735 | 0.986 | 0.785 | 1.236 |
| −0.431 | 0.386 | 0.441 | 0.536 | 0.784 | 0.770 | 1.003 | 0.714 | 0.734 |
| −0.908 | 0.578 | 0.817 | 0.747 | 0.793 | 0.808 | 1.253 | 0.996 | 0.898 |
| −1.386 | 0.715 | 0.808 | 0.742 | 1.476 | 0.888 | 0.851 | 0.869 | 1.028 |

| Conc (exp 10) (nM) | WV-1885 | | WV-1884 | | WV-1883 | | WV-1863 | |
|---|---|---|---|---|---|---|---|---|
| 1.477 | 0.156 | 0.148 | 0.200 | 0.150 | 0.138 | 0.085 | 0.097 | 0.074 |
| 1.000 | 0.254 | 0.358 | 0.294 | 0.293 | 0.261 | 0.198 | 0.180 | 0.207 |
| 0.523 | 0.353 | 0.553 | 0.391 | 0.554 | 0.413 | 0.399 | 0.277 | 0.430 |
| 0.046 | 0.590 | 0.776 | 0.548 | 0.748 | 0.531 | 0.611 | 0.553 | 0.731 |
| −0.431 | 0.703 | 0.939 | 0.582 | 0.795 | 0.794 | 0.635 | 0.575 | 0.731 |
| −0.908 | 0.797 | 0.846 | 0.769 | 0.702 | 0.910 | 0.694 | 0.846 | 0.921 |
| −1.386 | 0.747 | 1.063 | 0.787 | 0.828 | 0.831 | 0.797 | 0.725 | 1.137 |

TABLE 54-continued

Activity of oligonucleotides.

| Conc (exp 10) (nM) | WV-1876 | | WV-1871 | | WV-1870 | | WV-1864 | |
|---|---|---|---|---|---|---|---|---|
| 1.477 | 0.168 | 0.115 | 0.103 | 0.109 | 0.131 | 0.112 | 0.104 | 0.121 |
| 1.000 | 0.275 | 0.375 | 0.217 | 0.277 | 0.132 | 0.223 | 0.267 | 0.379 |
| 0.523 | 0.304 | 0.564 | 0.315 | 0.844 | 0.333 | 0.536 | 0.671 | 0.669 |
| 0.046 | 0.461 | 0.883 | 0.590 | 1.093 | 0.630 | 0.924 | 0.819 | 0.817 |
| −0.431 | 0.613 | 0.763 | 0.662 | 0.825 | 0.710 | 0.916 | 0.916 | 1.008 |
| −0.908 | 0.551 | 0.783 | 0.844 | 0.914 | 0.866 | 0.964 | 1.005 | 0.758 |
| −1.386 | 0.903 | 1.188 | 0.816 | 1.542 | 0.759 | 0.924 | 0.906 | 0.946 |

Table 55. Table 55 shows the IC50 of different ASOs, which target APOC3. Oligonucleotides tested are: WV-723, WV-819, WV-1422, and WV-1868.

TABLE 55

Activity of oligonucleotides.

| Oligonucleotide | IC50 (nM) |
|---|---|
| WV-723 | 1.5 |
| WV-819 | 0.5 |
| WV-1422 | 0.9 |
| WV-1868 | 1.4 |

Table 56. Table 56 shows in vitro efficacy of different ASOs, which target APOC3. Oligonucleotides tested are:

WV-2115 to WV-2124, WV-2126, and WV-1422. The oligonucleotides have different but overlapping base sequences.

TABLE 56

Activity of oligonucleotides.

| Conc (exp 10) (nM) | WV-2115 | | WV-2116 | | WV-2117 | |
|---|---|---|---|---|---|---|
| 1.477 | 0.169 | 0.160 | 0.165 | 0.191 | 0.150 | 0.271 |
| 1.000 | 0.164 | 0.320 | 0.219 | 0.194 | 0.404 | 0.264 |
| 0.523 | 0.298 | 0.477 | 0.258 | 0.419 | 0.879 | 0.549 |
| 0.046 | 0.495 | 0.562 | 0.615 | 0.662 | 1.078 | 0.724 |
| −0.431 | 0.589 | 0.699 | 0.394 | 0.706 | 1.176 | 0.685 |
| −0.908 | 0.732 | 0.784 | 0.708 | 0.793 | 0.929 | 0.886 |
| −1.386 | 0.972 | 0.832 | 0.958 | 0.812 | 1.292 | 0.871 |
| −1.863 | 0.887 | 0.924 | 1.051 | 1.019 | 1.014 | 1.126 |

| Conc (exp 10) (nM) | WV-2118 | | WV-2119 | | WV-2120 | |
|---|---|---|---|---|---|---|
| 1.477 | 0.350 | 0.242 | 0.285 | 0.254 | 0.442 | 0.323 |
| 1.000 | 0.521 | 0.310 | 0.358 | 0.297 | 0.651 | 0.246 |
| 0.523 | 0.936 | 0.534 | 0.877 | 0.811 | 0.548 | 0.477 |
| 0.046 | 1.808 | 0.629 | 1.252 | 1.005 | 1.096 | 0.706 |
| −0.431 | 1.296 | 0.777 | 1.204 | 0.900 | 1.033 | 0.722 |
| −0.908 | 0.869 | 1.080 | 0.737 | 0.761 | 0.951 | 0.735 |
| −1.386 | 0.865 | 0.830 | 0.910 | 1.009 | 0.946 | 0.809 |
| −1.863 | 0.968 | 1.029 | 1.318 | 1.071 | 1.094 | 0.864 |

| Conc (exp 10) (nM) | WV-2121 | | WV-2122 | | WV-2123 | |
|---|---|---|---|---|---|---|
| 1.477 | 0.528 | 0.355 | 0.316 | 0.267 | 0.257 | 0.260 |
| 1.000 | 0.339 | 0.228 | 0.415 | 0.212 | 0.377 | 0.298 |
| 0.523 | 0.622 | 0.349 | 0.553 | 0.439 | 0.310 | 0.347 |
| 0.046 | 0.808 | 0.687 | 1.331 | 0.564 | 0.508 | 0.730 |
| −0.431 | 1.008 | 0.706 | 0.960 | 0.714 | 0.716 | 0.643 |
| −0.908 | 0.700 | 0.797 | 1.011 | 1.014 | 0.742 | 0.730 |
| −1.386 | 1.124 | 0.835 | 1.158 | 0.883 | 0.728 | 0.774 |
| −1.863 | 1.148 | 1.026 | 0.898 | 0.926 | 0.835 | 1.142 |

| Conc (exp 10) (nM) | WV-2124 | | WV-2126 | | WV-1422 IC50 = 0.29 nM | |
|---|---|---|---|---|---|---|
| 1.477 | 0.333 | 0.314 | 0.258 | 0.294 | 0.100 | 0.131 |
| 1.000 | 0.408 | 0.260 | 0.210 | 0.248 | 0.182 | 0.170 |
| 0.523 | 0.390 | 0.283 | 0.355 | 0.342 | 0.245 | 0.230 |
| 0.046 | 0.492 | 0.439 | 0.572 | 0.520 | 0.293 | 0.353 |
| −0.431 | 1.139 | 0.533 | 0.754 | 0.636 | 0.451 | 0.528 |
| −0.908 | 0.713 | 0.683 | 0.796 | 0.692 | 0.600 | 0.591 |
| −1.386 | 1.054 | 0.915 | 1.240 | 0.736 | 0.756 | 0.693 |
| −1.863 | 0.902 | 0.987 | 0.886 | 0.885 | | |

Table 57. Table 57 shows in vitro efficacy of different ASOs, which target APOC3. Oligonucleotides tested are: WV-2128 to WV-2139, and WV-1868. The oligonucleotides have different but overlapping base sequences.

TABLE 57

Activity of oligonucleotides.

| Conc (exp 10) (nM) | WV-2128 | | WV-2129 | | WV-2130 | |
|---|---|---|---|---|---|---|
| 1.477 | 0.224 | 0.270 | 0.214 | 0.239 | 0.231 | 0.227 |
| 1.000 | 0.246 | 0.210 | 0.201 | 0.194 | 0.385 | 0.303 |
| 0.523 | 0.405 | 0.480 | 0.318 | 0.326 | 0.540 | 0.447 |
| 0.046 | 0.550 | 0.564 | 0.547 | 0.534 | 0.751 | 0.862 |
| −0.431 | 0.968 | 0.865 | 0.742 | 0.835 | 0.910 | 1.249 |
| −0.908 | 0.955 | 0.948 | 0.909 | 0.812 | 1.003 | 1.267 |
| −1.386 | 0.907 | 1.074 | 0.964 | 0.990 | 1.007 | 1.031 |
| −1.863 | 1.007 | 1.026 | 1.118 | 1.016 | 1.114 | 0.965 |

| Conc (exp 10) (nM) | WV-2131 | | WV-2132 | | WV-2133 | |
|---|---|---|---|---|---|---|
| 1.477 | 0.329 | 0.339 | 0.300 | 0.279 | 0.433 | 0.287 |
| 1.000 | 0.430 | 0.329 | 0.367 | 0.404 | 0.434 | 0.355 |
| 0.523 | 0.652 | 1.132 | 0.727 | 0.918 | 0.450 | 0.565 |
| 0.046 | 0.836 | 0.829 | 1.075 | 0.958 | 0.747 | 0.687 |
| −0.431 | 1.251 | 1.341 | 0.990 | 1.231 | 1.004 | 1.313 |
| −0.908 | 0.982 | 0.990 | 0.914 | 1.438 | 0.989 | 0.917 |
| −1.386 | 1.011 | 1.033 | 1.049 | 1.095 | 1.100 | 1.013 |
| −1.863 | 1.058 | 0.894 | 0.973 | 1.010 | 0.937 | 0.927 |

| Conc (exp 10) (nM) | WV-2134 | | WV-2135 | | WV-2136 | |
|---|---|---|---|---|---|---|
| 1.477 | 0.379 | 0.389 | 0.346 | 0.358 | 0.455 | 0.483 |
| 1.000 | 0.264 | 0.225 | 0.261 | 0.301 | 0.324 | 0.300 |
| 0.523 | 0.402 | 0.372 | 0.355 | 0.408 | 0.337 | 0.342 |
| 0.046 | 0.574 | 0.573 | 0.564 | 0.582 | 0.444 | 0.442 |
| −0.431 | 0.756 | 0.480 | 0.874 | 0.975 | 0.647 | 0.957 |
| −0.908 | 0.887 | 0.817 | 0.923 | 1.070 | 0.764 | 0.833 |
| −1.386 | 1.038 | 1.405 | 1.033 | 0.909 | 0.941 | 0.889 |
| −1.863 | 1.127 | 0.933 | 0.880 | 1.062 | 1.008 | 0.959 |

| Conc (exp 10) (nM) | WV-2137 | | WV-2139 | | WV-1868 IC50 = 0.62 nM | |
|---|---|---|---|---|---|---|
| 1.477 | 0.425 | 0.494 | 0.377 | 0.395 | 0.119 | 0.153 |
| 1.000 | 0.292 | 0.419 | 0.302 | 0.255 | 0.121 | 0.188 |
| 0.523 | 0.308 | 0.320 | 0.328 | 0.326 | 0.291 | 0.276 |
| 0.046 | 0.432 | 0.466 | 0.658 | 0.605 | 0.389 | 0.353 |
| −0.431 | 0.615 | 0.842 | 0.958 | 0.954 | 0.618 | 0.735 |
| −0.908 | 0.957 | 0.792 | 0.847 | 0.859 | 0.797 | 0.786 |
| −1.386 | 0.940 | 0.930 | 0.941 | 0.923 | 0.955 | 0.859 |
| −1.863 | 0.894 | 1.164 | 0.886 | 1.041 | | |

Table 58. Table 58 shows in vitro efficacy of different ASOs, which target APOC3. Oligonucleotides tested are: WV-2549 to WV-2554, WV-1422, and WV-1868. The oligonucleotides differ in overall length and in the length of the wings and core, and in stereochemistry.

IC50 for various oligonucleotides is presented in parentheses after the oligonucleotide designation.

TABLE 58

Activity of oligonucleotides.

| Conc (exp 10) (nM) | WV-2549 (IC50 = 4.5 nM) | | WV-2550 (5.2 nM) | | WV-2551 (5.0 nM) | |
|---|---|---|---|---|---|---|
| 1.477 | 0.280 | 0.246 | 0.442 | 0.463 | 0.323 | 0.332 |
| 1.079 | 0.383 | 0.439 | 0.666 | 0.489 | 0.545 | 0.446 |
| 0.681 | 0.544 | 0.538 | 0.810 | 0.745 | 0.699 | 0.580 |
| 0.283 | 0.718 | 0.814 | 0.937 | 0.973 | 0.914 | 0.894 |
| −0.115 | 0.826 | 0.817 | 1.075 | 1.272 | 0.802 | 0.997 |
| −0.513 | 0.830 | 1.212 | 1.106 | 1.262 | 1.057 | 1.160 |
| −0.911 | 0.840 | 1.030 | 0.949 | 1.370 | 1.024 | 1.264 |
| −1.308 | 0.859 | 1.103 | 1.014 | 1.113 | 0.993 | 1.218 |
| −1.706 | 0.987 | 1.016 | 1.177 | 0.984 | 0.966 | 1.049 |
| −2.104 | 0.942 | 0.948 | 0.835 | 1.054 | 1.022 | 1.110 |
| −2.502 | 1.182 | 1.022 | 0.982 | 0.949 | 0.942 | 0.935 |

TABLE 58-continued

Activity of oligonucleotides.

| Conc (exp 10) (nM) | WV-2552 (3.3 nM) | | WV-2553 (4.2 nM) | | WV-2554 (2.9 nM) | |
|---|---|---|---|---|---|---|
| 1.477 | 0.306 | 0.366 | 0.245 | 0.248 | 0.288 | 0.212 |
| 1.079 | 0.496 | 0.464 | 0.441 | 0.423 | 0.369 | 0.216 |
| 0.681 | 0.504 | 0.492 | 0.527 | 0.650 | 0.583 | 0.433 |
| 0.283 | 1.017 | 0.768 | 0.720 | 0.889 | 0.769 | 0.703 |
| −0.115 | 0.811 | 0.865 | 0.809 | 1.058 | 0.800 | 0.788 |
| −0.513 | 1.030 | 0.920 | 1.307 | 1.148 | 1.015 | 1.047 |
| −0.911 | 1.027 | 1.132 | 1.021 | 1.215 | 1.064 | 1.243 |
| −1.308 | 0.787 | 1.188 | 0.928 | 0.943 | 0.955 | 0.951 |
| −1.706 | 1.123 | 1.146 | 1.002 | 1.199 | 1.009 | 0.938 |
| −2.104 | 0.892 | 1.032 | 1.005 | 0.883 | 0.976 | 0.909 |
| −2.502 | 1.054 | 0.906 | 0.977 | 0.955 | 0.986 | 0.994 |

| Conc (exp 10) (nM) | WV-1868 (1.4 nM) | | WV-1422 (1 M) | |
|---|---|---|---|---|
| 1.477 | 0.219 | 0.185 | 0.251 | 0.226 |
| 1.079 | 0.272 | 0.189 | 0.352 | 0.322 |
| 0.681 | 0.435 | 0.323 | 0.446 | 0.461 |
| 0.283 | 0.603 | 0.492 | 0.535 | 0.713 |
| −0.115 | 0.633 | 0.771 | 0.689 | 0.815 |
| −0.513 | 0.808 | 0.979 | 0.951 | 0.999 |
| −0.911 | 0.934 | 1.216 | 0.931 | 1.054 |
| −1.308 | 1.045 | 1.209 | 0.921 | 0.915 |
| −1.706 | 1.196 | 0.963 | 1.128 | 1.053 |
| −2.104 | 0.912 | 0.947 | 0.927 | 0.993 |
| −2.502 | 0.904 | 0.948 | 0.945 | 0.955 |

Table 59. Table 59 shows in vitro efficacy of different ASOs, which target APOC3. The oligonucleotides differ in overall length and in the length of the wings and core, and in stereochemistry.

The IC50 is presented after the designation of the oligonucleotide.

TABLE 59

Activity of oligonucleotides.

| Conc (exp 10) (nM) | WV-2549 1.76 nM | | WV-2550 3.1 nM | | WV-2551 1.8 nM | |
|---|---|---|---|---|---|---|
| 1.477 | 0.368 | 0.473 | 0.435 | 0.499 | 0.444 | 0.446 |
| 1.079 | 0.482 | 0.479 | 0.472 | 0.550 | 0.390 | 0.365 |
| 0.681 | 0.614 | 0.558 | 0.656 | 0.685 | 0.432 | 0.421 |
| 0.283 | 0.759 | 0.613 | 0.812 | 0.842 | 0.742 | 0.672 |
| −0.115 | 0.843 | 0.927 | 0.995 | 0.977 | 0.847 | 0.842 |
| −0.513 | 0.858 | 1.102 | 1.094 | 1.096 | 0.869 | 0.948 |
| −0.911 | 0.972 | 1.262 | 1.044 | 1.109 | 0.941 | 1.035 |
| −1.308 | 1.025 | 1.047 | 1.015 | 1.085 | 1.047 | 1.016 |
| −1.706 | 1.086 | 1.098 | 0.969 | 1.041 | 0.976 | 0.909 |
| −2.104 | 0.889 | 0.856 | 1.017 | 0.908 | 0.978 | 0.881 |

| Conc (exp 10) (nM) | WV-2552 1.8 nM | | WV-2553 1.4 nM | | WV-2554 1.3 nM | |
|---|---|---|---|---|---|---|
| 1.477 | 0.643 | 0.438 | 0.303 | 0.303 | 0.227 | 0.262 |
| 1.079 | 0.497 | 0.376 | 0.349 | 0.238 | 0.215 | 0.199 |
| 0.681 | 0.519 | 0.454 | 0.441 | 0.394 | 0.326 | 0.295 |
| 0.283 | 0.755 | 0.694 | 0.627 | 0.509 | 0.543 | 0.477 |
| −0.115 | 1.022 | 0.868 | 0.807 | 0.610 | 0.710 | 0.641 |
| −0.513 | 1.093 | 0.958 | 0.962 | 0.811 | 0.836 | 0.847 |
| −0.911 | 0.989 | 1.142 | 0.997 | 0.964 | 0.856 | 0.986 |
| −1.308 | 1.037 | 1.109 | 1.045 | 1.006 | 1.021 | 0.935 |
| −1.706 | 1.031 | 0.873 | 0.922 | 0.809 | 1.019 | 0.821 |
| −2.104 | 0.932 | 0.795 | 1.033 | 0.836 | 0.960 | 0.869 |

TABLE 59-continued

Activity of oligonucleotides.

| Conc (exp 10) (nM) | WV-2677 1.5 nM | | WV-2678 1.8 nM | | WV-1422 1.1 nM | |
|---|---|---|---|---|---|---|
| 1.477 | 0.214 | 0.151 | 0.293 | 0.240 | 0.404 | 0.369 |
| 1.079 | 0.214 | 0.148 | 0.321 | 0.240 | 0.416 | 0.436 |
| 0.681 | 0.388 | 0.265 | 0.456 | 0.386 | 0.490 | 0.496 |
| 0.283 | 0.538 | 0.406 | 0.616 | 0.535 | 0.794 | 0.650 |
| −0.115 | 0.779 | 0.592 | 0.959 | 0.748 | 0.716 | 0.851 |
| −0.513 | 0.836 | 0.920 | 0.883 | 1.006 | 0.809 | 0.987 |
| −0.911 | 0.926 | 1.043 | 1.016 | 1.135 | 1.070 | 1.107 |
| −1.308 | 1.037 | 0.816 | 1.045 | 0.930 | 1.176 | 0.996 |
| −1.706 | 1.071 | 0.766 | 1.178 | 0.873 | | |
| −2.104 | 0.892 | 0.742 | 0.778 | 0.839 | | |

| Conc (exp 10) (nM) | WV-1868 1.65 nM | |
|---|---|---|
| 1.477 | 0.262 | 0.332 |
| 1.079 | 0.358 | 0.308 |
| 0.681 | 0.378 | 0.520 |
| 0.283 | 0.498 | 0.659 |
| −0.115 | 0.813 | 0.809 |
| −0.513 | 1.120 | 0.947 |
| −0.911 | 0.824 | 0.964 |
| −1.308 | | |
| −1.706 | | |
| −2.104 | | |

Table 60. Tables 60A to H show the efficacy and stability of different ASOs, which target APOC3. Oligonucleotides tested are: Table 60A, WV-2551, WV-2553, WV-2554, WV-2678, WV-2677, and WV-1868. The oligonucleotides differ in the length of the wings and core, and in stereochemistry.

The IC50 is presented after the designation of the oligonucleotide.

TABLE 60A

Activity of oligonucleotides.

| Conc (exp 10) (nM) | WV-2549 1.76 nM | | WV-2550 3.1 nM | | WV-2551 1.8nM | |
|---|---|---|---|---|---|---|
| 1.477 | 0.368 | 0.473 | 0.435 | 0.499 | 0.444 | 0.446 |
| 1.079 | 0.482 | 0.479 | 0.472 | 0.550 | 0.390 | 0.365 |
| 0.681 | 0.614 | 0.558 | 0.656 | 0.685 | 0.432 | 0.421 |
| 0.283 | 0.759 | 0.613 | 0.812 | 0.842 | 0.742 | 0.672 |
| −0.115 | 0.843 | 0.927 | 0.995 | 0.977 | 0.847 | 0.842 |
| −0.513 | 0.858 | 1.102 | 1.094 | 1.096 | 0.869 | 0.948 |
| −0.911 | 0.972 | 1.262 | 1.044 | 1.109 | 0.941 | 1.035 |
| −1.308 | 1.025 | 1.047 | 1.015 | 1.085 | 1.047 | 1.016 |
| −1.706 | 1.086 | 1.098 | 0.969 | 1.041 | 0.976 | 0.909 |
| −2.104 | 0.889 | 0.856 | 1.017 | 0.908 | 0.978 | 0.881 |
| Conc (exp 10) (nM) | WV-2552 1.8 nM | | WV-2553 1.4 nM | | WV-2554 1.3 nM | |
| 1.477 | 0.643 | 0.438 | 0.303 | 0.303 | 0.227 | 0.262 |
| 1.079 | 0.497 | 0.376 | 0.349 | 0.238 | 0.215 | 0.199 |
| 0.681 | 0.519 | 0.454 | 0.441 | 0.394 | 0.326 | 0.295 |
| 0.283 | 0.755 | 0.694 | 0.627 | 0.509 | 0.543 | 0.477 |
| −0.115 | 1.022 | 0.868 | 0.807 | 0.610 | 0.710 | 0.641 |
| −0.513 | 1.093 | 0.958 | 0.962 | 0.811 | 0.836 | 0.847 |
| −0.911 | 0.989 | 1.142 | 0.997 | 0.964 | 0.856 | 0.986 |
| −1.308 | 1.037 | 1.109 | 1.045 | 1.006 | 1.021 | 0.935 |
| −1.706 | 1.031 | 0.873 | 0.922 | 0.809 | 1.019 | 0.821 |
| −2.104 | 0.932 | 0.795 | 1.033 | 0.836 | 0.960 | 0.869 |
| Conc (exp 10) (nM) | WV-2677 1.5 nM | | WV-2678 1.8 nM | | WV-1422 All PS 1.1 nM | |
| 1.477 | 0.214 | 0.151 | 0.293 | 0.240 | 0.404 | 0.369 |
| 1.079 | 0.214 | 0.148 | 0.321 | 0.240 | 0.416 | 0.436 |
| 0.681 | 0.388 | 0.265 | 0.456 | 0.386 | 0.490 | 0.496 |
| 0.283 | 0.538 | 0.406 | 0.616 | 0.535 | 0.794 | 0.650 |
| −0.115 | 0.779 | 0.592 | 0.959 | 0.748 | 0.716 | 0.851 |
| −0.513 | 0.836 | 0.920 | 0.883 | 1.006 | 0.809 | 0.987 |
| −0.911 | 0.926 | 1.043 | 1.016 | 1.135 | 1.070 | 1.107 |
| −1.308 | 1.037 | 0.816 | 1.045 | 0.930 | 1.176 | 0.996 |
| −1.706 | 1.071 | 0.766 | 1.178 | 0.873 | | |
| −2.104 | 0.892 | 0.742 | 0.778 | 0.839 | | |
| Conc (exp 10) (nM) | WV-1868 PS/PO 1.65 nM | | | | | |
| 1.477 | 0.262 | 0.332 | | | | |
| 1.079 | 0.358 | 0.308 | | | | |
| 0.681 | 0.378 | 0.520 | | | | |
| 0.283 | 0.498 | 0.659 | | | | |
| −0.115 | 0.813 | 0.809 | | | | |
| −0.513 | 1.120 | 0.947 | | | | |
| −0.911 | 0.824 | 0.964 | | | | |
| −1.308 | | | | | | |
| −1.706 | | | | | | |
| −2.104 | | | | | | |

As shown in Table 60B, WV-1878, WV-1868, and WV-1871 were tested in vitro. The oligonucleotides differ in the length of the wings and core, and in base sequence.

TABLE 60B

Activity of oligonucleotides.

| Oligonucleotide | IC50 (nM) |
|---|---|
| WV-1878 | 2.1 |
| WV-1868 | 0.76 |
| WV-1871 | 2.7 |

As shown in Table 60C, WV-2141 and WV-3968 were tested in vitro.

Numbers indicate % APOC3 mRNA remaining (AOC3/HPRT1). The 5' end of WV-3968 comprises a Mod001 moiety (as defined in the legend to Table 1A) and a linker L001:

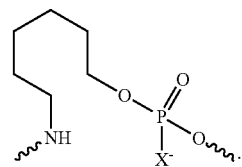

TABLE 60C

Activity of oligonucleotides

| Conc (uM) | WV-2141 | | WV-3968 | |
|---|---|---|---|---|
| 0 | 87.9 | 93.1 | 87.9 | 93.1 |
| 1 | 97.9 | 80.6 | 32.7 | 45.6 |
| 5 | 56.6 | 67.4 | 42.6 | 29.6 |
| 10 | 47.7 | 68.1 | 41.3 | 59.5 |

As shown in Table 60D, WV-2647, WV-2647, WV-2552, WV-2551, WV-2549, WV-2550, WV-2554, WV-2553, WV-2646, WV-2645, WV-1422, WV-2677, WV-723, WV-2678, WV-1868, WV-819, and WV-2644 were tested for stability in vitro.

The oligonucleotides were incubated in rat liver homogenate at 20 uM for 0d (0 days), 8 h (8 hours), 16 h, 1 d, 2 d, 3 d, 4 d, or 5 d and the remained full length oligonucleotides were plotted in percentage. Numbers indicate percentage of full-length oligonucleotide remaining. For example, in column 2, row 2, 100 indicates 100% full-length oligonucleotide remaining. Data from replicate experiments (e.g., -1, -2, etc.) are shown.

TABLE 60D

Stability of oligonucleotides

| Days | WV723-1 | WV723-2 | WV723-3 |
|---|---|---|---|
| 0 | 100 | 100 | 100 |
| 0.333 | 49.09815078 | 50.75705 | 46.66902 |
| 0.666 | 42.56045519 | 44.04259 | 40.76915 |
| 1 | 39.58463727 | 38.01295 | 36.69628 |
| 2 | 28.35277383 | 26.27468 | 27.87928 |
| 3 | 19.93172119 | 23.00572 | 22.19643 |
| 4 | 16.17638691 | 15.66529 | 16.07449 |
| 5 | 14.685633 | 13.81414 | 12.93025 |

| Days | WV819-1 | WV819-2 | WV819-3 |
|---|---|---|---|
| 0 | 100 | 100 | 100 |
| 0.333 | 43.51021872 | 46.65438 | 44.26357 |
| 0.666 | 38.36052349 | 39.37896 | 36.76867 |
| 1 | 32.56095375 | 37.27138 | 30.99551 |
| 2 | 21.00215131 | 23.34067 | 22.01958 |
| 3 | 15.66869846 | 16.55507 | 16.09547 |
| 4 | 13.55324489 | 18.68961 | 12.27254 |
| 5 | 10.54141269 | 12.78929 | 9.277846 |

| Days | WV1422-1 | WV1422-2 | WV1422-3 |
|---|---|---|---|
| 0 | 100 | 100 | 100 |
| 0.333 | 70.51666845 | 67.40684 | 62.96961 |
| 0.666 | 59.69557294 | 53.65779 | 52.61469 |
| 1 | 50.13399078 | 49.47022 | 46.16292 |
| 2 | 34.19980705 | 32.08112 | 31.21106 |
| 3 | 25.71551077 | 23.65526 | 22.862 |
| 4 | 22.55332833 | 20.25856 | 19.36473 |
| 5 | 17.25801265 | 14.45374 | 15.72116 |

| Days | WV1868-1 | WV1868-2 | WV1422-3 |
|---|---|---|---|
| 0 | 100 | 100 | 100 |
| 0.333 | 67.74587087 | 69.0377 | 65.87368 |
| 0.666 | 51.09797297 | 51.80944 | 51.05068 |
| 1 | 40.01814314 | 40.39831 | 40.40356 |
| 2 | 22.76338839 | 22.60573 | 20.85249 |
| 3 | 14.17042042 | 14.52475 | 13.57829 |
| 4 | 10.12575075 | 8.851996 | 9.154677 |
| 5 | 6.969469469 | 6.791561 | 6.716017 |

| Days | WV2549-1 | WV2549-2 | WV2549-3 |
|---|---|---|---|
| 0 | 100 | 100 | 100 |
| 0.333 | 93.91357898 | 92.79193 | 93.26989 |
| 0.666 | 92.45612234 | 88.80706 | 91.78848 |
| 1 | 86.59550446 | 86.70366 | 85.23006 |
| 2 | 74.17119984 | 76.55485 | 74.57078 |
| 3 | 67.43816073 | 67.03657 | 66.13362 |
| 4 | 59.98665709 | 57.77554 | 56.80859 |
| 5 | 48.6246536 | 46.3657 | 47.62092 |

| Days | WV2550-1 | WV2550-2 | WV2550-3 |
|---|---|---|---|
| 0 | 100 | 100 | 100 |
| 0.333 | 95.48114142 | 93.89125 | 89.39343 |
| 0.666 | 93.0236745 | 86.26168 | 86.79865 |
| 1 | 85.48024125 | 81.28292 | 82.89806 |
| 2 | 72.32874246 | 69.37978 | 67.81803 |
| 3 | 57.33189306 | 55.57349 | 55.64448 |
| 4 | 50.21154019 | 47.66355 | 47.21146 |
| 5 | 38.4463048 | 36.25319 | 38.91323 |

| Days | WV2551-1 | WV2551-2 | WV2551-3 |
|---|---|---|---|
| 0 | 100 | 100 | 100 |
| 0.333 | 92.39859107 | 94.76026 | 95.3919 |
| 0.666 | 90.27383252 | 92.22383 | 88.72739 |
| 1 | 87.85365299 | 88.97541 | 86.35874 |
| 2 | 78.17293489 | 79.9644 | 73.86951 |
| 3 | 66.67424156 | 66.80387 | 68.57235 |
| 4 | 60.27724122 | 59.30582 | 58.3441 |
| 5 | 49.80115896 | 49.6162 | 50.49526 |

| Days | WV2552-1 | WV2552-2 | WV2552-3 |
|---|---|---|---|
| 0 | 100 | 100 | 100 |
| 0.333 | 90.98589239 | 97.80328 | 99.99086 |
| 0.666 | 88.69750656 | 96.01004 | 96.23538 |
| 1 | 84.4488189 | 88.01219 | 95.87902 |
| 2 | 70.97276903 | 80.59715 | 84.91411 |
| 3 | 63.32841207 | 64.88837 | 74.57968 |
| 4 | 57.58694226 | 60.21698 | 64.41886 |
| 5 | 46.05479003 | 53.39371 | 55.2723 |

| Days | WV2553-1 | WV2553-2 | WV2553-3 |
|---|---|---|---|
| 0 | 100 | 100 | 100 |
| 0.333 | 92.2305438 | 97.18409 | 90.91079 |
| 0.666 | 90.83034842 | 84.13727 | 84.48244 |
| 1 | 77.52523608 | 77.0109 | 80.18029 |
| 2 | 65.01465321 | 65.03528 | 62.86602 |
| 3 | 55.49332465 | 53.52149 | 54.65962 |
| 4 | 45.88733312 | 42.96985 | 41.46099 |
| 5 | 33.82611527 | 34.58627 | 33.76438 |

| Days | WV2554-1 | WV2554-2 | WV2554-3 |
|---|---|---|---|
| 0 | 100 | 100 | 100 |
| 0.333 | 94.79862111 | 97.72837 | 95.30518 |
| 0.666 | 98.32002440 | 90.65912 | 90.90406 |
| 1 | 138.9448881 | 85.30018 | 83.4213 |
| 2 | 66.28267225 | 69.27597 | 69.07721 |
| 3 | 55.59191866 | 56.75569 | 56.33779 |
| 4 | 45.70406249 | 44.59501 | 44.68801 |
| 5 | 32.78352315 | 34.10078 | 34.8472 |

| Days | WV2644-1 | WV2644-2 | WV2644-3 |
|---|---|---|---|
| 0 | 100 | 100 | 100 |
| 0.333 | 0.059184568 | 0.088216 | 0.068567 |
| 0.666 | 0.026304253 | 0.050724 | 0.063293 |
| 1 | 0.026304253 | 0.02867 | 0.031646 |

| Days | WV2645-1 | WV2645-2 | WV2645-3 |
|---|---|---|---|
| 0 | 100 | 100 | 100 |
| 0.333 | 73.70322969 | 80.76862 | 79.76236 |
| 0.666 | 68.32793797 | 72.95462 | 70.16434 |
| 1 | 59.60249944 | 61.37744 | 59.47844 |
| 2 | 38.09380411 | 42.64941 | 40.05864 |
| 3 | 24.79861477 | 25.3116 | 25.41471 |
| 4 | 15.38056162 | 16.08341 | 15.97871 |
| 5 | 10.11066777 | 10.11505 | 10.07638 |

| Days | WV2646-1 | WV2646-2 | WV2646-3 |
|---|---|---|---|
| 0 | 100 | 100 | 100 |
| 0.333 | 70.8897207 | 71.01162 | 68.12728 |
| 0.666 | 64.49035416 | 60.79626 | 59.61305 |
| 1 | 53.49841635 | 53.76877 | 49.8854 |
| 2 | 32.93982148 | 33.63559 | 34.01645 |
| 3 | 23.74748056 | 23.42732 | 23.40569 |
| 4 | 15.99481716 | 16.70445 | 16.24646 |
| 5 | 17.77281889 | 11.52593 | 12.8219 |

TABLE 60D-continued

Stability of oligonucleotides

| Days | WV2647-1 | WV2647-2 | WV2647-3 |
|---|---|---|---|
| 0 | 100 | 100 | 100 |
| 0.333 | 91.14885115 | 91.36755 | 88.88889 |
| 0.666 | 94.40559441 | 87.56281 | 88.5921 |
| 1 | 88.15184815 | 83.3094 | 85.51289 |
| 2 | 84.31568432 | 78.24838 | 80.50454 |
| 3 | 79.000999 | 71.30294 | 74.23484 |
| 4 | 74.64535465 | 67.13927 | 69.24504 |
| 5 | 72.76723277 | 63.87294 | 65.7021 |

| Days | WV2677-2 | WV2677-2 | WV2677-3 |
|---|---|---|---|
| 0 | 100 | 100 | 100 |
| 0.333 | 74.16923604 | 68.33221 | 79.12078 |
| 0.666 | 56.90733128 | 54.40283 | 60.87654 |
| 1 | 46.88677629 | 45.06097 | 51.94168 |
| 2 | 31.20075368 | 28.98677 | 36.2923 |
| 3 | 24.36193902 | 22.31004 | 26.17147 |
| 4 | 17.72439192 | 17.54776 | 20.2684 |
| 5 | 15.74169236 | 14.89057 | 15.422 |

| Days | WV2678-1 | WV2678-2 | WV2678-3 |
|---|---|---|---|
| 0 | 100 | 100 | 100 |
| 0.333 | 66.0880372 | 64.71483 | 59.23107 |
| 0.666 | 45.11706222 | 45.80369 | 46.8807 |
| 1 | 36.52581783 | 38.74748 | 36.68648 |
| 2 | 23.66500962 | 24.55282 | 25.08918 |
| 3 | 17.4390635 | 17.61997 | 17.87951 |
| 4 | 12.93296985 | 12.52519 | 13.1193 |
| 5 | 9.878127004 | 10.02508 | 10.09116 |

As shown in Table 60E, WV-2725, WV-2726, WV-2727, WV-2722, WV-2723, and WV-2724 were tested for stability in vivo.

Numbers indicate ug/g of ASO in liver at a number of days after injection into test animals. Numbers are approximate and error bars are not shown. Approximately 75 ug/g represents about 90% of the injected dose, and about 13 ug/g represents about 16% of the injected dose. The oligonucleotides differ in stereochemistry pattern and 2'-modifications.

TABLE 60E

Stability of oligonucleotides in liver.

| Days | PBS | WV-2725 | WV-2726 | WV-2727 | WV-2722 | WV-2723 | WV-2724 |
|---|---|---|---|---|---|---|---|
| 1 | 2 | 36 | 75 | 51 | 35 | 49 | 39 |
| 5 |  | 26 | 43 | 33 | 19 | 26 | 15 |
| 15 | 2 | 7 | 13 | 11 | 4 | 7 | 4 |

As shown in Table 60F and 60G, WV-3968 and WV-6003 were tested. The 5' end of WV-3968 and that of WV-6003 comprise a Mod001 moiety (as defined in the legend to Table 1A) and a linker L001:

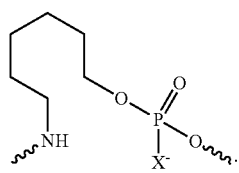

Data represent relative hAPOC3 protein levels (relative to PBS).

TABLE 60F

Part I. Activity of oligonucleotides.

| Day | Stereorandom WV-3968 | | | | |
|---|---|---|---|---|---|
| 8 | 0.062 | 0.013 | 0.018 | 0.016 | 0.035 |
| 15 | 0.017 | 0.009 | 0.01 | 0.012 | 0.014 |
| 22 | 0.039 | 0.027 | 0.019 | 0.023 | 0.023 |
| 29 | 0.153 | 0.043 | 0.021 | 0.06 | 0.072 |
| 35 | 0.096 | 0.172 | 0.088 | 0.172 | 0.09 |
| 42 | 0.304 | 0.228 | 0.209 | 0.317 | 0.402 |
| 50 | 0.396 | 0.459 | 0.02 | 0.351 | 0.165 |
| 57 | 1.038 | 1.223 | 0.623 | 0.792 | 0.654 |
| 64 | 1.011 | 0.92 | 0.458 | 0.621 | 0.551 |

| Day | Stereopure WV-6003 | | | | |
|---|---|---|---|---|---|
| 8 | 0.016 | 0.043 | 0.032 | 0.039 | 0.016 |
| 15 | 0.015 | 0.016 | 0.021 | 0.024 | 0.021 |
| 22 | 0.033 | 0.039 | 0.051 | 0.047 | 0.027 |
| 29 | 0.023 | 0.031 | 0.046 | 0.096 | 0.048 |
| 35 | 0.266 | 0.159 | 0.067 | 0.176 | 0.239 |
| 42 | 0.104 | 0.084 | 0.069 | 0.084 | 0.067 |
| 50 | 0.072 | 0.193 | 0.065 | 0.133 | 0.064 |
| 57 | 0.334 | 0.782 | 0.381 | 0.519 | 0.21 |
| 64 | 0.397 | 0.754 | 0.543 | 0.699 | 0.239 |

Data represent relative hAPOC3 protein levels (relative to PBS).

TABLE 60F

Part II Activity of oligonucleotides.

| Day | Stereorandom WV-3968 | | | | |
|---|---|---|---|---|---|
| 8 | 0.062 | 0.013 | 0.018 | 0.016 | 0.035 |
| 15 | 0.017 | 0.009 | 0.01 | 0.012 | 0.014 |
| 22 | 0.039 | 0.027 | 0.019 | 0.023 | 0.023 |
| 29 | 0.153 | 0.043 | 0.021 | 0.06 | 0.072 |
| 35 | 0.096 | 0.172 | 0.088 | 0.172 | 0.09 |
| 50 | 0.396 | 0.459 | 0.02 | 0.351 | 0.165 |
| 64 | 0.873 | 1.34 | 0.407 | 0.613 | 0.492 |
| 78 | 0.904 | 1.971 | 1.292 | 1.611 | 0.638 |

| Day | Stereopure WV-6003 | | | | |
|---|---|---|---|---|---|
| 8 | 0.016 | 0.043 | 0.032 | 0.039 | 0.016 |
| 15 | 0.015 | 0.016 | 0.021 | 0.024 | 0.021 |
| 22 | 0.033 | 0.039 | 0.051 | 0.047 | 0.027 |
| 29 | 0.023 | 0.031 | 0.046 | 0.096 | 0.048 |
| 35 | 0.266 | 0.159 | 0.067 | 0.176 | 0.239 |
| 50 | 0.072 | 0.193 | 0.065 | 0.133 | 0.064 |
| 64 | 0.43 | 0.591 | 0.401 | 0.235 | 0.12 |
| 78 | 0.399 | 0.669 | 0.557 | 1.358 | 0.442 |

In some experiments, compounds were constructed which comprise an APOC3 oligonucleotide (WV-7107) conjugated to a mono-, bis- or tri-antennary GalNAc (also designated Ref. GalNAc or Reference GalNAc) or PFE ligand (also described as PFE ASPGR ligand, PFE GalNAc, bridged bicyclic ketal or bicyclic ligand).

Oligonucleotides tested are listed in Table 60G, Part I

TABLE 60G

Part I. List of oligonucleotides

| Oligo-nucleotide | Ligand | Alternative designation of ligand and linker (L001 is a linker) | Example describing example synthesis of oligonucleotide with ligand |
|---|---|---|---|
| WV-8877 | None | — | — |
| WV-7107 | None | — | 37A |
| WV-6558 | Ref. GalNAc Tri-antennary | Mod001L001 | 37A, 37B |
| WV-9542 | PFE ligand Tri-antennary | Mod083L001 | 37C |
| WV-9543 | Ref. GalNAc Bis-antennary | Mod079L001 | 37D |
| WV-9544 | PFE ligand Bis-antennary | Mod080L001 | 37E |
| WV-9545 | Ref. GalNAc Mono-antennary | Mod081L001 | 37F |
| WV-9546 | PFE ligand Mono-antennary | Mod082L001 | 37G |

Ref GalNAc Tri-antennary is also designated Tri-GalNAc; PFE ligand Tri-antennary is also designated Tri-PFE ligand; Ref. GalNAc Bis-antennary is also designated Bis-GalNAc; PFE ligand Bis-antennary is also designated Bis-PFE ligand; Ref. GalNAc Mono-antennary is also designated Mono-GalNAc; and PFE ligand Mono-antennary is also designated Mono-PFE ligand. The structures of Mod001, Mod079, Mod080, Mod081, Mod082, Mod083 and L001 are provided in the legend to Table 1A and in other texts herein. Ligands are also described in Example 27. Mod083 is also described in Example 4A and 4B.

The GalNAc structures in Examples 29, 35, and 36 represent the protected versions, as they comprise —OAc (—O-acetate groups). In construction of the listed oligonucleotides, the Ac groups are removed during de-protection following conjugation of the compound to the oligonucleotide. De-protection is performed, for example, with concentrated ammonium hydroxide, e.g., as described in Example 37B. In the de-protected versions of these structures, —OAc is replaced by —OH.

WV-8877 (negative control) targets a different gene, which is not APOC3 or PNPLA3.

The APOC3 oligonucleotide WV-7107, conjugated with GalNAc or PFE ligand at different valencies (mono, bis or triantennary) and the negative control were separately administered to Tg (transgenic) mice harboring the human APOC3 transgene (B6. Cg-Tg(APOC3)2Bres/J) on day 1, and APOC3 knockdown was monitored by serum hAPOC3 protein reduction.

In this experiment, all oligonucleotides were administered to animals at a 3 mg/kg single dose (s.c.) at day 1. In addition, WV-6558 and WV-9542 were also administered to animals at a 1 mg/kg single dose (s.c.) at day 1. Serum was collected at days 0, 8, 15, 22, 29, 36, 43, and 50. Each group contained 5 animals. PBS and WV-8877 (which targets a gene which is not APOC3) were negative controls.

Numbers indicate relative APOC3 protein level, wherein 1.00 represents 100% relative to PBS.

In various in vivo studies, including this one, tested animals were transgenic mice expressing the human APOC3 gene.

TABLE 60G

Part II. Activity of oligonucleotides

| Day | 0 | 8 | 15 | 22 | 29 | 36 | 43 | 50 |
|---|---|---|---|---|---|---|---|---|
| PBS | 1.52 | 0.95 | 1.50 | 0.56 | 0.96 | 1.07 | 1.57 | 1.74 |
|  | 0.59 | 0.73 | 0.74 | 0.87 | 0.90 | 0.90 | 0.73 | 0.71 |
|  | 1.21 | 0.99 | 1.10 | 1.34 | 0.89 | 0.82 | 0.62 | 0.78 |
|  | 0.67 | 1.14 | 0.89 | 0.99 | 0.89 | 0.86 | 0.95 | 0.86 |
|  | 1.01 | 1.20 | 0.76 | 1.24 | 1.35 | 1.36 | 1.13 | 0.91 |
| WV-8877 | 1.56 | 1.24 | 1.67 | 1.59 | 2.37 | 1.56 | 1.47 | 2.27 |
|  | 0.78 | 0.73 | 0.85 | 0.80 | 1.15 | 0.61 | 0.75 | 1.19 |
|  | 1.08 | 0.81 | 1.42 |  | 1.84 | 1.21 | 1.73 | 3.05 |
|  | 0.71 | 1.21 | 0.74 | 0.62 | 1.02 | 1.07 | 0.95 | 1.48 |
|  | 1.28 | 1.21 | 0.60 | 0.80 | 1.13 | 1.50 | 0.86 |  |
| WV-6558 | 2.74 | 0.06 | 0.05 | 0.06 | 0.11 | 0.38 | 0.69 | 1.43 |
|  | 1.15 | 0.17 | 0.05 | 0.04 | 0.09 | 0.27 | 0.01 | 0.81 |
|  | 0.38 | 0.04 | 0.05 | 0.10 | 0.18 | 0.45 | 0.53 | 1.07 |
|  | 0.44 |  |  |  |  |  |  |  |
|  | 0.41 | 0.04 | 0.04 | 0.08 | 0.09 | 0.11 | 0.13 | 0.22 |
| WV-9542 | 1.10 | 0.23 | 0.05 | 0.07 | 0.13 | 0.23 | 0.32 | 0.78 |
|  | 0.71 | 0.03 | 0.02 | 0.04 | 0.06 | 0.09 | 0.20 | 0.28 |
|  | 0.59 | 0.05 | 0.04 | 0.08 | 0.16 | 0.72 | 0.90 | 0.80 |
|  | 0.32 | 0.03 | 0.02 | 0.04 | 0.09 | 0.37 | 0.54 | 0.55 |
|  | 0.40 | 0.03 | 0.03 | 0.06 | 0.21 | 0.39 | 0.49 | 0.58 |
| WV-9543 | 0.48 | 0.03 | 0.05 | 0.09 | 0.08 | 0.21 | 0.27 | 0.49 |
|  | 1.19 | 0.06 | 0.06 | 0.09 | 0.06 | 0.09 | 0.57 | 0.96 |
|  | 0.79 | 0.05 | 0.04 | 0.17 | 0.06 | 0.15 | 0.42 | 0.80 |
|  | 0.79 | 0.09 | 0.03 | 0.28 | 0.20 | 0.17 | 0.28 | 0.59 |
|  | 0.48 | 0.04 | 0.02 | 0.08 | 0.06 | 0.12 | 0.17 | 0.32 |
| WV-9544 | 0.91 |  | 0.04 | 0.06 | 0.06 | 0.19 | 0.26 | 0.67 |
|  | 0.94 | 0.10 | 0.03 | 0.08 | 0.09 | 0.15 | 0.34 | 0.76 |
|  | 1.72 | 0.19 | 0.04 | 0.07 | 0.09 | 0.25 | 0.60 | 0.83 |
|  | 1.92 | 0.28 | 0.07 | 0.10 | 0.11 | 0.13 | 0.26 | 0.56 |
|  | 0.81 | 0.04 | 0.05 | 0.11 | 0.12 | 0.20 | 0.32 | 0.73 |
| WV-9545 | 0.49 | 0.03 | 0.07 | 0.16 | 0.21 | 0.32 | 0.66 | 0.60 |
|  | 1.14 | 0.22 | 0.04 | 0.10 | 0.15 | 0.58 | 0.76 | 0.97 |
|  | 0.58 | 0.03 | 0.04 | 0.15 | 0.27 | 0.67 | 1.16 | 0.97 |
|  | 0.64 | 0.03 | 0.04 | 0.19 | 0.42 | 0.98 | 1.38 | 0.96 |
|  | 0.60 | 0.05 | 0.03 | 0.08 |  |  |  |  |
| WV-9546 | 3.33 | 0.20 | 0.06 | 0.27 | 0.24 | 0.49 | 1.13 | 1.31 |
|  | 1.03 | 0.11 | 0.04 | 0.09 | 0.14 | 0.46 | 0.55 | 0.68 |
|  | 1.20 | 0.28 | 0.12 | 0.20 | 0.31 | 0.95 | 1.75 | 1.39 |
|  | 0.71 | 0.15 | 0.04 | 0.19 | 0.39 | 0.26 | 0.75 | 0.36 |
|  | 0.18 | 0.04 | 0.02 | 0.20 | 0.28 | 0.21 | 0.56 | 0.56 |

Oligonucleotide accumulation in the liver was also analyzed after a single 3 mg/kg dose, 30 min. Numbers indicate ug of oligonucleotide/g of tissue. Tested animals were transgenic mice expressing the human APOC3 gene.

TABLE 60H

Part I. Oligonucleotide accumulation in the liver

| PBS | WV-6558 | WV-9542 | WV-9543 | WV-9544 | WV-9545 | WV-9546 |
|---|---|---|---|---|---|---|
| 0 | 2.95 | 1.73 | 3.52 | 3.82 | 2.02 | 4.27 |
| 0 | 2.46 | 1.69 | 2.49 | 4.19 | 1.99 | 1.37 |
| 0 | 2.48 | 0.45 | 1.14 | 2.74 | 1.30 | 1.29 |
| 0 | 1.85 | 1.09 | 2.12 | 2.26 | 1.14 | 1.25 |
| 0 | 1.79 | 1.43 | 4.26 | 1.88 | 1.07 | 0.82 |

In the same experiment: Oligonucleotide accumulation in the liver was also analyzed for WV-6558 and WV-9542 after a single 1 mg/kg dose, 30 min. Numbers indicate pg of oligonucleotide/g of tissue.

| PBS | WV-6558 1 mpk | WV-9542 1 mpk |
|---|---|---|
| 0 | 1.92 | 0.46 |
| 0 | 1.77 | 1.08 |
| 0 | 1.43 | 0.56 |

-continued

| PBS | WV-6558 1 mpk | WV-9542 1 mpk |
|---|---|---|
| 0 | 0.68 | 0.30 |
| 0 | 0.18 | 0.67 |

Oligonucleotide accumulation in the liver was also analyzed after a single 3 mg/kg dose, 8 days. Numbers indicate ng of oligonucleotide/g of tissue. Tested animals were transgenic mice expressing the human APOC3 gene.

TABLE 60H

Part II. Oligonucleotide accumulation in the liver

| PBS | WV-6558 | WV-9542 | WV-9543 | WV-9544 | WV-9545 | WV-9546 |
|---|---|---|---|---|---|---|
| 0 | 3.30 | 2.93 | 6.83 | 4.56 | 3.55 | 3.83 |
| 0 | 3.49 | 2.20 | 6.56 | 4.45 | 2.23 | 4.05 |
| 0 | 3.18 | 1.34 | 4.58 | 2.72 | 1.94 | 2.28 |
| 0 | 2.41 | 1.61 | 3.87 | 2.31 | 3.03 | 2.12 |
| 0 | 1.43 | 2.90 | 4.10 | 2.36 | 1.85 | 3.50 |

In the same experiment: Oligonucleotide accumulation in the liver was also analyzed for WV-6558 and WV-9542 after a single 1 mg/kg (1 mpk) dose, 8 days. Numbers indicate ng of oligonucleotide/g of tissue.

| PBS | WV-6558 1 mpk | WV-9542 1 mpk |
|---|---|---|
| 0 | 0.72 | 1.08 |
| 0 | 0.74 | 1.20 |
| 0 | 0.60 | 0.75 |
| 0 | 0.55 | 0.57 |
| 0 | 0.63 | 0.63 |

As shown in Table 60I, animals were dosed subcutaneously with 10 mpk (mg/kg animal weight) of oligonucleotide on days 1 and 5, and samples were obtained for testing on days −2, 5, 8 and 28. Level of serum APOC3 is shown.

TABLE 60I

Activity of oligonucleotides

|  | −2 | 5 | 8 | 14 | 21 | 28 |
|---|---|---|---|---|---|---|
| PBS | 0.85 | 0.77 | 0.77 | 0.87 | 0.70 | 0.59 |
|  | 0.82 | 0.80 | 0.85 | 0.78 | 0.62 | 0.67 |
|  | 1.21 | 1.23 | 1.22 | 1.22 | 1.32 | 1.33 |
|  | 1.12 | 1.20 | 1.16 | 1.13 | 1.36 | 1.41 |
| WV-2722 | 0.89 | 0.71 | 0.53 | 0.70 | 0.86 | 0.95 |
|  | 0.95 | 0.52 | 0.27 | 0.64 | 0.72 | 0.79 |
|  | 1.12 | 0.89 | 0.44 | 0.84 | 1.03 | 1.36 |
|  | 1.10 | 1.08 | 0.71 | 0.82 | 1.06 | 1.46 |
| WV-4204 | 0.78 | 0.75 | 0.42 | 0.61 | 0.70 | 0.68 |
|  | 0.81 | 0.70 | 0.35 | 0.43 | 0.50 | 0.52 |
|  | 1.13 | 1.10 | 0.73 | 0.71 | 0.63 | 1.21 |
|  | 1.09 | 0.87 | 0.36 | 0.10 | 0.27 | 0.65 |
| WV-4205 | 0.94 | 0.78 | 0.73 | 0.28 | 0.86 | 0.90 |
|  | 0.64 | 0.45 | 0.26 | 0.20 | 0.73 | 0.71 |
|  | 1.07 | 0.74 | 0.35 | 0.16 | 0.74 | 0.96 |
|  | 1.14 | 1.07 | 0.93 | 0.42 | 1.37 | 1.42 |
| WV-4206 | 1.10 | 1.10 | 1.08 | 0.57 | 1.22 | 1.21 |
|  | 1.06 | 0.98 | 0.88 | 0.39 | 0.84 | 1.06 |
|  | 0.72 | 0.63 | 0.43 | 0.19 | 0.56 | 0.45 |
|  | 0.85 | 0.81 | 0.86 | 0.37 | 0.87 | 0.93 |
| WV-4207 | 0.79 | 0.92 | 0.76 | 0.31 | 0.71 | 0.68 |
|  | 0.77 | 0.96 | 0.89 | 0.35 | 0.94 | 0.91 |
|  | 1.01 | 1.01 | 0.99 | 0.78 | 1.17 | 1.40 |
|  | 1.05 | 0.93 | 1.03 | 0.65 | 1.33 | 1.34 |

TABLE 60I-continued

Activity of oligonucleotides

|  | −2 | 5 | 8 | 14 | 21 | 28 |
|---|---|---|---|---|---|---|
| WV-4208 | 0.87 | 0.96 | 0.78 | 0.83 | 0.80 | 0.61 |
|  | 0.82 | 0.71 | 0.45 | 0.31 | 0.41 | 0.52 |
|  | 1.08 | 0.89 | 0.64 | 0.64 | 0.70 |  |
|  | 1.07 | 1.05 | 0.85 | 0.92 | 1.08 | 1.17 |
| WV-4209 | 1.07 | 0.91 | 0.92 | 0.96 | 1.13 | 1.18 |
|  | 1.00 | 0.71 | 0.82 | 0.86 | 1.02 | 1.11 |
|  | 1.05 | 1.12 | 0.94 | 1.03 | 1.18 | 1.28 |
|  | 1.01 | 1.08 | 0.94 | 0.99 | 1.28 | 1.42 |
| WV-4210 | 0.95 | 0.73 | 0.74 | 0.72 | 0.88 | 0.80 |
|  | 0.88 | 0.71 | 0.54 | 0.50 | 0.67 | 0.66 |
|  | 1.00 | 0.99 | 0.95 | 0.98 | 1.06 | 1.13 |
|  | 1.13 | 1.10 | 0.95 | 1.01 | 0.96 | 1.32 |
| WV-4211 | 1.01 | 0.81 | 0.43 | 0.15 |  |  |
|  | 0.70 | 0.78 | 0.46 | 0.17 | 0.63 | 0.55 |
|  | 1.08 | 1.06 | 0.89 | 0.33 | 1.10 | 1.23 |
|  | 1.02 | 1.11 | 0.89 | 0.41 | 0.94 | 1.31 |
| WV-4212 | 1.01 | 0.95 | 0.93 | 0.39 |  |  |
|  | 0.95 | 0.90 | 0.84 | 0.36 | 0.94 | 0.95 |
|  | 0.91 | 0.97 | 0.88 | 0.35 | 1.01 | 0.96 |
|  | 1.07 | 1.06 | 0.92 | 0.41 | 0.87 | 0.96 |
| WV-4213 | 1.00 | 1.00 | 0.91 | 0.49 | 1.11 | 1.14 |
|  | 0.82 | 0.77 | 0.68 | 0.26 | 0.74 | 0.67 |
|  | 1.11 | 1.03 | 1.00 | 0.48 | 1.03 | 0.92 |
|  | 1.07 | 1.11 | 1.03 | 0.56 | 1.36 | 1.40 |
| WV-4214 | 0.36 | 0.23 | 0.19 | 0.22 | 0.82 | 0.82 |
|  | 0.27 | 0.17 | 0.14 | 0.20 | 0.52 | 0.58 |
|  | 0.71 | 0.52 | 0.39 | 0.52 | 1.41 | 1.33 |
|  | 0.71 | 0.32 | 0.07 | 0.14 | 0.93 | 1.17 |
| WV-4215 | 0.58 | 0.45 | 0.47 | 0.62 | 1.38 | 1.21 |
|  | 0.39 | 0.39 | 0.34 | 0.55 | 1.31 | 1.36 |
|  | 0.29 | 0.12 | 0.11 | 0.15 | 0.51 | 0.54 |
|  | 0.22 | 0.19 | 0.11 | 0.16 | 0.57 | 0.70 |
| WV-4216 | 0.33 | 0.11 | 0.09 | 0.23 | 0.81 | 0.71 |
|  | 0.38 | 0.12 | 0.10 | 0.17 | 0.67 | 1.18 |
|  | 0.68 | 0.45 | 0.34 | 0.42 | 1.41 | 1.41 |
|  | 0.56 | 0.25 | 0.12 | 0.24 | 1.17 | 1.27 |

As shown in Table 60J, animals were dosed subcutaneously with 10 mpk (mg/kg animal weight) of oligonucleotide on days 1 and 5, and samples were obtained for testing on days −2, 1, 5, 8, 14, 21, and 28. Level of APOC3 protein and TG (triglycerides) is shown.

Table 60J. Activity of Oligonucleotides Relative to PBS.

TABLE 60J

Activity of oligonucleotides Relative to PBS.

| Day | | −2 | 5 | 8 | 14 |
|---|---|---|---|---|---|
| PBS | ApoC3 | 0.89 | 0.74 | 0.71 | 0.63 |
|  |  | 0.75 | 0.72 | 0.47 | 0.60 |
|  |  | 1.26 | 1.20 | 1.07 | 1.38 |
|  |  | 1.57 | 0.93 | 1.08 | 1.17 |
|  | TG | 0.61 | 0.58 | 0.56 | 0.48 |
|  |  | 0.62 | 0.76 | 0.51 | 0.52 |
|  |  | 0.99 | 1.44 | 1.42 | 1.88 |
|  |  | 1.50 | 1.09 | 1.38 | 1.66 |
| WV-3534 | ApoC3 | 0.83 | 0.09 | 0.10 | 0.10 |
|  |  | 1.14 | 0.17 | 0.12 | 0.09 |
|  |  | 1.17 | 0.22 | 0.51 | 0.13 |
|  |  | 1.15 | 0.17 | 0.36 | 0.21 |
|  | TG | 0.91 | 0.13 | 0.17 | 0.13 |
|  |  | 1.34 | 0.24 | 0.18 | 0.14 |
|  |  | 0.82 | 0.25 | 0.61 | 0.16 |
|  |  | 0.93 | 0.18 | 0.44 | 0.23 |
| WV-2816 | ApoC3 | 1.10 | 0.35 | 0.21 | 0.31 |
|  |  | 1.09 | 0.53 | 0.35 | 0.52 |
|  |  | 0.92 | 0.65 | 0.33 | 0.27 |
|  |  | 0.79 | 0.96 | 0.67 | 0.61 |
|  | TG | 1.04 | 0.44 | 0.26 | 0.35 |

TABLE 60J-continued

Activity of oligonucleotides Relative to PBS.

| Day | | -2 | 5 | 8 | 14 |
|---|---|---|---|---|---|
| | | 1.01 | 0.54 | 0.37 | 0.47 |
| | | 0.63 | 1.15 | 0.50 | 0.40 |
| | | 0.70 | 1.43 | 0.96 | 0.69 |
| WV-4125 | ApoC3 | 0.47 | 0.32 | 0.27 | 0.32 |
| | | 0.86 | 0.23 | 0.17 | 0.36 |
| | | 1.22 | 0.99 | 0.82 | 0.96 |
| | | 1.33 | 0.88 | 0.98 | 0.94 |
| | TG | 0.54 | 0.36 | 0.40 | 0.36 |
| | | 1.05 | 0.24 | 0.23 | 0.31 |
| | | 1.01 | 1.51 | 1.31 | 1.30 |
| | | 0.88 | 0.78 | 1.03 | 0.92 |
| WV-4127 | ApoC3 | 1.06 | 1.00 | 0.51 | 0.75 |
| | | 0.46 | 0.26 | 0.18 | 0.41 |
| | | 1.42 | 0.94 | 0.82 | 1.07 |
| | | 1.23 | 1.11 | 1.25 | 0.72 |
| | TG | 1.29 | 1.74 | 0.61 | 0.85 |
| | | 0.59 | 0.20 | 0.23 | 0.46 |
| | | 1.37 | 1.03 | 1.47 | 1.06 |
| | | 1.37 | 1.34 | 1.31 | 1.04 |
| WV-4128 | ApoC3 | 0.84 | 0.40 | 0.35 | 0.63 |
| | | 0.62 | 0.38 | 0.38 | 0.32 |
| | | 1.54 | 1.25 | 1.04 | 1.47 |
| | | 1.03 | 1.45 | 1.39 | 1.46 |
| | TG | 0.90 | 0.43 | 0.45 | 0.59 |
| | | 0.50 | 0.32 | 0.30 | 0.25 |
| | | 1.69 | 1.69 | 1.60 | 1.51 |
| | | 0.90 | 1.30 | 1.35 | 1.37 |
| WV-4129 | ApoC3 | 0.92 | 0.73 | 0.35 | 0.30 |
| | | 1.02 | 0.36 | 0.28 | 0.52 |
| | | 1.23 | 1.01 | 0.56 | 0.37 |
| | | 1.60 | 1.04 | 0.25 | 0.16 |
| | TG | 0.82 | 0.82 | 0.40 | 0.30 |
| | | 1.07 | 0.41 | 0.29 | 0.55 |
| | | 1.51 | 1.38 | 1.15 | 0.48 |
| | | 1.74 | 1.56 | 0.51 | 0.25 |
| WV-4132 | ApoC3 | 0.75 | 0.33 | 0.32 | 0.27 |
| | | 0.90 | 0.46 | 0.37 | 0.41 |
| | | 1.33 | 1.04 | 0.80 | 0.85 |
| | | 1.05 | 0.79 | 0.44 | 0.53 |
| | TG | 0.89 | 0.33 | 0.38 | 0.28 |
| | | 1.01 | 0.65 | 0.43 | 0.51 |
| | | 1.36 | 1.29 | 1.14 | 1.14 |
| | | 1.39 | 0.94 | 0.70 | 0.53 |
| WV-4133 | ApoC3 | 0.88 | 0.44 | 0.41 | 0.66 |
| | | 0.42 | 0.22 | 0.16 | 0.32 |
| | | 1.16 | 0.63 | 0.41 | 0.25 |
| | | 0.98 | 1.04 | 0.61 | 0.50 |
| | TG | 1.03 | 0.52 | 0.53 | 0.66 |
| | | 0.46 | 0.22 | 0.25 | 0.40 |
| | | 1.30 | 0.93 | 0.61 | 0.23 |
| | | 0.90 | 1.38 | 0.90 | 0.59 |
| WV-4134 | ApoC3 | 0.48 | 0.27 | 0.24 | 0.31 |
| | | 0.43 | 0.22 | 0.18 | 0.27 |
| | | 1.10 | 0.97 | 0.67 | 0.82 |
| | | 1.82 | 1.12 | 0.57 | 0.69 |
| | TG | 0.54 | 0.29 | 0.23 | 0.26 |
| | | 0.48 | 0.24 | 0.23 | 0.30 |
| | | 1.46 | 1.57 | 1.17 | 1.19 |
| | | 1.30 | 0.90 | 0.70 | 0.22 |
| | | -2 | 5 | 8 | 14 |
| PBS | ApoC3 | 0.622 | 0.747 | 0.784 | 0.661 |
| | | 0.407 | 0.439 | 0.464 | 0.532 |
| | | 2.096 | 1.034 | 1.411 | 1.373 |
| | | 1.852 | 0.96 | 1.111 | 1.506 |
| | TG | 0.631758 | 0.60746 | 0.546714 | 0.473818 |
| | | 0.461669 | 0.473818 | 0.413073 | 0.461669 |
| | | 1.627992 | 1.34856 | 1.688738 | 1.433605 |
| | | 2.10181 | 0.971935 | 1.457903 | 1.299964 |
| WV-3534 | ApoC3 | 0.581 | 0.096 | 0.129 | 0.116 |
| | | 0.709 | 0.167 | 0.117 | 0.146 |
| | | 2.935 | 0.993 | 0.518 | 0.148 |
| | | 1.537 | 0.799 | 0.319 | 0.194 |
| | TG | 0.741101 | 0.085044 | 0.14579 | 0.085044 |
| | | 0.959786 | 0.218685 | 0.14579 | 0.109343 |
| | | 1.385008 | 1.117726 | 0.619609 | 0.109343 |
| | | 1.166322 | 0.984085 | 0.388774 | 0.182238 |
| WV-2816 | ApoC3 | 0.869 | 0.365 | 0.246 | 0.278 |
| | | 0.737 | 0.411 | 0.298 | 0.441 |
| | | 1.953 | 0.828 | 0.353 | 0.369 |
| | | 1.354 | 1.361 | 0.739 | 0.734 |
| | TG | 0.75325 | 0.400923 | 0.242984 | 0.255133 |
| | | 0.959786 | 0.437371 | 0.315879 | 0.388774 |
| | | 1.142024 | 1.069129 | 0.425222 | 0.291581 |
| | | 0.984085 | 1.336411 | 0.850443 | 0.571012 |
| WV-4126 | ApoC3 | 1.681 | 0.681 | 0.348 | 0.48 |
| | | 1.343 | 0.435 | 0.17 | 0.249 |
| | | 0.807 | 0.489 | 0.195 | 0.421 |
| | | 1.148 | 0.749 | 0.523 | 0.477 |
| | TG | 1.34856 | 0.862593 | 0.59531 | 0.388774 |
| | | 1.312113 | 0.425222 | 0.218685 | 0.182238 |
| | | 1.044831 | 0.510266 | 0.242984 | 0.400923 |
| | | 1.737334 | 0.59531 | 1.154173 | 0.388774 |
| WV-4130 | ApoC3 | 1.128 | 0.852 | 0.782 | 1.798 |
| | | 0.424 | 0.753 | 0.301 | 0.445 |
| | | 2.74 | 0.6 | 0.084 | 0.281 |
| | | 0.192 | 0.084 | 0.12 | 0.165 |
| | TG | 0.631758 | 0.328028 | 0.315879 | 0.242984 |
| | | 0.583161 | 0.218685 | 0.157939 | 0.085044 |
| | | 1.154173 | 0.279431 | 0.218685 | 0.352327 |
| | | 1.190621 | 0.291581 | 0.170089 | 0.194387 |
| WV-4131 | ApoC3 | 0.311 | 0.223 | 0.175 | 0.344 |
| | | 0.128 | 0.09 | 0.05 | 0.139 |
| | | 1.13 | 2.182 | 0.271 | 0.09 |
| | | 1.334 | 1.01 | 0.631 | 0.458 |
| | TG | 0.388774 | 0.157939 | 0.230835 | 0.218685 |
| | | 0.206536 | 0.14579 | 0.097194 | 0.109343 |
| | | 1.105576 | 1.008383 | 0.315879 | 0.230835 |
| | | 0.668206 | 0.376625 | 0.072895 | 0.109343 |
| WV-4135 | ApoC3 | 2.181 | 1.22 | 0.526 | 0.575 |
| | | 1.996 | 1.102 | 0.691 | 0.812 |
| | | 1.418 | 0.379 | 0.187 | 0.271 |
| | | 2.081 | 0.594 | 0.213 | 0.088 |
| | TG | 0.692504 | 0.255133 | 0.182238 | 0.267282 |
| | | 0.75325 | 0.352327 | 0.206536 | 0.255133 |
| | | 1.117726 | 0.60746 | 0.352327 | 0.255133 |
| | | 0.935488 | 0.704653 | 0.30373 | 0.255133 |
| WV-4136 | ApoC3 | 1.013 | 0.132 | 0.067 | 0.049 |
| | | 0.663 | 0.211 | 0.171 | 0.271 |
| | | 0.527 | 1.451 | 0.817 | 0.232 |
| | | 1.748 | 1.263 | 0.511 | 0.453 |
| | TG | 0.911189 | 0.267282 | 0.121492 | 0.109343 |
| | | 0.182238* | 0.072895* | 0.072895* | 0.060746* |
| | | 0.947637 | 0.546714 | 0.388774 | 0.109343 |
| | | 0.534564 | 0.364476 | 0.206536 | 0.085044 |

Animals were dosed twice, subcutaneously, on days 1 and 4 at 10 mpk. Tested samples were withdrawn on days 2, 4, 7, 14, 21, 28 and 39.

TABLE 60K

Activity of oligonucleotides

| | -2 | 4 | 7 | 14 | 21 | 28 | 39 |
|---|---|---|---|---|---|---|---|
| WV-2141 | 1.49 | 0.67 | 0.37 | 0.56 | 0.80 | 0.79 | 0.75 |
| | 0.64 | 0.32 | 0.17 | 0.32 | | 0.55 | 0.91 |
| | 1.21 | 0.76 | 0.60 | 0.87 | 1.11 | 1.13 | 1.24 |
| | 0.88 | 0.81 | 0.57 | 0.33 | 0.99 | 0.85 | 0.83 |
| WV-3968 | 0.80 | 0.13 | 0.11 | 0.16 | 0.33 | 0.36 | |
| | 0.77 | 0.09 | 0.08 | 0.11 | 0.27 | 0.37 | 0.73 |
| | 2.00 | 0.32 | 0.13 | 0.11 | | 0.26 | 0.79 |
| | 0.81 | 0.06 | 0.03 | 0.07 | 0.17 | 0.29 | 0.43 |
| WV-3534 | 1.11 | 0.15 | 0.11 | 0.13 | 0.43 | 0.58 | 0.74 |
| | 1.08 | 0.14 | 0.11 | 0.11 | 0.38 | 0.45 | 0.66 |
| | 1.61 | 0.41 | 0.21 | 0.18 | 0.43 | 0.67 | 1.14 |

TABLE 60K-continued

Activity of oligonucleotides

| -2 | 4 | 7 | 14 | 21 | 28 | 39 |
|---|---|---|---|---|---|---|
| 0.00 | 0.25 | 0.18 | 0.15 | 0.48 | 0.78 | 1.11 |
| 1.00 | 0.65 | 0.08 | 0.09 | 0.32 | 0.52 | 1.01 |

TABLE 60L

| Conc. | 1 | 0.522 | 0.045 | −0.43 | −0.90 | −1.38 | −1.86 | −2.33 | −2.81 | −3.29 | −3.77 |
|---|---|---|---|---|---|---|---|---|---|---|---|
| WV-7540 | 0.133 | 0.158 | 0.269 | 0.395 | 0.559 | 0.688 | 0.726 | 0.693 | 0.720 | 0.774 | 0.637 |
|  | 0.153 | 0.251 | 0.325 | 0.470 | 0.644 | 0.798 | 0.921 | 0.839 | 0.923 | 1.343 | 1.046 |
| WV-8427 | 0.202 | 0.225 | 0.372 | 0.400 | 0.634 | 0.802 | 0.913 | 1.000 | 1.004 | 0.910 | 0.880 |
|  | 0.168 | 0.258 | 0.354 | 0.543 | 0.714 | 0.923 | 0.972 | 0.982 | 1.038 | 1.596 | 1.252 |
| WV-8429 | 0.140 | 0.150 | 0.255 | 0.276 | 0.455 | 0.609 | 0.788 | 1.011 | 0.948 | 0.968 | 1.307 |
|  | 0.148 | 0.187 | 0.218 | 0.297 | 0.491 | 0.708 | 0.964 | 0.948 | 1.006 | 0.954 | 0.959 |
| WV-8431 | 0.167 | 0.205 | 0.234 | 0.288 | 0.494 | 0.755 | 0.896 | 1.000 | 1.055 | 1.117 | 0.953 |
|  | 0.209 | 0.234 | 0.275 | 0.338 | 0.504 | 0.713 | 0.913 | 1.078 | 0.972 | 1.023 | 0.914 |
| WV-6439 | 0.206 | 0.172 | 0.217 | 0.232 | 0.521 | 0.740 | 0.909 | 0.993 | 1.052 | 0.948 | 0.952 |
|  | 0.198 | 0.301 | 0.239 | 0.552 | 0.567 | 0.747 | 1.010 | 1.254 | 1.038 | 1.334 | 1.212 |
| WV-6439 | 0.190 | 0.176 | 0.189 | 0.265 | 0.400 | 0.566 | 0.703 | 0.797 | 0.940 | 0.985 | 0.864 |
|  | 0.209 | 0.217 | 0.226 | 0.226 | 0.398 | 0.635 | 0.915 | 1.040 | 1.025 | 1.142 | 1.019 |
| WV-6431 | 0.209 | 0.283 | 0.185 | 0.227 | 0.415 | 0.668 | 0.728 | 0.850 | 1.053 | 0.899 | 0.927 |
|  | 0.220 | 0.191 | 0.202 | 0.206 | 0.388 | 0.622 | 0.807 | 0.944 | 0.891 | 0.950 | 1.032 |
| WV-6439 | 0.198 | 0.208 | 0.229 | 0.285 | 0.542 | 0.670 | 0.749 | 0.852 | 0.775 | 0.855 | 0.863 |
|  | 0.206 | 0.183 | 0.232 | 0.454 | 0.520 | 0.736 | 0.935 | 0.986 | 0.998 | 1.099 | 0.890 |
| Plate Control |  |  |  |  |  |  |  |  |  |  |  |

Concentrations (Conc.) are provided in nM, exp 10.

Single IV dosage. Numbers are APOC3 mRNA level at 15 days. APOC3 levels were also reduced at 8 days (data not shown).

TABLE 60M

Activity of oligonucleotides

|  | PBS | WV-6544 | WV-6558 | WV-6559 |
|---|---|---|---|---|
| 1mpk | 1.269 | 1.314 | 0.252 | 0.387 |
|  | 1.144 | 0.529 | 0.085 | 0.302 |
|  | 0.865 | 0.554 | 0.077 | 0.219 |
|  | 0.914 | 0.374 | 0.108 | 0.299 |
|  | 0.808 | 0.416 | 0.206 | 0.402 |
| 3mpk |  | 0.199 | 0.106 | 0.194 |
|  |  | 0.25 | 0.189 | 0.257 |
|  |  | 0.182 | 0.091 | 0.388 |

TABLE 60M-continued

Activity of oligonucleotides

|  | PBS | WV-6544 | WV-6558 | WV-6559 |
|---|---|---|---|---|
|  |  | 0.102 | 0.064 | 0.232 |
|  |  | 0.146 | 0.044 | 0.065 |
| 10mpk |  | 0.066 | 0.058 | 0.088 |
|  |  | 0.091 | 0.058 | 0.065 |
|  |  | 0.067 | 0.061 | 0.067 |
|  |  | 0.151 | 0.094 | 0.075 |
|  |  | 0.099 | 0.103 | 0.09 | hAPOC3 Tg (transgenic) mice were dosed with 5 mpk of oligonucleotide on days 1 and 3, and samples were collected on days 1, 8, 15, 22, 29, 43, 50, 57 and 63. Levels of hAPOC3 protein level relative to PBS are shown.

TABLE 60N

|  | 1 | 8 | 15 | 22 | 29 | 36 | 43 | 50 | 57 | 63 |
|---|---|---|---|---|---|---|---|---|---|---|
| PBS | 0.53 | 0.27 | 0.88 | 0.89 | 1.55 | 1.66 | 0.68 | 1.21 | 0.87 | 1.29 |
|  | 1.23 | 1.49 | 1.42 | 1.19 | 1.13 | 1.19 | 1.12 | 0.96 | 1.31 | 1.09 |
|  | 0.65 | 0.83 | 1.06 | 0.86 | 0.88 | 0.59 | 0.67 | 1.46 | 1.19 | 0.73 |
|  | 1.26 | 0.98 | 1.15 | 1.94 | 1.21 | 1.23 | 1.99 | 0.82 | 1.26 | 1.36 |
|  | 1.34 | 1.42 | 0.50 | 0.12 | 0.24 | 0.33 | 0.54 | 0.54 | 0.38 | 0.53 |
| WV-3968 | 2.60 | 0.13 | 0.04 | 0.06 | 0.43 | 0.47 | 1.76 | 1.29 | 1.51 | 1.37 |
|  | 2.18 | 0.12 | 0.10 | 0.52 | 0.68 | 1.46 | 1.88 | 0.71 | 1.51 | 1.78 |
|  | 1.67 | 0.01 | 0.05 | 0.07 | 0.29 | 0.57 | 1.83 | 0.91 | 0.68 | 1.43 |
|  | 1.14 | 0.01 | 0.03 | 0.03 | 0.26 | 0.56 | 1.05 | 1.23 | 0.88 | 0.70 |
|  | 1.11 | 0.02 | 0.02 | 0.03 | 0.19 | 0.55 | 0.81 | 1.27 | 1.56 | 1.30 |
| WV-6003 | 1.60 | 0.04 | 0.06 | 0.12 | 0.12 | 0.31 | 0.45 | 0.54 | 0.94 | 1.52 |
|  | 0.40 | 0.04 | 0.06 | 0.08 | 0.14 | 0.16 | 0.45 | 0.23 | 0.68 | 1.04 |
|  | 1.30 | 0.03 | 0.05 | 0.08 | 0.25 | 0.12 | 0.33 | 0.24 | 0.44 | 0.58 |
|  | 1.33 | 0.04 | 0.05 | 0.13 | 0.34 | 0.09 | 0.43 | 0.34 | 0.73 | 1.56 |
|  | 1.11 | 0.04 | 0.06 | 0.00 | 0.15 | 0.09 | 0.31 | 0.19 | 0.70 | 0.87 |
| WV-6555 | 0.95 | 0.07 | 0.05 | 0.24 | 0.57 | 0.37 | 1.05 | 0.46 | 0.54 | 1.07 |
|  | 0.14 | 0.03 | 0.04 | 0.04 | 0.17 | 0.09 | 0.35 | 0.39 | 0.27 | 0.42 |
|  | 1.70 | 0.09 | 0.06 | 0.11 | 0.25 | 0.87 | 0.84 | 1.69 | 1.07 | 2.46 |
|  | 0.29 | 0.02 | 0.04 | 0.08 | 0.27 | 0.34 | 0.61 | 0.47 | 0.29 | 0.97 |
|  | 0.75 | 0.05 | 0.09 | 0.19 | 0.67 | 0.77 | 0.94 | 0.79 | 0.85 | 1.18 |

TABLE 60N-continued

|  | 1 | 8 | 15 | 22 | 29 | 36 | 43 | 50 | 57 | 63 |
|---|---|---|---|---|---|---|---|---|---|---|
| WV-6757 | 1.08 | 0.04 | 0.06 | 0.10 | 0.43 | 0.24 | 0.39 | 0.27 | 0.22 | 0.42 |
|  | 0.72 | 0.04 | 0.04 | 0.07 | 0.18 | 0.13 | 0.44 | 0.26 | 0.29 | 0.35 |
|  | 0.79 | 0.02 | 0.00 | 0.37 | 0.12 | 0.13 | 0.32 | 0.34 | 0.37 | 0.81 |
|  | 2.78 | 0.25 | 0.20 | 0.36 | 0.49 | 1.05 | 1.13 | 0.87 | 0.48 | 1.67 |
|  | 0.81 | 0.08 | 0.06 | 0.07 | 0.44 | 0.42 | 0.96 | 0.53 | 0.68 | 1.01 |
| WV-6544 | 0.88 | 0.04 | 0.03 | 0.02 | 0.05 | 0.51 | 0.96 | 1.28 | 1.88 | 1.90 |
|  | 0.55 | 0.02 | 0.05 | 0.04 | 0.17 | 0.32 | 1.50 | 1.15 | 1.19 | 2.47 |
|  | 0.71 | 0.02 | 0.03 | 0.04 | 0.08 | 0.82 | 0.82 | 1.46 | 1.54 | 1.49 |
|  | 0.78 | 0.03 | 0.00 | 0.01 | 0.14 | 0.18 | 0.60 | 0.33 | 0.24 | 0.49 |
|  | 1.38 | 0.13 | 0.03 | 0.02 | 0.35 | 0.37 | 1.05 | 0.75 | 0.92 | 1.64 |
| WV-6558 | 0.94 | 0.01 | 0.01 | 0.01 | 0.02 | 0.05 | 0.22 | 0.06 | 0.16 | 0.56 |
|  | 1.00 | 0.01 | 0.05 | 0.04 | 0.27 | 0.19 | 0.58 | 0.69 | 0.75 | 1.29 |
|  | 0.59 | 0.03 | 0.03 | 0.02 | 0.04 | 0.04 | 0.23 | 0.11 | 0.13 | 0.16 |
|  | 1.39 | 0.02 | 0.03 | 0.02 | 0.04 | 0.14 | 0.27 | 0.25 | 0.46 | 1.15 |
|  | 0.93 | 0.05 | 0.05 | 1.50 | 0.05 | 0.05 | 0.28 | 0.29 | 0.49 | 1.22 |
| WV-6559 | 0.70 | 0.02 | 0.04 | 0.06 | 0.05 | 0.08 | 0.25 | 0.28 | 0.51 | 1.33 |
|  | 1.64 | 0.06 | 0.01 | 0.05 | 0.08 | 0.05 | 0.22 | 0.29 | 0.12 | 0.50 |
|  | 1.06 | 0.01 | 0.00 | 0.04 | 0.03 | 0.04 | 0.24 | 0.00 | 0.02 | 0.01 |
|  | 1.53 | 0.21 | 0.02 | 0.05 | 0.13 | 0.17 | 0.32 | 0.71 | 0.69 | 1.92 |
|  | 0.60 | 0.01 | 0.03 | 0.02 | 0.05 | 0.07 | 0.30 | 0.36 | 0.18 | 0.40 | hAPOC3 Tg (transgenic) mice were dosed with 5 mpk of oligonucleotide on days 1 and 3, and samples were collected on days 1, 8, 15, 22, 29, 43, 50, 57 and 63. Levels of hAPOC3 protein level relative to PBS are shown.

TABLE 60O

|  | 1 | 8 | 15 | 22 | 29 | 36 | 43 | 50 | 57 | 63 |
|---|---|---|---|---|---|---|---|---|---|---|
| PBS | 0.53 | 0.27 | 0.88 | 0.89 | 1.55 | 1.66 | 0.68 | 1.21 | 0.87 | 1.29 |
|  | 1.23 | 1.49 | 1.42 | 1.19 | 1.13 | 1.19 | 1.12 | 0.96 | 1.31 | 1.09 |
|  | 0.65 | 0.83 | 1.06 | 0.86 | 0.88 | 0.59 | 0.67 | 1.46 | 1.19 | 0.73 |
|  | 1.26 | 0.98 | 1.15 | 1.94 | 1.21 | 1.23 | 1.99 | 0.82 | 1.26 | 1.36 |
|  | 1.34 | 1.42 | 0.50 | 0.12 | 0.24 | 0.33 | 0.54 | 0.54 | 0.38 | 0.53 |
| WV-3968 | 2.60 | 0.13 | 0.04 | 0.06 | 0.43 | 0.47 | 1.76 | 1.29 | 1.51 | 1.37 |
|  | 2.18 | 0.12 | 0.10 | 0.52 | 0.68 | 1.46 | 1.88 | 0.71 | 1.51 | 1.78 |
|  | 1.67 | 0.01 | 0.05 | 0.07 | 0.29 | 0.57 | 1.83 | 0.91 | 0.68 | 1.43 |
|  | 1.14 | 0.01 | 0.03 | 0.03 | 0.26 | 0.56 | 1.05 | 1.23 | 0.88 | 0.70 |
|  | 1.11 | 0.02 | 0.02 | 0.03 | 0.19 | 0.55 | 0.81 | 1.27 | 1.56 | 1.30 |
| WV-6003 | 1.60 | 0.04 | 0.06 | 0.12 | 0.12 | 0.31 | 0.45 | 0.54 | 0.94 | 1.52 |
|  | 0.40 | 0.04 | 0.06 | 0.08 | 0.14 | 0.16 | 0.45 | 0.23 | 0.68 | 1.04 |
|  | 1.30 | 0.03 | 0.05 | 0.08 | 0.25 | 0.12 | 0.33 | 0.24 | 0.44 | 0.58 |
|  | 1.33 | 0.04 | 0.05 | 0.13 | 0.34 | 0.09 | 0.43 | 0.34 | 0.73 | 1.56 |
|  | 1.11 | 0.04 | 0.06 | 0.00 | 0.15 | 0.09 | 0.31 | 0.19 | 0.70 | 0.87 |
| WV-6555 | 0.95 | 0.07 | 0.05 | 0.24 | 0.57 | 0.37 | 1.05 | 0.46 | 0.54 | 1.07 |
|  | 0.14 | 0.03 | 0.04 | 0.04 | 0.17 | 0.09 | 0.35 | 0.39 | 0.27 | 0.42 |
|  | 1.70 | 0.09 | 0.06 | 0.11 | 0.25 | 0.87 | 0.84 | 1.69 | 1.07 | 2.46 |
|  | 0.29 | 0.02 | 0.04 | 0.08 | 0.27 | 0.34 | 0.61 | 0.47 | 0.29 | 0.97 |
|  | 0.75 | 0.05 | 0.09 | 0.19 | 0.67 | 0.77 | 0.94 | 0.79 | 0.85 | 1.18 |
| WV-6757 | 1.08 | 0.04 | 0.06 | 0.10 | 0.43 | 0.24 | 0.39 | 0.27 | 0.22 | 0.42 |
|  | 0.72 | 0.04 | 0.04 | 0.07 | 0.18 | 0.13 | 0.44 | 0.26 | 0.29 | 0.35 |
|  | 0.79 | 0.02 | 0.00 | 0.37 | 0.12 | 0.13 | 0.32 | 0.34 | 0.37 | 0.81 |
|  | 2.78 | 0.25 | 0.20 | 0.36 | 0.49 | 1.05 | 1.13 | 0.87 | 0.48 | 1.67 |
|  | 0.81 | 0.08 | 0.06 | 0.07 | 0.44 | 0.42 | 0.96 | 0.53 | 0.68 | 1.01 |
| WV-6544 | 0.88 | 0.04 | 0.03 | 0.02 | 0.05 | 0.51 | 0.96 | 1.28 | 1.88 | 1.90 |
|  | 0.55 | 0.02 | 0.05 | 0.04 | 0.17 | 0.32 | 1.50 | 1.15 | 1.19 | 2.47 |
|  | 0.71 | 0.02 | 0.03 | 0.04 | 0.08 | 0.82 | 0.82 | 1.46 | 1.54 | 1.49 |
|  | 0.78 | 0.03 | 0.00 | 0.01 | 0.14 | 0.18 | 0.60 | 0.33 | 0.24 | 0.49 |
|  | 1.38 | 0.13 | 0.03 | 0.02 | 0.35 | 0.37 | 1.05 | 0.75 | 0.92 | 1.64 |
| WV-6558 | 0.94 | 0.01 | 0.01 | 0.01 | 0.02 | 0.05 | 0.22 | 0.06 | 0.16 | 0.56 |
|  | 1.00 | 0.01 | 0.05 | 0.04 | 0.27 | 0.19 | 0.58 | 0.69 | 0.75 | 1.29 |
|  | 0.59 | 0.03 | 0.03 | 0.02 | 0.04 | 0.04 | 0.23 | 0.11 | 0.13 | 0.16 |
|  | 1.39 | 0.02 | 0.03 | 0.02 | 0.04 | 0.14 | 0.27 | 0.25 | 0.46 | 1.15 |
|  | 0.93 | 0.05 | 0.05 | 1.50 | 0.05 | 0.05 | 0.28 | 0.29 | 0.49 | 1.22 |
| WV-6559 | 0.70 | 0.02 | 0.04 | 0.06 | 0.05 | 0.08 | 0.25 | 0.28 | 0.51 | 1.33 |
|  | 1.64 | 0.06 | 0.01 | 0.05 | 0.08 | 0.05 | 0.22 | 0.29 | 0.12 | 0.50 |
|  | 1.06 | 0.01 | 0.00 | 0.04 | 0.03 | 0.04 | 0.24 | 0.00 | 0.02 | 0.01 |
|  | 1.53 | 0.21 | 0.02 | 0.05 | 0.13 | 0.17 | 0.32 | 0.71 | 0.69 | 1.92 |
|  | 0.60 | 0.01 | 0.03 | 0.02 | 0.05 | 0.07 | 0.30 | 0.36 | 0.18 | 0.40 |

Several oligonucleotides were also prepared which target a mouse homolog of different gene, Factor XI (FXI), and which comprised an additional component, which was a tri-, bi- or mono-antennary ligand which was either a GalNAc or a PFE ligand.

TABLE 60P

Part I. Oligonucleotides

| Oligo-nucleotide | Sequence | Naked Sequence | Stereo-chemistry |
|---|---|---|---|
| WV-7297 | Mod038L001Teo * Geo * Geo * Teo * Aeo * A * T * m5C * m5C * A * m5C * T * T * T * m5C * Aeo * Geo * Aeo * Geo * Geo | TGGTAA TCCACTT TCAGAGG | OXXXXXXXX XXXXXXXXX XX |
| WV-7298 | Mod039L001Teo * Geo * Geo * Teo * Aeo * A * T * m5C * m5C * A * m5C * T * T * T * m5C * Aeo * Geo * Aeo * Geo * Geo | TGGTAA TCCACTT TCAGAGG | OXXXXXXXX XXXXXXXXX XX |
| WV-7299 | Mod040L001Teo * Geo * Geo * Teo * Aeo * A * T * m5C * m5C * A * m5C * T * T * T * m5C * Aeo * Geo * Aeo * Geo * Geo | TGGTAA TCCACTT TCAGAGG | OXXXXXXXX XXXXXXXXX XX |
| WV-7300 | Mod041L001Teo * Geo * Geo * Teo * Aeo * A * T * m5C * m5C * A * m5C * T * T * T * m5C * Aeo * Geo * Aeo * Geo * Geo | TGGTAA TCCACTT TCAGAGG | OXXXXXXXX XXXXXXXXX XX |
| WV-5287 | Mod034L001Teo * Geo * Geo * Teo * Aeo * A * T * m5C * m5C * A * m5C * T * T * T * m5C * Aeo * Geo * Aeo * Geo * Geo | TGGTAA TCCACTT TCAGAGG | OXXXXXXXX XXXXXXXXX XX |

The various components (e.g., *, Mod038, etc.) in this table are the same as those in Table 1A. All of these oligonucleotides are single-stranded, though the sequences are split into multiple lines for formatting.

The oligonucleotides listed in Table 60P, Part I, were administered to mice at 0.3, 1 or 3 mpK QDx3. Numbers below represent the mFXI/mHPRT1 mRNA level relative to control at 3 mpk. Mice were also administered oligonucleotides at 0.3 and 1 mpk (data not shown).

TABLE 60P

Part II. Activity of oligonucleotides.

| mFXI Oligonucleotide | Ligand | mFX1/mHPRT1 |
|---|---|---|
| WV-3969 | Tri-GalNAc | 23 |
| WV-5287 | Tri-PFE ligand | 22 |
| WV-7299 | Bis-GalNAc | 22 |
| WV-7300 | Bis-PFE ligand | 20 |
| WV-7297 | Mono-GalNAc | 74 |
| WV-7298 | Mono-PFE ligand | 43 |

As shown in Tables 61 to 73, various oligonucleotides were constructed and tested for their ability to mediate knockdown of PNPLA3, including in vitro. Without wishing to be bound by any theory, the present disclosure suggests that at least some of the oligonucleotides in Tables 61 to 73 may be capable of mediating knockdown via a RISC-mediated ssRNAi mechanism. In addition, some of the oligonucleotides in these tables have a hybrid format. In addition, at least some of the oligonucleotides described herein are capable of mediating knockdown of PNPLA3 in an allele-specific manner.

Table 61. Table 61 shows in vitro efficacy of different single-stranded RNAi agents, which target PNPLA3. Oligonucleotides tested are: WV-4054 and WV-4098. Oligonucleotides were tested in Hep3B (I/I) cells, with is homozygous wild-type (I/I aa in PNPLA3); and in Huh7 cells, which is homozygous mutant (M/M aa in PNPLA3). IC50 of WV-4054 in Huh7 cells was 0.239 nM; and IC50 of WV-4098 in Huh7 cells was 0.158 nM. Oligonucleotides WV-4054 and WV-4098 differ in length but are both capable of mediating allele-specific knockdown of PNPLA3. The ability of WV-4098 to mediate knockdown via a RNA interference mechanism is supported by the finding that a CRISPR knockout of AGO-2 (which is required for RNA interference) prevented the ability of WV-4098 to knockdown gene expression, while knockouts of AGO-1, AGO-3 and AGO-4 (which are not required for RNA interference) did not (data not shown).

TABLE 61A

Activity of oligonucleotides.

| Conc. (exp 10) (nM) | WV-4054-Hep3b | | WV-4054-Huh7 | |
|---|---|---|---|---|
| 0.796 | 1.226 | 1.121 | 0.280 | 0.449 |
| 0.495 | 0.910 | 1.010 | 0.478 | 0.402 |
| 0.194 | 1.068 | 1.024 | 0.419 | 0.367 |
| −0.107 | 0.843 | 1.160 | 0.405 | 0.449 |
| −0.408 | 0.976 | 0.942 | 0.422 | 0.584 |
| −0.709 | 0.798 | 0.917 | 0.750 | 0.601 |
| −1.010 | 0.832 | 1.038 | 0.798 | 0.755 |
| −1.612 | 1.053 | 0.923 | 0.969 | 0.792 |
| −2.214 | 0.956 | 0.929 | 0.809 | 0.798 |

Table 62. Table 62 shows the in vitro potency and $IC_{50}$ for different single-stranded RNAi agents, which target PNPLA3. Tested oligonucleotides are: WV-2477 (positive control), WV-3380 (positive control), WV-4018, WV-4019, WV-4020, WV-4021, WV-4022, WV-4023, WV-4024, and WV-4025, each tested in Hep3B (Hep) and Huh7 (Huh) cells. Oligonucleotides for PNPLA3 assays were delivered using Lipofectamine® 2000 transfection reagent (ThermoFisher, Grand Island, N.Y.). In this and other tables, oligonucleotides were tested at concentrations of 2, 8.25 and 33 nM.

TABLE 62

Activity of oligonucleotides.

| | 2 nM | | 8.25 nM | | 33 nM | |
|---|---|---|---|---|---|---|
| Control | | 94.6 | 103.5 | 102.8 | 102.1 | 108.7 |
| WV-2477-Hep | | 91.4 | 110.2 | 103.5 | 101.4 | 102.1 |
| WV-2477_Huh | | 86.2 | 90.5 | 96.4 | 84.5 | 98.4 |
| WV-3380-Hep | 51.1 | 46.3 | 30.8 | 26.4 | 4.9 | 8.8 |
| WV-3380-Huh | | 59.7 | 53.5 | 58.9 | 10.3 | |
| WV-4018-Hep | 61.1 | 47.0 | | 94.0 | 72.7 | 65.5 |
| WV-4018-Huh | 43.4 | 46.9 | 61.8 | 51.6 | 63.6 | 66.7 |
| WV-4019-Hep | 75.3 | 88.3 | 117.3 | 119.7 | 84.7 | 79.6 |
| WV-4019-Huh | 67.7 | 68.1 | 77.7 | 77.2 | 67.7 | 74.0 |
| WV-4020-Hep | 74.7 | 68.8 | 87.1 | 92.7 | 52.1 | 59.5 |
| WV-4020-Huh | 70.0 | 81.6 | 71.0 | 91.2 | 54.6 | 77.2 |
| WV-4021-Hep | 64.6 | 81.2 | 76.8 | 85.9 | 45.4 | 56.1 |

TABLE 62-continued

Activity of oligonucleotides.

| | 2 nM | | 8.25 nM | | 33 nM | |
|---|---|---|---|---|---|---|
| WV-4021-Huh | 68.6 | 64.0 | 69.1 | 69.6 | 64.0 | 68.1 |
| WV-4022-Hep | 66.0 | 75.3 | | 97.3 | 56.3 | 62.9 |
| WV-4022-Huh | 49.5 | 62.7 | 63.6 | 58.9 | 58.1 | 77.2 |
| WV-4023-Hep | 62.9 | 90.8 | 76.3 | 79.6 | 46.7 | 47.6 |
| WV-4023-Huh | 70.5 | 66.7 | 71.5 | 75.1 | 64.0 | 67.7 |
| WV-4024-Hep | 74.7 | 77.4 | 99.3 | 100.7 | 54.7 | 75.8 |
| WV-4024-Huh | 70.0 | 63.1 | 104.0 | 91.2 | 79.9 | 88.7 |
| WV-4025-Hep | 61.1 | 65.5 | 65.5 | | 83.5 | 55.1 |
| WV-4025-Huh | 58.9 | 71.5 | 69.1 | 66.3 | 79.9 | 63.6 |

Table 63. Table 63 shows the in vitro potency and IC$_{50}$ for different single-stranded RNAi agents, which target PNPLA3. Tested oligonucleotides are: WV-2477 (positive control), WV-3380 (positive control), WV-4026, WV-4027, WV-4028, WV-4029, WV-4030, WV-4031, WV-4032, and WV-4033, each tested in Hep3B (Hep) and Huh7 (Huh) cells.

TABLE 63

Activity of oligonucleotides.

| | 2 nM | | 8.25 nM | | 33 nM | |
|---|---|---|---|---|---|---|
| Control | | 94.6 | 103.5 | 102.8 | 102.1 | 108.7 |
| WV-2477-Hep | | 91.4 | 110.2 | 103.5 | 101.4 | 102.1 |
| WV-2477_Huh | | 86.2 | 90.5 | 96.4 | 84.5 | 98.4 |
| WV-3380-Hep | 51.1 | 46.3 | 30.8 | 26.4 | 4.9 | 8.8 |
| WV-3380-Huh | | 59.7 | 53.5 | 58.9 | 10.3 | |
| WV-4026-Hep | | 104.2 | 115.7 | 105.7 | 103.5 | 86.5 |
| WV-4026-Huh | 74.0 | 76.1 | 84.5 | 70.5 | 71.5 | 68.1 |
| WV-4027-Hep | 64.6 | 76.3 | 71.2 | 77.4 | 39.0 | 51.1 |
| WV-4027-Huh | 69.1 | 75.1 | 55.7 | 69.1 | 60.1 | 61.4 |
| WV-4028-Hep | 79.0 | 71.2 | 102.8 | 107.2 | 70.2 | 53.6 |
| WV-4028-Huh | 74.0 | 70.0 | 64.5 | 65.4 | 83.9 | 76.7 |
| WV-4029-Hep | 79.6 | 87.7 | 81.8 | 100.0 | 57.8 | 79.6 |
| WV-4029-Huh | | 74.0 | 74.6 | 79.4 | 116.2 | 102.6 |
| WV-4030-Hep | | 85.9 | 93.3 | 105.0 | 68.8 | 80.1 |
| WV-4030-Huh | 51.6 | 67.7 | 75.1 | 69.1 | 71.5 | |
| WV-4031-Hep | 85.9 | 101.4 | 104.2 | 122.3 | 51.1 | 56.3 |
| WV-4031-Huh | 73.5 | 72.0 | 100.4 | 91.2 | 95.7 | 95.0 |
| WV-4032-Hep | 78.5 | 73.7 | | 121.4 | 51.8 | 62.0 |
| WV-4032-Huh | 81.0 | 82.2 | 100.4 | 105.4 | 107.7 | 124.5 |
| WV-4033-Hep | 84.1 | 85.3 | 100.0 | | 83.5 | 83.5 |
| WV-4033-Huh | 52.4 | 38.9 | 57.3 | 59.7 | 107.7 | 81.0 |

Table 64. Table 64 shows the in vitro potency and IC$_{50}$ for different single-stranded RNAi agents, which target PNPLA3. Tested oligonucleotides are: WV-2477 (positive control), WV-3380 (positive control), WV-4034, WV-4035, WV-4036, WV-4037, WV-4038, WV-4039, WV-4040, WV-4041, each tested in Hep3B (Hep) and Huh7 (Huh) cells.

TABLE 64

Activity of oligonucleotides.

| | 2 nM | | 8.25 nM | | 33 nM | |
|---|---|---|---|---|---|---|
| Control | | 94.6 | 103.5 | 102.8 | 102.1 | 108.7 |
| WV-2477-Hep | | 91.4 | 110.2 | 103.5 | 101.4 | 102.1 |
| WV-2477_Huh | | 86.2 | 90.5 | 96.4 | 84.5 | 98.4 |
| WV-3380-Hep | 51.1 | 46.3 | 30.8 | 26.4 | 4.9 | 8.8 |
| WV-3380-Huh | | 59.7 | 53.5 | 58.9 | 10.3 | |
| WV-4034-Hep | 100.0 | 100.0 | 100.0 | 100.0 | 100.0 | 100.0 |
| WV-4034-Huh | 73.0 | 76.7 | 91.2 | 78.8 | 101.1 | 119.4 |
| WV-4035-Hep | 81.8 | 77.4 | 92.7 | 104.2 | 57.8 | 84.7 |
| WV-4035-Huh | 75.1 | 81.6 | 82.2 | 63.1 | 101.1 | 115.4 |
| WV-4036-Hep | 76.3 | 77.4 | 82.9 | 77.4 | 49.7 | 54.0 |
| WV-4036-Huh | 74.6 | 75.1 | 72.5 | 67.2 | 75.6 | 87.4 |

TABLE 64-continued

Activity of oligonucleotides.

| | 2 nM | | 8.25 nM | | 33 nM | |
|---|---|---|---|---|---|---|
| WV-4037-Hep | 79.6 | 68.3 | 75.8 | 97.3 | 80.7 | 72.7 |
| WV-4037-Huh | 69.6 | 82.7 | 76.7 | 87.4 | 94.4 | 81.0 |
| WV-4038-Hep | 64.2 | 71.2 | 74.2 | 97.9 | 83.5 | 83.5 |
| WV-4038-Huh | 69.1 | 85.1 | 78.3 | 67.2 | 86.8 | 69.6 |
| WV-4039-Hep | 69.3 | 70.2 | 46.0 | 77.9 | 48.6 | 45.7 |
| WV-4039-Huh | 63.1 | 79.9 | 64.0 | 58.9 | 61.0 | 50.6 |
| WV-4040-Hep | 74.2 | 67.8 | 92.7 | 75.8 | 50.0 | 59.9 |
| WV-4040-Huh | 88.0 | 70.0 | 73.5 | 78.3 | 71.0 | 66.3 |
| WV-4041-Hep | 77.4 | 75.8 | 82.9 | 95.9 | 61.1 | 60.7 |
| WV-4041-Huh | 99.1 | 93.7 | 83.9 | 82.7 | 67.2 | 61.0 |

Table 65. Table 65 shows the in vitro potency and IC$_{50}$ for different single-stranded RNAi agents, which target PNPLA3. Tested oligonucleotides are: WV-3380 (positive control), WV-2477 (positive control), WV-4042, WV-4043, WV-4044, WV-4045, WV-4046, WV-4047, WV-4048, and WV-4049, each tested in Hep3B (Hep) and Huh7 (Huh) cells.

TABLE 65

Activity of oligonucleotides.

| | 2 nM | | 8.25 nM | | 33 nM | |
|---|---|---|---|---|---|---|
| Control | 111.9 | 113.4 | 113.4 | 119.1 | 100.1 | 111.9 |
| WV-2477-Hep | 99.4 | 100.1 | 115.8 | 107.3 | 103.7 | 119.1 |
| WV-2477-Huh | 96.9 | 91.6 | 89.7 | 109.7 | 96.9 | 91.0 |
| WV-3380-Hep | 39.8 | 52.6 | 35.7 | 26.3 | 5.9 | |
| WV-3380-Huh | 54.5 | 60.5 | | 46.8 | 22.7 | |
| WV-4042-Hep | 63.8 | 67.5 | 86.6 | 72.8 | 49.0 | 49.4 |
| WV-4042-Huh | | 66.2 | | 48.4 | 25.4 | 28.2 |
| WV-4043-Hep | 64.3 | 60.8 | 83.6 | 68.4 | 52.9 | 41.8 |
| WV-4043-Huh | 48.4 | 64.8 | 48.4 | 56.8 | 47.1 | 52.6 |
| WV-4044-Hep | 70.8 | 66.5 | 83.0 | 73.3 | 20.6 | 33.7 |
| WV-4044-Huh | 86.7 | 109.0 | 72.9 | 81.4 | 38.5 | 33.3 |
| WV-4045-Hep | 86.0 | 80.2 | 100.8 | 103.0 | 44.8 | 42.1 |
| WV-4045-Huh | 81.4 | 79.2 | 80.9 | 76.5 | 45.2 | 62.6 |
| WV-4046-Hep | 117.4 | 96.7 | 92.1 | 82.5 | 24.9 | 22.9 |
| WV-4046-Huh | 83.7 | 73.9 | 71.9 | 56.4 | 44.6 | 41.9 |
| WV-4047-Hep | 86.0 | 76.4 | 98.8 | 111.1 | 53.3 | 51.8 |
| WV-4047-Huh | 63.5 | 94.2 | 78.7 | 71.9 | 56.0 | 38.0 |
| WV-4048-Hep | 79.1 | 70.3 | 95.4 | 98.8 | 37.4 | 27.2 |
| WV-4048-Huh | 93.6 | 76.5 | 81.4 | 81.4 | 46.5 | 44.9 |
| WV-4049-Hep | | 107.3 | 107.3 | 111.9 | 36.1 | 55.9 |
| WV-4049-Huh | 87.3 | 98.2 | 88.5 | 89.7 | 62.6 | 62.2 |

Table 66. Table 66 shows the in vitro potency and IC$_{50}$ for different single-stranded RNAi agents, which target PNPLA3. Tested oligonucleotides are: WV-2477 (positive control), WV-3380 (positive control), WV-4050, WV-4051, WV-4052, WV-4053, WV-4054, WV-4055, WV-4056, WV-4057, each tested in Hep3B (Hep) and Huh7 (Huh) cells.

TABLE 66

Activity of oligonucleotides.

| | 2 nM | | 8.25 nM | | 33 nM | |
|---|---|---|---|---|---|---|
| Control | 111.9 | 113.4 | 113.4 | 119.1 | 100.1 | 111.9 |
| WV-2477-Hep | 99.4 | 100.1 | 115.8 | 107.3 | 103.7 | 119.1 |
| WV-2477-Huh | 96.9 | 91.6 | 89.7 | 109.7 | 96.9 | 91.0 |
| WV-3380-Hep | 39.8 | 52.6 | 35.7 | 26.3 | 5.9 | |
| WV-3380-Huh | 54.5 | 60.5 | | 46.8 | 22.7 | |
| WV-4050-Hep | 71.8 | 75.9 | 98.8 | 75.9 | 54.8 | 55.2 |
| WV-4050-Huh | 69.0 | 80.9 | 63.0 | 57.6 | 46.8 | 57.6 |
| WV-4051-Hep | 73.8 | 80.8 | 92.8 | 69.4 | 40.4 | 59.1 |
| WV-4051-Huh | 67.1 | 74.9 | 54.9 | 58.8 | 47.4 | 37.5 |
| WV-4052-Hep | 79.1 | 77.0 | 113.4 | 97.4 | 51.5 | 44.8 |

TABLE 66-continued

Activity of oligonucleotides.

|  | 2 nM | | 8.25 nM | | 33 nM | |
|---|---|---|---|---|---|---|
| WV-4052-Huh | 67.1 | 67.1 | 84.9 | 80.3 | 75.5 | 52.6 |
| WV-4053-Hep | 89.0 | 69.8 | 100.0 | | 63.4 | 57.1 |
| WV-4053-Huh | 56.0 | 64.3 | 76.0 | 68.0 | 84.3 | 59.2 |
| WV-4054-Hep | 100.0 | 100.0 | 100.0 | 100.0 | 106.6 | 111.9 |
| WV-4054-Huh | 30.6 | 31.7 | | 38.8 | 53.0 | 47.8 |
| WV-4055-Hep | 92.1 | 105.8 | 100.0 | | 58.7 | 72.3 |
| WV-4055-Huh | 69.9 | 80.9 | 95.5 | 81.4 | 77.6 | 71.9 |
| WV-4056-Hep | 86.6 | 81.3 | | 116.6 | 54.0 | 65.6 |
| WV-4056-Huh | 84.9 | | 78.7 | 101.0 | 62.2 | 76.5 |
| WV-4057-Hep | 105.8 | 95.4 | 110.3 | 105.1 | 46.1 | 50.8 |
| WV-4057-Huh | 87.9 | 79.8 | 107.5 | 92.3 | 72.9 | 50.5 |

Table 67. Table 67 shows the in vitro potency and $IC_{50}$ for different single-stranded RNAi agents, which target PNPLA3. Tested oligonucleotides are: WV-2477 (positive control), WV-3380 (positive control), WV-4058, WV-4059, WV-4060, WV-4061, WV-4062, WV-4063, WV-4064, and WV-4065. Oligonucleotides were tested in Hep3B (Hep) and Huh7 (Huh-7 or Huh or P-Huh7 or P-Huh-7) cells.

TABLE 67

Activity of oligonucleotides.

|  | 2 nM | | 8.25 nM | | 33 nM | |
|---|---|---|---|---|---|---|
| Control | 111.9 | 113.4 | 113.4 | 119.1 | 100.1 | 111.9 |
| WV-2477-Hep | 99.4 | 100.1 | 115.8 | 107.3 | 103.7 | 119.1 |
| WV-2477-Huh | 96.9 | 91.6 | 89.7 | 109.7 | 96.9 | 91.0 |
| WV-3380-Hep | 39.8 | 52.6 | 35.7 | 26.3 | 5.9 | |
| WV-3380-Huh | 54.5 | 60.5 | | 46.8 | 22.7 | |
| WV-4058-Hep | 67.0 | 78.0 | 73.3 | 62.5 | 67.0 | 56.3 |
| WV-4058-Huh | 73.9 | 79.8 | 86.7 | 70.9 | 55.6 | 59.6 |
| WV-4059-Hep | 64.7 | 70.3 | 74.8 | 53.7 | 74.3 | 63.4 |
| WV-4059-Huh | 74.4 | 63.0 | 65.7 | 74.4 | 44.3 | 43.9 |
| WV-4060-Hep | 80.8 | 68.9 | | 107.3 | 43.0 | 63.4 |
| WV-4060-Huh | 77.6 | 39.9 | 72.9 | 66.2 | 66.6 | 79.2 |
| WV-4061-Hep | 115.8 | 93.4 | | 108.8 | 57.5 | 66.1 |
| WV-4061-Huh | 70.9 | 60.0 | 87.9 | 68.0 | 61.7 | 70.4 |
| WV-4062-Hep | 97.4 | 91.5 | 111.9 | | 78.0 | 59.5 |
| WV-4062-Huh | | 81.4 | 94.2 | 83.2 | 101.7 | 82.6 |
| WV-4063-Hep | 86.6 | 82.5 | 98.1 | 119.9 | 47.0 | 54.0 |
| WV-4063-Huh | | 79.2 | 76.5 | 77.6 | 58.8 | 75.5 |
| WV-4064-Hep | 72.8 | 83.6 | 111.1 | 91.5 | 61.2 | 56.3 |
| WV-4064-Huh | 71.4 | 59.2 | 53.4 | 52.6 | 50.1 | 66.2 |
| WV-4065-Hep | 109.6 | 107.3 | 87.2 | 101.5 | 33.7 | 68.4 |
| WV-4065-Huh | 92.3 | 86.1 | 89.1 | 97.5 | 67.1 | 76.0 |

Table 68. Table 68 shows the in vitro potency for different single-stranded RNAi agents, which target PNPLA3. Tested oligonucleotides are: WV-4098, WV-7462, WV-7464, WV-7467, and WV-7469.

Concentration (Conc.) of oligonucleotides is provided. Cells used and oligonucleotide used are also provided. Numbers represent PNPLA3 mRNA level (PNPLA3/HPRT1), wherein 100 would represent 100% mRNA level (no knockdown) and 0 would represent 0% mRNA level (or 100% knockdown). Data from replicates are shown.

TABLE 68

Activity of oligonucleotides.

Part 1. Activity in Hep3B cells.

| Conc. | WV-4098 | | WV-7462 | | WV-7464 | |
|---|---|---|---|---|---|---|
| 0.006 | 97.9 | 94.5 | 112.3 | 100.9 | 106.4 | 107.3 |
| 0.025 | 134.1 | 100.9 | 96.2 | 87.9 | 155.5 | 99.2 |
| 0.01 | 99.5 | 97.9 | 92.5 | 95.0 | 108.9 | 109.4 |

TABLE 68-continued

Activity of oligonucleotides.

| 0.4 | 84.4 | 94.2 | 74.2 | 90.5 | 96.5 | 105.6 |
|---|---|---|---|---|---|---|
| 1.6 | 88.3 | 84.4 | 99.6 | 82.4 | 80.8 | 97.0 |
| 6.25 | 131.4 | 137.0 | 120.3 | 142.1 | 81.2 | 121.1 |

| Conc. | WV-7467 | | WV-7469 | |
|---|---|---|---|---|
| 0.006 | 103.9 | 105.9 | 93.9 | 100.7 |
| 0.025 | 99.9 | 108.8 | 97.4 | 84.9 |
| 0.01 | 91.0 | 106.0 | 90.8 | 107.1 |
| 0.4 | 100.5 | 100.1 | 75.8 | 81.1 |
| 1.6 | 83.8 | 82.0 | 76.0 | 72.5 |
| 6.25 | 100.0 | 100.3 | 77.0 | 82.8 |

Part 2. Activity in Huh7 (P-Huh7) cells.

| Conc. | WV-4098 | | WV-7462 | | WV-7464 | |
|---|---|---|---|---|---|---|
| 0.006 | 105.8 | 115.7 | 129.8 | 116.1 | 110.5 | 131.0 |
| 0.025 | 102.1 | 105.0 | 110.0 | 94.3 | 116.6 | 127.3 |
| 0.01 | 77.2 | 95.8 | 93.3 | 72.8 | 79.1 | 104.5 |
| 0.4 | 83.8 | 65.4 | 66.2 | 66.4 | 93.8 | 54.2 |
| 1.6 | 40.8 | 54.7 | 50.9 | 46.1 | 58.1 | 45.0 |
| 6.25 | 43.0 | 34.2 | 49.8 | 32.9 | 48.9 | 34.3 |

| Conc. | WV-7467 | | WV-7469 | |
|---|---|---|---|---|
| 0.006 | 109.2 | 129.2 | 86.0 | 87.3 |
| 0.025 | 99.9 | 107.2 | 90.5 | 102.1 |
| 0.01 | 73.3 | 63.7 | 72.0 | 65.6 |
| 0.4 | 88.0 | 66.7 | 54.0 | 46.2 |
| 1.6 | 49.1 | 33.4 | 41.2 | 28.6 |
| 6.25 | 48.5 | 38.8 | 32.0 | 28.5 |

Table 69. Tables 69A and B show the in vitro potency and $IC_{50}$ for different single-stranded RNAi agents, which target PNPLA3. Tested oligonucleotides are: Table 69A, WV-4098, WV-4075, WV-7465, WV-7466, and WV-7468; and Table 69B, WV-3380, WV-4098, and WV-7469.

Concentration (Conc.) of oligonucleotides is provided. Cells used and oligonucleotide used are also provided. Numbers represent PNPLA3 mRNA level (PNPLA3/HPRT1), wherein 100 would represent 100% mRNA level (no knockdown) and 0 would represent 0% mRNA level (or 100% knockdown). Data from replicates are shown.

Part 1. Activity in Hep3B Cells.

TABLE 69A

Activity of oligonucleotides.

Part 1. Activity in Hep3B cells.

| Conc. | WV-4098 | | WV-4075 | | WV-7463 | |
|---|---|---|---|---|---|---|
| 0.006 | 97.9 | 94.5 | 77.4 | 80.1 | 90.8 | 106.9 |
| 0.025 | 134.1 | 100.9 | 91.1 | 109.1 | 119.9 | 97.2 |
| 0.01 | 99.5 | 97.9 | 85.3 | 86.6 | 106.7 | 90.9 |
| 0.4 | 84.4 | 94.2 | 83.1 | 95.8 | 79.4 | 86.3 |
| 1.6 | 88.3 | 84.4 | 110.5 | 112.5 | 127.0 | 112.5 |
| 6.25 | 131.4 | 137.0 | 115.8 | 135.8 | 148.7 | 164.1 |

| Conc. | WV-7465 | | WV-7466 | | WV-7468 | |
|---|---|---|---|---|---|---|
| 0.006 | 101.1 | 102.2 | 124.3 | 98.9 | 97.9 | 97.0 |
| 0.025 | 118.5 | 116.3 | 140.4 | 121.2 | 118.1 | 112.1 |
| 0.01 | 102.0 | 110.0 | 126.4 | 113.2 | 100.2 | 88.8 |
| 0.4 | 131.3 | 132.4 | 112.0 | 139.2 | 92.7 | 96.6 |
| 1.6 | 108.2 | 95.5 | 102.5 | 98.1 | 83.9 | 97.7 |
| 6.25 | 98.1 | 107.2 | 126.6 | 128.5 | 120.7 | 134.7 |

TABLE 69A-continued

Activity of oligonucleotides.

Part 2. Activity in Huh7 cells.

| Conc. | WV-4098 | | WV-4075 | | WV-7463 | |
|---|---|---|---|---|---|---|
| 0.006 | 105.8 | 115.7 | 111.3 | 119.4 | 116.9 | 131.9 |
| 0.025 | 102.1 | 105.0 | 101.8 | 95.8 | 116.9 | 119.4 |
| 0.01 | 77.2 | 95.8 | 96.5 | 94.1 | 95.3 | 77.9 |
| 0.4 | 83.8 | 65.4 | 85.9 | 81.0 | 62.6 | 50.7 |
| 1.6 | 40.8 | 54.7 | 58.6 | 67.8 | 50.1 | 45.6 |
| 6.25 | 43.0 | 34.2 | 70.8 | 57.7 | 60.0 | 67.1 |

| Conc. | WV-7465 | | WV-7466 | | WV-7468 | |
|---|---|---|---|---|---|---|
| 0.006 | 119.6 | 126.5 | 100.1 | 124.8 | 69.3 | 95.2 |
| 0.025 | 114.8 | 111.8 | 95.0 | 106.6 | 69.8 | 84.9 |
| 0.01 | 104.9 | 101.4 | 50.1 | 61.3 | 54.2 | 48.5 |
| 0.4 | 84.5 | 64.3 | 64.1 | 43.3 | 55.5 | 38.1 |
| 1.6 | 55.3 | 55.2 | 40.2 | 35.3 | 37.4 | 33.5 |
| 6.25 | 79.4 | 57.3 | 50.2 | 46.5 | 60.3 | 41.4 |

Concentration (Conc.) of oligonucleotides is provided. Cells used and oligonucleotide used are also provided. Numbers represent PNPLA3 mRNA level (PNPLA3/HPRT1), wherein 100 would represent 100% mRNA level (no knockdown) and 0 would represent 0% mRNA level (or 100% knockdown). Data from replicates are shown.

TABLE 69B

Activity of oligonucleotides.

| Conc. | Hep3B-WV3380 | | Huh7-WV-3380 | |
|---|---|---|---|---|
| 0.006 | 83.9 | 88.2 | 87.5 | 101.8 |
| 0.025 | 92.3 | 88.7 | 90.1 | 105.4 |
| 0.01 | 75.3 | 70.6 | 75.5 | |
| 0.4 | 40.2 | 49.4 | 79.1 | 69.3 |
| 1.6 | 22.6 | 20.8 | 52.2 | 52.2 |
| 6.25 | 5.3 | 4.4 | 18.6 | 15.5 |

| Conc. | Hep3B-WV-4098 | | Huh7-WV-4098 | |
|---|---|---|---|---|
| 0.006 | 97.9 | 94.5 | 105.8 | 115.7 |
| 0.025 | 134.1 | 100.9 | 102.1 | 105.0 |
| 0.01 | 99.5 | 97.9 | 77.2 | 95.8 |
| 0.4 | 84.4 | 94.2 | 83.8 | 65.4 |
| 1.6 | 88.3 | 84.4 | 40.8 | 54.7 |
| 6.25 | 131.4 | 137.0 | 43.0 | 34.2 |

| Conc. | Hep3B-WV-7469 | | Huh-WV-7469 | |
|---|---|---|---|---|
| 0.006 | 93.9 | 100.7 | 86.0 | 87.3 |
| 0.025 | 97.4 | 84.9 | 90.5 | 102.1 |
| 0.01 | 90.8 | 107.1 | 72.0 | 65.6 |
| 0.4 | 75.8 | 81.1 | 54.0 | 46.2 |
| 1.6 | 76.0 | 72.5 | 41.2 | 28.6 |
| 6.25 | 77.0 | 82.8 | 32.0 | 28.5 |

Table 69C shows a rat liver homogenate stability assay (24 hours). Tested oligonucleotides were: WV-4098, WV-7463, WV-7462, WV-7316, WV-4075, WV-7469, WV-7464, WV-7468, WV-7467, WV-7466, WV-7465.

Numbers indicate percentage of full-length oligonucleotide remaining after 24 hr treatment with rat liver homogenate. 100 would represent 100% of full length oligonucleotide remaining; 0 would represent 0% of full length oligonucleotide remaining. Different oligonucleotides have different numbers of stereocontrolled phosphorothioate internucleotidic linkages. Data from replicates are shown.

TABLE 69C

Stability of oligonucleotides.

| WV-4075 | | WV-4098 | | WV-7316 | |
|---|---|---|---|---|---|
| 23.5 | 23.5 | 24.3 | 19.2 | 18.3 | 17.4 | 16.8 | 18.7 | 18.3 |

| WV-7462 | | WV-7463 | | WV-7464 | |
|---|---|---|---|---|---|
| 21.1 | 20.7 | 21.4 | 15.0 | 16.2 | 15.4 | 45.7 | 43.6 | 45.8 |

| WV-7465 | | WV-7466 | | WV-7467 | |
|---|---|---|---|---|---|
| 85.6 | 86.1 | 87.6 | 65.2 | 69.6 | 69.8 | 54.7 | 57.1 | 56.0 |

| WV-7468 | | WV-7469 | |
|---|---|---|---|
| 55.7 | 55.6 | 50.0 | 43.0 | 45.0 | 41.8 |

Table 70. Table 70 shows the IC50 for different single-stranded RNAi agents. Tested oligonucleotides are: WV-2477, WV-4054, and WV-3387 in Huh7 and Hep3B cells. WV-2477 did not significantly knock down PNPLA3 in either cells. WV-4054 has a sequence complementary to a pair of SNPs, rs738408 T and rs738409 G, and is able to mediate allele-specific RNA interference against cells (Huh7) which comprise these two SNPs. This oligonucleotide does not mediate significant RNAi interference at the tested concentrations in different cells (Hep3B) which do not comprise these SNPs, but rather have rs738408C and rs738409 C. In addition, single-stranded RNAi agent WV-4098 is also able to knock-down a complementary sequence (with SNPs rs738408 T and rs738409 G in Huh7 cells), but not a non-complementary sequence (with SNPs rs738408C and rs738409 C in Hep3B cells) at the tested concentrations.

TABLE 70

IC50 of oligonucleotides.

| Oligonucleotide-cell tested | IC50 (nM) | 95% CI |
|---|---|---|
| WV-4054-Hep3b | NA | --- |
| WV-4054-Huh7 | 0.239 | 0.15 to 0.38 |
| WV-4098-Hep3b | NA | --- |
| WV-4098-Huh7 | 0.158 | 0.10 to 0.22 |

Table 71. Tables 71A to 71D show non-limiting examples of formats of stereocontrolled (e.g., chirally controlled) oligonucleotides (e.g., single-stranded RNAi agents).

Table 72. Table 72 shows the in vitro potency in primary cynomolgus hepatic cells of ssRNAi WV-4054.

Table 74. Table 74 shows the efficacy of antisense oligonucleotides in knockdown of PNPLA3 mediated by RNase H, in a Hep3B 24 hour assay. Tested oligonucleotides are: WV-1868 (negative control), WV-3367, WV-3368, WV-3369, WV-3370, WV-3371, WV-3372, WV-3373, WV-3374, WV-3375, WV-3376, WV-3377, WV-3378, WV-3379, and WV-3380. WV-1868 is an antisense oligonucleotide (operating through RNase H-mediated knockdown), while other tested oligonucleotides are RNAi agents. Cell used were PCH cells.

Table 73. Table 73 shows the structure of PNPLA3 ssRNAi agents WV-7467, WV-7469, WV-7466, and WV-7468; and ASO WV-6825.

As shown in Tables 74 to 90, various oligonucleotides were constructed and tested for their ability to mediate knockdown of PNPLA3, including in vitro. Without wishing to be bound by any theory, the present disclosure suggests that at least some of the oligonucleotides in Tables 74 to 90 may be capable of mediating knockdown via a RNaseH-mediated mechanism. In addition, some of the oligonucleotides in these tables have a hybrid format.

Table 74. Table 74 shows the in vitro potency of ASOs to PNPLA3. Tested oligonucleotides are: WV-1868, and WV-3367 to WV-3380. Cells used were Hep3B cells.

TABLE 74

Activity of oligonucleotides.

| Wave ID | 2.0 nM | 8.2 nM | 33 nM |
|---|---|---|---|
| Control | .96 | 1.08 | 1.13 |
| WV-1868 | 1.18 | 1.06 | .85 |
| WV-3367 | 1.07 | 1.04 | .77 |
| WV-3368 | 1.17 | .96 | .58 |
| WV-3369 | 1.12 | .98 | 1.03 |
| WV-3370 | 1.23 | .88 | .67 |
| WV-3371 | 1.24 | 1.19 | .65 |
| WV-3372 | 1.08 | 1.17 | 1.05 |
| WV-3373 | 1.22 | 1.14 | 1.15 |
| WV-3374 | 1.19 | .99 | .76 |
| WV-3375 | 1.14 | 1.0 | .63 |
| WV-3376 | 1.14 | .72 | .39 |
| WV-3377 | .92 | .52 | .12 |
| WV-3378 | 1.07 | .48 | .15 |
| WV-3379 | 1.18 | .45 | .16 |
| WV-3380 | .31 | .12 | .06 |

Table 75. Table 75 shows the in vitro potency of ASOs to PNPLA3. Tested oligonucleotides are: WV-1868, and WV-3381 to WV-3394.

TABLE 75

Activity of oligonucleotides.

| Wave ID | 2.0 nM | 8.2 nM | 33 nM |
|---|---|---|---|
| Control | .95 | 1.07 | 1.12 |
| WV-1868 | 1.18 | 1.07 | .85 |
| WV-3381 | .48 | .11 | .18 |
| WV-3382 | .99 | .33 | .18 |
| WV-3383 | 1.02 | .55 | .31 |
| WV-3384 | 1.16 | .42 | .13 |
| WV-3385 | 1.03 | .42 | .18 |
| WV-3386 | .57 | .22 | .23 |
| WV-3387 | .23 | .08 | .11 |
| WV-3388 | 1.08 | .95 | 1.03 |
| WV-3389 | 1.07 | 1.15 | .79 |
| WV-3390 | .63 | .25 | .05 |
| WV-3391 | .46 | .18 | .14 |
| WV-3392 | .42 | .13 | .08 |
| WV-3393 | .33 | .11 | .05 |
| WV-3394 | .46 | .20 | .10 |

Table 76. Tables 76A and B show the in vitro potency of ASOs to PNPLA3. Tested oligonucleotides are: Table 76A, WV-1868, and WV-3395 to WV-3408; Table 76B, WV-1868, and WV-3409 to WV-3422.

TABLE 76A

Activity of oligonucleotides.

| Wave ID | 2.0 nM | 8.2 nM | 33 nM |
|---|---|---|---|
| Control | .96 | 1.07 | 1.12 |
| WV-1868 | 1.18 | 1.06 | .85 |
| WV-3395 | .33 | .28 | .33 |
| WV-3396 | 1.02 | .51 | .23 |
| WV-3397 | .83 | .37 | .14 |
| WV-3398 | 1.07 | .22 | .06 |
| WV-3399 | .4 | .22 | .26 |

TABLE 76A-continued

Activity of oligonucleotides.

| Wave ID | 2.0 nM | 8.2 nM | 33 nM |
|---|---|---|---|
| WV-3400 | .87 | .52 | .18 |
| WV-3401 | 1.09 | .43 | .12 |
| WV-3402 | .37 | .12 | .06 |
| WV-3403 | 1.2 | 1.08 | .92 |
| WV-3404 | .29 | .15 | .25 |
| WV-3405 | .86 | .33 | .21 |
| WV-3406 | 1.18 | 1.26 | 1.14 |
| WV-3407 | .95 | .56 | .23 |
| WV-3408 | .31 | .15 | .21 |

TABLE 76B

Activity of oligonucleotides.

| Wave ID | 2.0 nM | 8.2 nM | 33 nM |
|---|---|---|---|
| Control | .96 | 1.07 | 1.12 |
| WV-1868 | 1.17 | 1.06 | .85 |
| WV-3409 | .6 | .31 | .45 |
| WV-3410 | .89 | .23 | .19 |
| WV-3411 | .63 | .12 | .07 |
| WV-3412 | .87 | .34 | .08 |
| WV-3413 | .85 | .31 | .05 |
| WV-3414 | 1.07 | .75 | .32 |
| WV-3415 | 1.02 | .25 | .44 |
| WV-3416 | .55 | .28 | .25 |
| WV-3417 | .68 | .23 | .31 |
| WV-3418 | .55 | .15 | .28 |
| WV-3419 | .81 | .63 | .38 |
| WV-3420 | 1.12 | .87 | .27 |
| WV-3421 | .48 | .17 | .23 |
| WV-3422 | 1.01 | .6 | .38 |

Table 77. Table 77 shows the in vitro potency of ASOs to PNPLA3. Tested oligonucleotides are: WV-1868, and WV-3423 to WV-3436.

TABLE 77

Activity of oligonucleotides.

| Wave ID | 2.0 nM | 8.2 nM | 33 nM |
|---|---|---|---|
| Control | 1.05 | 1.15 | 1.03 |
| WV-1868 | 1.07 | 1.07 | 1.03 |
| WV-3423 | .62 | .42 | .3 |
| WV-3424 | .69 | .4 | .2 |
| WV-3425 | 1.02 | .68 | .35 |
| WV-3426 | .92 | .46 | .37 |
| WV-3427 | .87 | .74 | .6 |
| WV-3428 | 1.08 | .88 | .97 |
| WV-3429 | 1.02 | .6 | .37 |
| WV-3430 | 1.13 | .94 | .48 |
| WV-3431 | .63 | .38 | .23 |
| WV-3432 | .97 | .63 | .31 |
| WV-3433 | .63 | .26 | .18 |
| WV-3434 | .81 | .31 | .2 |
| WV-3435 | .58 | .33 | .28 |
| WV-3436 | .93 | .71 | .5 |

Table 78. Table 78 shows the in vitro potency of ASOs to PNPLA3. Tested oligonucleotides are: WV-1868, and WV-3437 to WV-3450.

TABLE 78

Activity of oligonucleotides.

| Wave ID | 2.0 nM | 8.2 nM | 33 nM |
|---|---|---|---|
| Control | 1.05 | 1.15 | 1.03 |
| WV-1868 | 1.06 | 1.06 | 1.03 |
| WV-3437 | 1.06 | .54 | .22 |
| WV-3438 | .93 | .85 | 1 |
| WV-3439 | 1.01 | .75 | .56 |
| WV-3440 | 1.04 | 1.03 | .67 |
| WV-3441 | 1.16 | .8 | .38 |
| WV-3442 | 1.03 | .57 | .29 |
| WV-3443 | .45 | .25 | .2 |
| WV-3444 | .65 | .38 | .23 |
| WV-3445 | 1.18 | .78 | .42 |
| WV-3446 | .8 | .45 | .25 |
| WV-3447 | .86 | .59 | .25 |
| WV-3448 | .81 | .52 | .22 |
| WV-3449 | .74 | .43 | .2 |
| WV-3450 | .96 | .95 | .92 |

Table 79. Table 79 shows the efficacy of antisense oligonucleotides in knockdown of PNPLA3 mediated by RNase H, in a Hep3B 24 hour assay. Tested oligonucleotides are: WV-1868 (control), WV-3451, WV-3452, WV-3453, WV-3454, WV-3455, WV-3456, WV-3457, WV-3458, WV-3459, WV-3460, WV-3461, and WV-3462. WV-1868 is an antisense oligonucleotide (operating through RNase H-mediated knockdown), while other tested oligonucleotides are RNAi agents.

TABLE 79

Activity of oligonucleotides.

| Wave ID | 2.0 nM | 8.2 nM | 33 nM |
|---|---|---|---|
| Control | 1.05 | 1.15 | 1.04 |
| WV-1868 | 1.06 | 1.06 | 1.02 |
| WV-3451 | .97 | .55 | .24 |
| WV-3452 | 1.01 | .52 | .18 |
| WV-3453 | .43 | .19 | .19 |
| WV-3454 | .51 | .22 | .1 |
| WV-3455 | .62 | .35 | .18 |
| WV-3456 | .78 | .52 | .22 |
| WV-3457 | .74 | .37 | .11 |
| WV-3458 | .64 | .28 | .22 |
| WV-3459 | 1.15 | 1.09 | .9 |
| WV-3460 | .77 | .4 | .43 |
| WV-3461 | 1.13 | .54 | .23 |
| WV-3462 | .93 | .42 | .2 |

Table 81. Table 81 shows the in vitro potency and $IC_{50}$ for different oligonucleotides which target PNPLA3. Tested oligonucleotides are: WV-2477 (which knocks down the target via a RNA interference-mediated mechanism) and WV-3387 (which knocks down the target via RNase H-mediated knockdown).

TABLE 81

Activity of oligonucleotides.

| Conc. (nM) (exp 10) | WV-2477-Hep3b | | WV-2447-Huh7 | | WV-3387-Hep3b | | WV-3387-Huh7 | |
|---|---|---|---|---|---|---|---|---|
| 0.796 | 1.031 | | | 1.029 | 0.928 | 0.148 | 0.095 | 0.154 | 0.186 |
| 0.495 | | 0.982 | | | 0.884 | 0.143 | 0.092 | 0.163 | 0.218 |
| 0.194 | 1.144 | 0.989 | 1.103 | 0.994 | 0.221 | 0.162 | 0.183 | |
| -0.107 | 1.068 | 1.201 | 1.259 | 1.008 | 0.273 | 0.254 | 0.321 | 0.361 |
| -0.408 | 1.193 | 1.075 | 0.947 | 1.111 | 0.350 | 0.385 | 0.515 | 0.490 |
| -0.709 | 1.113 | 1.003 | | 0.974 | 0.560 | 0.534 | 0.537 | 0.708 |
| -1.010 | 1.193 | 1.010 | 0.866 | 0.902 | 0.644 | 0.704 | 0.652 | 0.974 |
| -1.612 | | 0.989 | 1.044 | 1.051 | 0.861 | 0.820 | 1.029 | 0.825 |
| -2.214 | 1.185 | 0.976 | 0.954 | 1.051 | 0.929 | 0.956 | 0.947 | 0.866 |

| | IC50 (nM) | 95% CI |
|---|---|---|
| WV-2477-Hep3b | NA | — |
| WV-2477-Huh7 | NA | — |
| WV-3387-Hep3b | 0.205 | 0.16 to 0.254 |
| WV-3387-Huh7 | 0.311 | 0.186 to 0.602 |

Table 82. Table 82 shows the efficacy of antisense oligonucleotides in knockdown of PNPLA3 mediated by RNase H, in a Hep3B assay. Tested oligonucleotides are: WV-3380 (positive control), WV-3387, WV-3391, WV-3393, WV-3402, WV-3411, WV-3416, WV-3443, and WV-3454.

TABLE 82

Activity of oligonucleotides.

| Wave ID | IC50 (nM) |
|---|---|
| WV-3380 | 4.28 |
| WV-3387 | 1.29 |
| WV-3391 | 2.31 |
| WV-3393 | 2.21 |
| WV-3402 | 1.55 |
| WV-3411 | 5.32 |
| WV-3416 | 4.68 |
| WV-3443 | 1.22 |
| WV-3454 | 3.39 |

Table 83. Table 83 shows the IC50 of ASOs to PNPLA3 in Huh7 cells. Tested oligonucleotides are: WV-3380, WV-3387, WV-3391, WV-3393, WV-3402, WV-3411, WV-3416, WV-3443, and WV-3454.

TABLE 83

Activity of oligonucleotides.

| Wave ID | HEP3B IC50 (nM) | Huh7 IC50 (nM) |
|---|---|---|
| WV-3380 | 4.28 | 3.86 |
| WV-3387 | 1.29 | 1.91 |
| WV-3391 | 2.31 | 2.96 |
| WV-3393 | 2.21 | 5.5 |
| WV-3402 | 1.55 | 2.85 |
| WV-3411 | 5.32 | 8.27 |
| WV-3416 | 4.68 | 9.0 |
| WV-3443 | 1.22 | 2.55 |
| WV-3454 | 3.39 | 4.30 |

Table 84. Table 84 shows the in vitro potency of ASOs to PNPLA3. Tested oligonucleotides are: WV-3380, WV-3393, WV-3402, WV-3421, WV-3390, WV-3399, WV-3404, WV-3443, WV-3391, WV-3394, WV-3408, WV-3387, and WV-3381.

TABLE 84

IC50 of oligonucleotides.

| Wave ID | IC 50 nM |
|---|---|
| WV-3380 | 1.5 |
| WV-3393 | 1.1 |
| WV-3402 | 1.7 |
| WV-3421 | 1.4 |

TABLE 84-continued

IC50 of oligonucleotides.

| Wave ID | IC 50 nM |
|---|---|
| WV-3399 | 0.77 |
| WV-3404 | 1.6 |
| WV-3443 | 1.6 |
| WV-3391 | 0.65 |
| WV-3394 | 1.4 |
| WV-3408 | 0.92 |
| WV-3387 | 1.2 |
| WV-3381 | 1.4 |

Table 85. Table 85 shows the IC50 of ASOs to PNPLA3. Tested oligonucleotides are: WV-3380, WV-3381, WV-3387, WV-3391, WV-3393, WV-3394, WV-3399, WV-3402, WV-3404, WV-3408, WV-3421, and WV-3443. Oligonucleotides had various sequences, and were in the coding segment (CDS) or 3' untranslated region (3'UTR) of PNPLA3.

TABLE 85

IC50 of oligonucleotides.

| Wave ID | IC 50 nM | Position |
|---|---|---|
| WV-3380 | 1.5 | CDS |
| WV-3393 | 1.1 | CDS |
| WV-3402 | 1.7 | CDS |
| WV-3421 | 1.4 | 3'UTR |
| WV-3399 | 0.77 | 3'UTR |
| WV-3404 | 1.6 | 3'UTR |
| WV-3443 | 1.6 | 3'UTR |
| WV-3391 | 0.65 | 3'UTR |
| WV-3394 | 1.4 | 3'UTR |
| WV-3408 | 0.92 | 3'UTR |
| WV-3387 | 1.2 | 3'UTR |
| WV-3381 | 1.4 | 3'UTR |

Table 86. Table 86 shows the in vitro potency of ASOs to PNPLA3. Tested oligonucleotides are: WV-3421, WV-3393, WV-3380, and WV-3402. In the data shown in Tables 86 and 87, oligonucleotides with human sequences were tested in cyno cells. Ovals indicate a mismatch, wherein the oligo sequence matches the human sequence, but has a mismatch with the cyno sequence. Numbers represent relative PNPLA3 mRNA levels (PNPLA3/GAPDH). 1.0 would represent 100% mRNA level or 0% knockdown, and 0.0 would represent 0.0% mRNA level or 100% knockdown. Numbers are approximate, and error bars are not included. Cynomolgus monkey cells were treated in vitro.

TABLE 86

Activity of oligonucleotides.

| | Oligonucleotide | | | | |
|---|---|---|---|---|---|
| | 0 nM | 0.01 nM | 1 nM | 8 nM | 25 nM |
| WV-3421 | .99 | .78 | .52 | .18 | .12 |
| WV-3380 | 1.01 | 1.12 | .99 | .55 | .29 |
| WV-3393 | .99 | 1.02 | .94 | .48 | .37 |
| WV-3402 | .96 | 1.01 | .82 | .56 | .39 |

Table 87. Table 87 shows the in vitro potency of ASOs to PNPLA3. Tested oligonucleotides are: WV-3404, WV-3399, WV-3443, and WV-3421.
Numbers represent relative PNPLA3 mRNA levels (PNPLA3/GAPDH). 1.0 would represent 100% mRNA level or 0% knockdown, and 0.0 would represent 0.0% mRNA level or 100% knockdown. Numbers are approximate, and error bars are not included. Cynomolgus monkey cells were treated in vitro.

TABLE 87

Activity of oligonucleotides.

| Oligonucleotide | 0 nM | 0.01 nM | 1 nM | 8 nM | 25 nM |
|---|---|---|---|---|---|
| WV-3404 | 1.01 | .95 | .81 | .33 | .36 |
| WV-3443 | 1.01 | 1.07 | 1.14 | .52 | .39 |
| WV-3399 | 1.04 | .97 | .83 | .84 | .80 |

While not wishing to be bound by any particular theory, the present disclosure notes that further experiments also provided additional data supporting the conclusions that various putative single-stranded RNAi agents were, in fact, capable of mediating RNA interference; and that various oligonucleotides designed to be capable of mediating knockdown via a RNaseH-mediated mechanism in fact mediated knockdown via a RNaseH-mediated mechanism. The finding that an oligonucleotide to a different target directed knockdown via a RNaseH-mediated mechanism supports the idea that another oligonucleotide of the same or a similar format but which has a PNPLA3 and is capable of knocking down PNPLA3 may likely do so also via a RNaseH-mediated mechanism.

In one experiment, an in vitro RNase H assay was performed, with APOC3 oligonucleotide WV-1868 (ASO, mediating a RNase H knockdown mechanism of APOC3) as a positive control, and APOC3 oligonucleotide WV-2110 (a single-stranded RNAi agent) as a negative control. RNA molecule WV-2372 is used as a test substrate. In the RNase H assay, dual mechanism APOC3 oligonucleotide WV-2111 mediated RNase H knockdown (data not shown).

In another experiment, an in vitro Ago-2 assay (for single-stranded RNA interference) was performed. This assay was performed with single-stranded RNAi agents to another gene, APOC3, but which have formats which are similar or identical to various formats described for PNPLA3 oligonucleotides. The finding that an oligonucleotide to a different target directed RNA interference supports the idea that another oligonucleotide of the same or a similar format but which has a PNPLA3 and is capable of knocking down PNPLA3 may likely do so also via directed RNA interference.

A RNA test substrate was WV-2372 (APOC3). In the results, the band representing the RNA test substrate is absent in the presence of APOC3 oligonucleotides WV-1308 and WV-2420, indicating that these oligonucleotides are single-stranded RNAi agents capable of mediating RNA interference. Various controls were used: Substrate in the absence of negative control ASO WV-2134; substrate in the presence of negative control ASO WV-2134, which does not mediate RNA interference; substrate in the absence of test oligonucleotide WV-1308; substrate in the absence of test oligonucleotide WV-2420; substrate alone; no substrate, with added WV-2134; and no substrate, with added WV-1308 (data not shown).

In another experiment, in vitro Ago-2 assay was (for single-stranded RNA interference) performed, using a APOC3 mRNA as a test substrate in a 3' RACE assay in Hep3B cells. A cleavage product of the APOC3 mRNA in the presence of test oligonucleotide WV-3021 was detected, corresponding to cleavage of the mRNA at a site corresponding to a cut between positions 10 and 11 of WV-3021

(data not shown), which result is consistent with RNA interference. An artifactual cleavage product was also detected.

In other experiments, dual mechanism (hybrid format) APOC3 oligonucleotide WV-2111 was shown to be capable of mediating knockdown by both RNase H and RNA interference. A RNA substrate for WV-2111, which comprises the sequence of GCUGGCCUCC-CAAUAAAGCUGGACA (SEQ ID NO: 3938), which is complementary to the sequence of APOC3 oligonucleotide WV-2111, was found to be cleaved in the presence of WV-2111 at the following positions: GC/UGGC/C/U/CC/CAAUA//AAGCUGGACA (SEQ ID NO: 3938), wherein / indicates a cleavage site in a position typical of RNaseH activity, and // indicates a cleavage site in a position typical of Ago-2 (RNA interference) activity. These data support the idea that WV-2111 mediates knockdown via both RNaseH and RNA interference mechanisms.

Several oligonucleotides were also found to be capable of mediating RNA interference in an Ago-2 in vitro assay. A RNA test substrate was APOC3 oligonucleotide WV-2372; this substrate disappeared in the presence of APOC3 oligonucleotides WV-1308, WV-2114, WV-2386, or WV-2387 (each tested separately), indicating that each of these oligonucleotides is capable of acting as single-stranded RNAi agents mediating RNA interference.

While not wishing to be bound by any particular theory, the present disclosure suggests that at least some of the oligonucleotides designated herein as single-stranded RNAi agents mediate knockdown via a RISC (RNA interference silencing complex); however, in at least some experiments, oligonucleotides designated herein as single-stranded RNAi agents were capable of mediating an observed knockdown of the protein level of a target greater than the observed knockdown of the corresponding mRNA level, and, while not wishing to be bound by any particular theory, the present disclosure suggests that this observation is consistent with the conjecture that some oligonucleotides designated herein as single-stranded RNAi agents which are capable of knocking down of a target gene or protein may be able to do so via a RISC-mediated mechanism and/or steric hindrance.

The present disclosure presents many non-limiting examples of oligonucleotides, having any of various sequences, formats, modifications, 5'-end regions, seed regions, post-seed regions, and 3'-end regions, and which are capable of mediating single-stranded RNA interference (e.g., single-stranded RNAi agents).

Figure 3A:
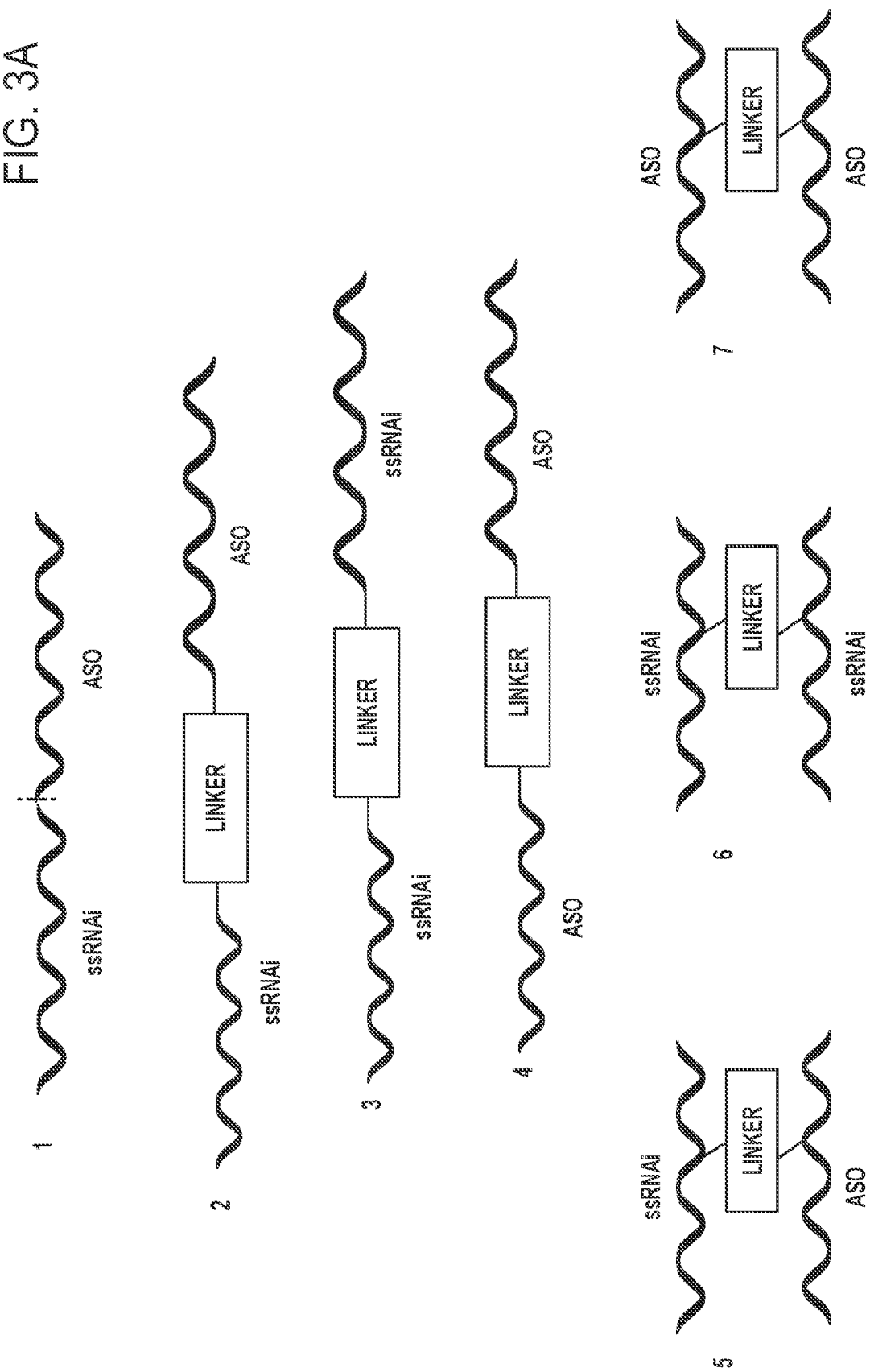
Figure 3B:
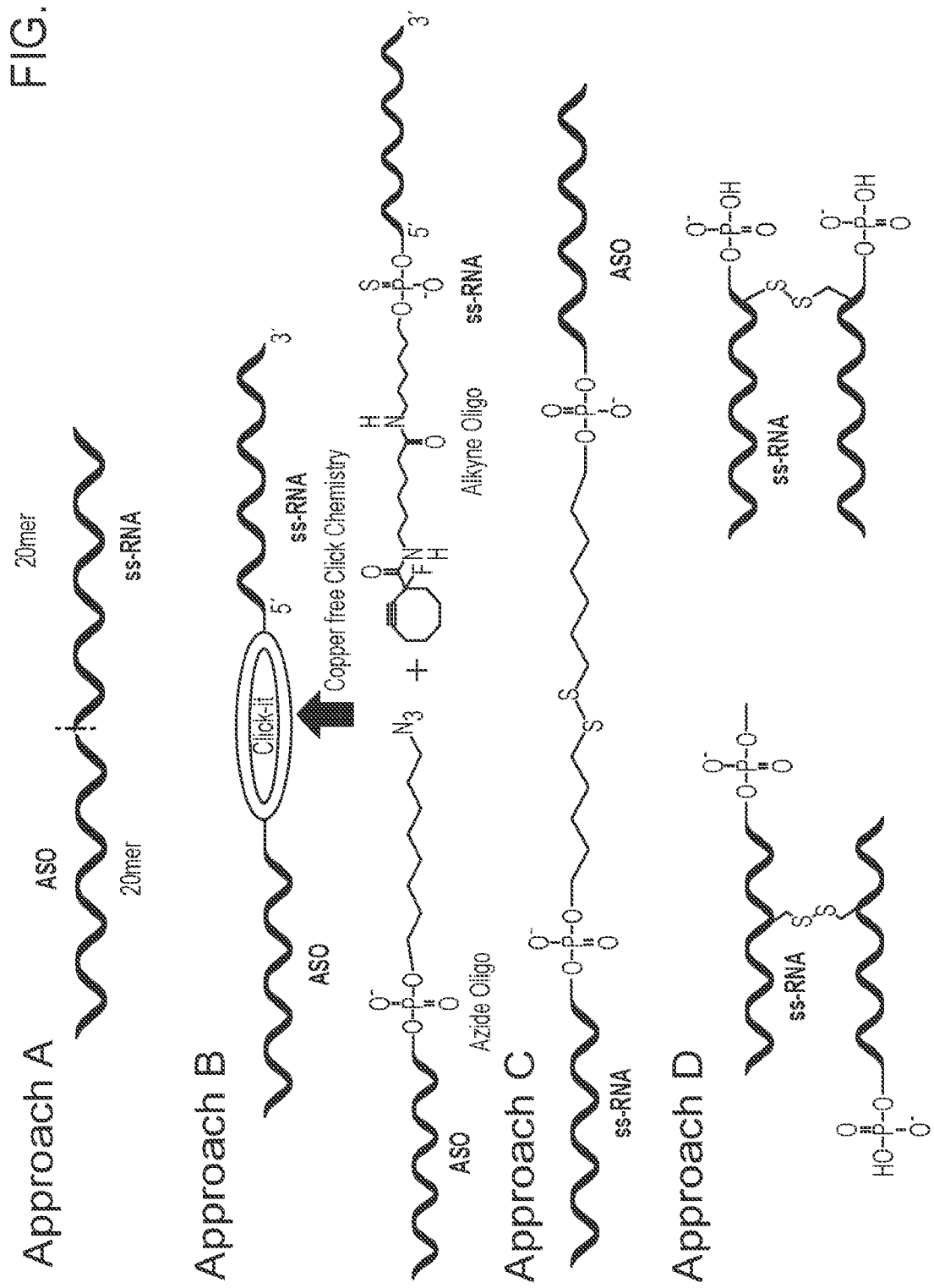
FIG. 3B shows example chemistry approaches for joining monomers, which monomers may perform their functions through various pathways, to form multimers.

FIG. 3. FIGS. 3A and 3B show example multimer formats. Oligonucleotides can be joined directly and/or through linkers. As illustrated, a multimer can comprise oligonucleotide monomers of the same or different structures/types. In some embodiments, a monomer of a multimer is an ssRNAi agent. In some embodiments, a monomer of a multimer is a RNase H-dependent antisense oligonucleotide (ASO). Monomers can be joined through various positions, for example, the 5'-end, the 3'-end, or positions in between.

Shown directly below is a phosphoramidite useful for linking oligonucleotide monomers through formation of disulfide linkers. After incorporation into oligonucleotide monomers, a thioester can be hydrolyzed to release a free thiol, which can react with a thiol of another oligonucleotide monomer to form a disulfide bond, thereby linking oligonucleotide monomers together. Multiple thiol groups may be incorporated into oligonucleotides so that multimers of various numbers of monomers may be formed.

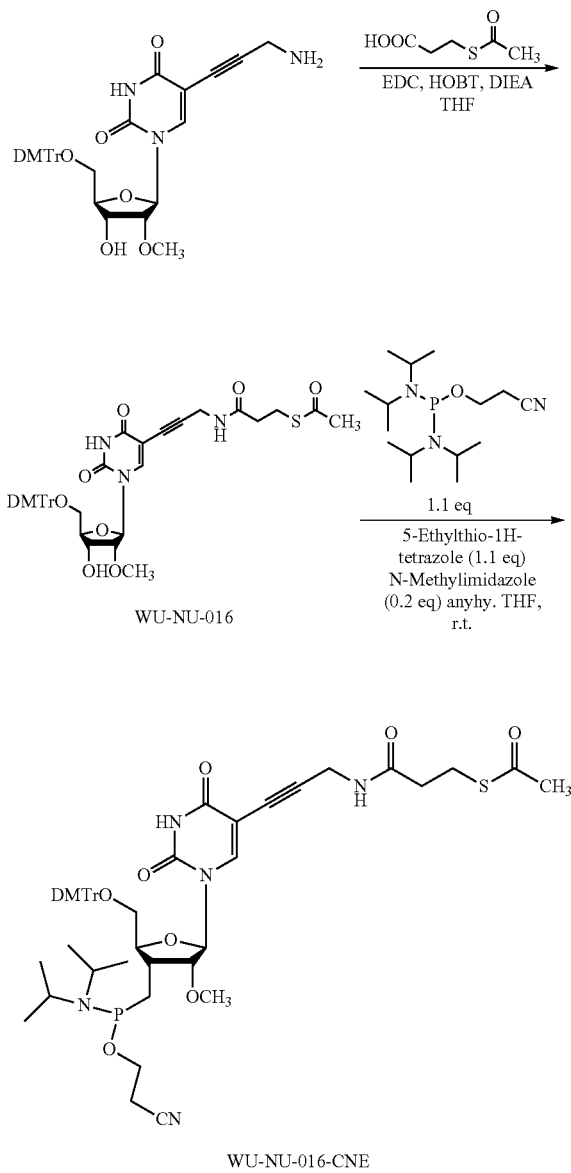

WU-NU-016

WU-NU-016-CNE

Table 90 shows in vitro allele-specific suppression of different oligonucleotides which target PNPLA3. Example oligonucleotides are completely complementary to target sequences of one allele, which target sequences comprise one or two SNP sites. One SNP site is associated with I148M change in protein sequence. Oligonucleotides comprising target-binding sequences that are completely complementary to target sequences comprising both SNPs were assessed in Hep3B cells (wild-type, C and C, I148) and Huh7 cells (with double mutation, T and G, M148). The double mutation was tested at various positions (8 and 11; 9 and 12; 10 and 13; etc.) and with various modifications to identify oligonucleotides capable of allele-specific knockdown of PNPLA3.

As shown in Table 90B, WV-7778 to WV-7793 and WV-3858 to WV-3864 were tested. In these oligonucleotides, the first and the last internucleotidic linkages in the wings are stereorandom PS and the others are PO; the 5' wing and the 3' wing comprise 2'-OMe. Several oligonucleotides demonstrated allele-specific knockdown of PNPLA3.

TABLE 90B

Activity of oligonucleotides.

|  | Hep3B | | Huh7 | |
|---|---|---|---|---|
| mock | 100 | 100 | 100 | 100 |
| WV-7778 | 92.8 | 86.9 | 63.6 | 52.7 |
| WV-7779 | 92.6 | 85.8 | 59.2 | 48.0 |
| WV-7780 | 102.3 | 97.1 | 36.4 | 34.8 |
| WV-7781 | 111.8 | 102.4 | 46.1 | 38.9 |
| WV-7782 | 108.5 | 94.7 | 43.3 | 35.0 |
| WV-7783 | 110.2 | 97.5 | 36.6 | 33.7 |
| WV-7784 | 105.0 | 95.9 | 41.2 | 41.9 |
| WV-7785 | 108.7 | 107.4 | 73.8 | 57.5 |
| WV-3858 | 103.3 | 103.6 | 55.1 | 52.3 |
| WV-3859 | 94.7 | 96.1 | 41.8 | 41.2 |
| WV-3860 | 104.2 | 94.1 | 46.7 | 45.6 |
| WV-3861 | 101.8 | 99.2 | 47.1 | 45.2 |
| WV-3862 | 97.1 | 96.5 | 44.0 | 42.3 |
| WV-3863 | 99.7 | 86.0 | 42.0 | 51.5 |
| WV-3864 | 97.8 | 96.8 | 53.5 | 38.9 |
| WV-7786 | 99.1 | 104.3 | 37.0 | 38.0 |
| WV-7787 | 84.2 | 87.5 | 23.0 | 25.1 |
| WV-7788 | 80.4 | 88.0 | 35.5 | 28.5 |
| WV-7789 | 82.7 | 85.7 | 25.4 | 25.5 |
| WV-7790 | 80.8 | 85.1 | 27.4 | 29.8 |
| WV-7791 | 87.1 | 80.1 | 40.8 | 42.1 |
| WV-7792 | 78.1 | 73.1 | 42.5 | 46.5 |
| WV-7793 | 68.3 | 65.1 | 49.9 | 44.9 |

As shown in Table 90C, WV-7794 to WV-7816 were tested. In these oligonucleotides, the first and the last internucleotidic linkages in the wings are stereorandom PS and the others are PO; the 5' wing and the 3' wing comprise 2'-MOE. Several oligonucleotides demonstrated allele-specific knockdown of PNPLA3.

TABLE 90C

Activity of oligonucleotides.

|  | Hep3B | | Huh7 | |
|---|---|---|---|---|
| mock | 100 | 100 | 100 | 100 |
| WV-7794 | 47.6 | 44.5 | 25.0 | 20.6 |
| WV-7795 | 58.5 | 52.8 | 14.3 | 14.8 |
| WV-7796 | 54.6 | 56.4 | 16.3 | 15.5 |
| WV-7797 | 75.1 | 74.2 | 13.5 | 12.8 |
| WV-7798 | 78.4 | 79.8 | 11.9 | 13.7 |
| WV-7799 | 89.9 | 92.4 | 23.5 | 25.7 |
| WV-7800 | 93.6 | 92.2 | 34.1 | 29.9 |
| WV-7801 | 90.3 | 90.3 | 38.4 | 29.3 |
| WV-7802 | 101.1 | 101.3 | 25.1 | 29.6 |
| WV-7803 | 102.0 | 103.2 | 24.8 | 25.8 |
| WV-7804 | 95.9 | 97.2 | 27.8 | 32.7 |
| WV-7805 | 100.5 | 95.5 | 21.9 | 22.0 |
| WV-7806 | 110.6 | 105.4 | 22.0 | 21.2 |
| WV-7807 | 96.2 | 101.5 | 21.1 | 23.8 |
| WV-7808 | 95.5 | 101.0 | 21.5 | 18.8 |
| WV-7809 | 85.3 | 84.2 | 17.1 | 15.7 |
| WV-7810 | 92.0 | 95.9 | 25.2 | 21.6 |
| WV-7811 | 100.1 | 100.0 | 26.6 | 27.1 |
| WV-7812 | 79.5 | 82.1 | 22.3 | 21.1 |
| WV-7813 | 83.7 | 76.2 | 23.7 | 18.2 |
| WV-7814 | 87.8 | 82.8 | 44.3 | 39.2 |
| WV-7815 | 78.1 | 74.8 | 45.3 | 37.1 |
| WV-7816 | 59.5 | 52.4 | 24.5 | 20.5 |

As shown in Table 90D, WV-7817 to WV-7839 were tested. In these oligonucleotides, the first and the last nucleotide are LNA; the 5' wing has a LNA at the 5' end of the oligonucleotide followed by several 2'-OMe; and the 3' wing has several 2'-OMe followed by a LNA at the 3' end of the oligonucleotide. Several oligonucleotides demonstrated allele-specific knockdown of PNPLA3.

TABLE 90D

Activity of oligonucleotides.

|  | Hep3B | | Huh7 | |
|---|---|---|---|---|
| mock | 100 | 100 | 100 | 100 |
| WV-7817 | 71.4 | 60.1 | 34.0 | 30.2 |
| WV-7818 | 68.1 | 75.8 | 44.0 | 30.0 |
| WV-7819 | 68.5 | 76.6 | 20.7 | 20.7 |
| WV-7820 | 87.7 | 86.0 | 24.0 | 22.4 |
| WV-7821 | 90.1 | 89.3 | 17.7 | 15.3 |
| WV-7822 | 101.2 | 87.2 | 19.6 | 11.7 |
| WV-7823 | 83.3 | 87.7 | 22.9 | 17.8 |
| WV-7824 | 99.0 | 101.9 | 31.1 | 31.6 |
| WV-7825 | 94.0 | 89.5 | 28.7 | 22.6 |
| WV-7826 | 95.6 | 87.5 | 21.2 | 17.6 |
| WV-7827 | 113.3 | 104.4 | 22.1 | 19.3 |
| WV-7828 | 108.1 | 102.8 | 25.7 | 23.6 |
| WV-7829 | 99.8 | 97.9 | 20.5 | 21.7 |
| WV-7830 | 95.9 | 87.8 | 18.5 | 19.2 |
| WV-7831 | 89.8 | 89.2 | 21.3 | 23.4 |
| WV-7832 | 76.2 | 71.7 | 9.4 | 11.8 |
| WV-7833 | 68.2 | 76.8 | 14.1 | 10.4 |
| WV-7834 | 69.5 | 71.2 | 17.4 | 16.5 |
| WV-7835 | 69.6 | 68.7 | 11.0 | 9.4 |
| WV-7836 | 59.8 | 67.8 | 18.3 | 21.0 |
| WV-7837 | 60.8 | 63.7 | 25.6 | 28.4 |
| WV-7838 | 48.2 | 50.5 | 16.8 | 13.5 |
| WV-7839 | 35.0 | 39.1 | 10.5 | 11.8 |

As shown in Table 90E, WV-7840 to WV-7862 were tested. In these oligonucleotides, the first and the last nucleotide are LNA; the 5' wing has a LNA at the 5' end of the oligonucleotide followed by several 2'-MOE; and the 3' wing has several 2'-MOE (or 5-methyl 2'-MOE) followed by a LNA at the 3' end of the oligonucleotide. Several oligonucleotides demonstrated allele-specific knockdown of PNPLA3.

TABLE 90E

Activity of oligonucleotides.

|  | Hep3B | | Huh7 | |
|---|---|---|---|---|
| mock | 100 | 100 | 100 | 100 |
| WV-7840 | 32.7 | 37.7 | 12.8 | 14.8 |
| WV-7841 | 45.9 | 49.8 | 8.1 | 10.6 |
| WV-7842 | 43.2 | 50.4 | 7.6 | 7.0 |
| WV-7843 | 53.7 | 61.0 | 8.7 | 10.6 |
| WV-7844 | 69.2 | 69.0 | 14.3 | 14.9 |
| WV-7845 | 80.8 | 83.7 | 15.0 | 13.7 |
| WV-7846 | 77.1 | 86.3 | 16.5 | 15.7 |
| WV-7847 | 85.2 | 96.4 | 18.5 | 15.6 |
| WV-7848 | 87.2 | 89.4 | 21.7 | 18.0 |
| WV-7849 | 65.0 | 74.2 | 17.2 | 16.7 |
| WV-7850 | 98.8 | 107.4 | 15.3 | 18.7 |
| WV-7851 | 105.0 | 95.8 | 11.4 | 15.9 |
| WV-7852 | 113.7 | 86.9 | 14.2 | 14.2 |
| WV-7853 | 108.5 | 90.7 | 10.1 | 14.3 |
| WV-7854 | 109.6 | 94.9 | 11.3 | 12.4 |
| WV-7855 | 81.9 | 82.8 | 7.4 | 5.4 |
| WV-7856 | 86.3 | 82.0 | 11.5 | 11.2 |
| WV-7857 | 95.3 | 78.1 | 14.6 | 15.6 |
| WV-7858 | 63.0 | 66.3 | 8.6 | 9.8 |
| WV-7859 | 65.4 | 61.5 | 12.9 | 15.9 |
| WV-7860 | 69.4 | 70.0 | 30.4 | 34.2 |
| WV-7861 | 51.9 | 49.0 | 14.8 | 26.8 |
| WV-7862 | 37.4 | 41.3 | 10.4 | 11.2 |

As shown in Table 90F, WV-993, WV-3390, and WV-4054 were tested.

TABLE 90F

Activity of oligonucleotides.

|  | Hep3B | | Huh7 | |
|---|---|---|---|---|
| mock | 100.0 | 100.0 | 100.0 | 100.0 |
| UT (untreated) | 92.4 | 98.7 | 93.1 | 107.0 |
| WV-993 10 nM | 108.0 | 117.8 | 115.8 | 137.6 |
| WV-3390 2 nM | 84.5 | 84.1 | 46.5 | 57.6 |
| WV-3390 10 nM | 50.0 | 53.9 | 15.7 | 24.4 |
| WV-4054 2 nM | 95.8 | 95.1 | 30.0 | 35.7 |
| WV-4054 10 nM | 85.5 | 91.8 | 30.2 | 37.5 |

As shown in Table 90G, WV-3860 to WV-3864 were tested. Oligonucleotides had mismatches (between wildtype and mutant alleles) at positions 8 and 11 (WV-3860); 9 and 12 (WV-3861); 10 and 13 (WV-3862); 11 and 14 (WV-3863); and 12 and 15 (WV-3864). Several oligonucleotides demonstrated allele-specific knockdown of PNPLA3, particularly at a concentration of 8 nM.

TABLE 90G

Activity of oligonucleotides.

| nM | WV-3860 Hep3B | | WV-3861 Hep3B | | WV-3862 Hep3B | | WV-3863 Hep3B | |
|---|---|---|---|---|---|---|---|---|
| 50 | 37.7 | 44.4 | 44.3 | 47.7 | 21.9 | 32.3 | 32.0 | 32.8 |
| 20 | 83.9 | 89.7 | 87.7 | 93.9 | 64.7 | 72.1 | 81.7 | 87.3 |
| 8 | 95.8 | 95.4 | 101.9 | 103.4 | 90.8 | 92.0 | 84.3 | 93.9 |
| 3.2 | 105.9 | 93.0 | 94.3 | 90.7 | 98.1 | 98.3 | 88.3 | 86.8 |
| 1.28 | 100.9 | 93.4 | 81.0 | 95.4 | 91.0 | 92.7 | 90.9 | 87.4 |
| 0.512 | 90.5 | 96.6 | 94.9 | 88.3 | 92.5 | 93.3 | 87.1 | 88.7 |
| 0.205 | 110.1 | 99.0 | 93.2 | 95.4 | 95.7 | 89.5 | 89.7 | 92.5 |
| 0.082 | 96.6 | 95.6 | 94.8 | 96.2 | 95.3 | 97.8 | 86.7 | 93.9 |
| 0.033 | 98.5 | 88.1 | 98.0 | 95.3 | 103.7 | 93.2 | 93.3 | 87.8 |
| 0.013 | 97.1 | 95.6 | 91.1 | 92.4 | 100.9 | 90.9 | 91.7 | 90.9 |

| nM | WV-3864 Hep3B | | WV-3860 Huh7 | | WV-3861 Huh7 | | WV-3862 Huh7 | |
|---|---|---|---|---|---|---|---|---|
| 50 | 31.8 | 43.9 | 11.4 | 9.3 | 12.4 | 8.4 | 6.8 | 8.4 |
| 20 | 98.4 | 99.4 | 23.7 | 25.9 | 25.9 | 24.4 | 16.8 | 14.0 |
| 8 | 100.7 | 107.4 | 47.9 | 51.3 | 46.0 | 44.0 | 40.7 | 42.6 |
| 3.2 | 94.9 | 102.7 | 84.1 | 67.6 | 63.7 | 68.7 | 56.9 | 77.6 |
| 1.28 | 96.3 | 95.6 | 100.5 | 83.9 | 80.4 | 83.7 | 77.3 | 81.0 |
| 0.512 | 89.7 | 102.4 | 100.5 | 97.3 | 85.9 | 87.5 | 78.0 | 85.6 |
| 0.205 | 96.3 | 93.8 | 101.6 | 99.9 | 83.7 | 76.6 | 73.4 | 85.7 |
| 0.082 | 89.5 | 92.1 | 81.4 | 87.3 | 85.3 | 84.1 | 78.9 | 89.3 |
| 0.033 | 92.7 | 94.2 | 114.4 | 90.6 | 100.4 | 87.6 | 87.5 | 84.6 |
| 0.013 | 91.7 | 106.0 | 107.0 | 93.7 | 82.3 | 88.1 | 78.3 | 91.6 |

| nM | WV-3863 Huh7 | | WV-3864 Huh7 | |
|---|---|---|---|---|
| 50 | 5.6 | 10.6 | 8.4 | 8.3 |
| 20 | 20.0 | 13.4 | 16.5 | 13.9 |
| 8 | 37.4 | 40.8 | 47.9 | 43.3 |
| 3.2 | 67.5 | 60.5 | 75.6 | 65.5 |
| 1.28 | 84.9 | 82.5 | 86.2 | 87.0 |
| 0.512 | 79.4 | 81.1 | 95.6 | 91.0 |
| 0.205 | 83.0 | 86.3 | 89.1 | 96.1 |
| 0.082 | 79.5 | 92.5 | 89.4 | 77.9 |
| 0.033 | 79.7 | 102.1 | 104.6 | 86.4 |
| 0.013 | 94.6 | 96.8 | 93.0 | 104.9 |

As shown in Table 90H, WV-7804 to WV-7808 were tested. Oligonucleotides had mismatches at positions 8 and 11 (WV-7804); 9 and 12 (WV-7805); 10 and 13 (WV-7806); 11 and 14 (WV-7807); and 12 and 15 (WV-7808). Some oligonucleotides demonstrated allele-specific knockdown of PNPLA3, particularly at concentrations of 3.2 and 8 nM.

TABLE 90H

Activity of oligonucleotides.

| nM | WV-7804 Hep3B | | WV-7805 Hep3B | | WV-7806 Hep3B | | WV-7807 Hep3B | |
|---|---|---|---|---|---|---|---|---|
| 50 | 63.3 | 69.5 | 60.3 | 62.7 | 69.6 | 65.1 | 75.0 | 75.5 |
| 20 | 84.6 | 98.4 | 81.8 | 86.1 | 90.1 | 89.4 | 95.3 | 95.4 |
| 8 | 101.1 | 102.9 | 96.9 | 98.5 | 100.8 | 94.7 | 101.2 | 95.5 |
| 3.2 | 92.9 | 95.1 | 90.7 | 98.1 | 98.9 | 92.1 | 88.8 | |
| 1.28 | 95.5 | 98.6 | 91.3 | 97.0 | 95.9 | 90.9 | 97.3 | 103.6 |
| 0.512 | 96.2 | 110.4 | 95.5 | 97.9 | 95.9 | 94.8 | 100.9 | 92.7 |
| 0.205 | 92.0 | 99.5 | 90.5 | 100.7 | 99.3 | 94.7 | 96.4 | 99.8 |
| 0.082 | 97.6 | 93.6 | 92.2 | 107.6 | 92.3 | 93.8 | 93.4 | 103.7 |
| 0.033 | 98.4 | 101.4 | 98.5 | 104.0 | 99.6 | 90.1 | 89.2 | 93.3 |
| 0.013 | 96.7 | 100.4 | 95.0 | 105.8 | 90.1 | 97.5 | 90.6 | 87.5 |

| nM | WV-7808 Hep3B | WV-7804 Huh7 | | WV-7805 Huh7 | | WV-7806 Huh7 | |
|---|---|---|---|---|---|---|---|
| 50 | 72.2 | 4.4 | 7.5 | 1.7 | 8.4 | 9.8 | 3.8 |
| 20 | 98.9 | 3.5 | 11.1 | 7.1 | 11.9 | 2.8 | 7.2 |
| 8 | 117.8 | 25.1 | 23.3 | 19.6 | 11.6 | 13.8 | 12.5 |
| 3.2 | 109.5 | 45.3 | 48.0 | 36.1 | 38.4 | 28.8 | 39.7 |
| 1.28 | 116.3 | 68.9 | 77.1 | 59.2 | 76.2 | 68.7 | 68.5 |
| 0.512 | 110.9 | 74.6 | 76.0 | 75.3 | 78.4 | 66.6 | 82.4 |
| 0.205 | 109.3 | 73.6 | 86.5 | 69.8 | 81.1 | 69.7 | 80.3 |
| 0.082 | 116.8 | 82.9 | 89.4 | 75.0 | 86.9 | 78.6 | 79.7 |
| 0.033 | 111.1 | 81.8 | 96.1 | 78.0 | 95.8 | 89.4 | 87.3 |
| 0.013 | 104.6 | 86.7 | 90.4 | 79.6 | 95.0 | 88.6 | 98.0 |

| nM | WV-7807 Huh7 | | WV-7808 Huh7 | |
|---|---|---|---|---|
| 50 | 3.0 | 3.9 | 1.8 | 1.4 |
| 20 | 12.6 | 9.1 | 1.9 | 5.2 |
| 8 | 25.1 | 14.9 | 14.2 | 9.1 |
| 3.2 | 46.9 | 41.5 | 37.1 | 33.2 |
| 1.28 | 78.0 | 70.4 | 63.6 | 65.2 |
| 0.512 | 85.3 | 73.7 | 71.0 | 77.4 |
| 0.205 | 98.8 | 68.5 | 79.2 | 92.3 |
| 0.082 | 92.6 | 75.3 | 88.0 | 71.2 |
| 0.033 | 85.6 | 81.9 | 84.1 | 83.5 |
| 0.013 | 85.5 | 94.7 | 95.3 | 78.1 |

As shown in Table 90I, WV-7827 to WV-7831 were tested. Oligonucleotides had mismatches at positions 8 and 11 (WV-7827); 9 and 12 (WV-7828); 10 and 13 (WV-7829); 11 and 14 (WV-7830); and 12 and 15 (WV-7831). Several oligonucleotides demonstrated allele-specific knockdown of PNPLA3, particularly at concentrations of 3.2 and 8 nM.

TABLE 90I

Activity of oligonucleotides.

| nM | WV-7827 | Hep3B | WV-7828 | Hep3B | WV-7829 | Hep3B | WV-7830 | Hep3B |
|---|---|---|---|---|---|---|---|---|
| 50 | 37.01 | 34.29 | 36.95 | 32.75 | 25.05 | 33.48 | 36.76 | 54.22 |
| 20 | 79.06 | 85.05 | 85.88 | 77.16 | 82.21 | 79.79 | 79.33 | 87.62 |
| 8 | 97.28 | 89.87 | 93.46 | 91.76 | 99.65 | 98.83 | 97.94 | 97.83 |
| 3.2 | 94.15 | 89.12 | 97.63 | 90.63 | 92.57 | 92.37 |  | 104.59 |
| 1.28 | 97.02 | 95.4 | 94.2 | 88.81 | 93.55 | 94.13 | 100.19 | 113.12 |
| 0.512 | 105.31 | 93.06 | 97.26 | 96.7 | 95.81 | 104.04 | 107.33 | 109.89 |
| 0.205 | 107.16 | 97.39 | 92 | 91.65 | 103.76 | 102.33 | 104.56 | 100.78 |
| 0.082 | 100.92 | 101.71 | 94.43 | 88.97 | 93.95 | 105.59 | 94.95 | 110.09 |
| 0.033 | 98.82 | 95.76 | 92.83 | 92.84 | 91.46 | 103.11 | 97.7 | 93.54 |
| 0.013 | 96.78 | 93.38 | 92.91 | 90.28 | 86.25 | 104.33 | 96.73 | 98.6 |

| nM | WV-7831 | Hep3B | WV-7827 | Huh7 | WV-7828 | Huh7 | WV-7829 | Huh7 |
|---|---|---|---|---|---|---|---|---|
| 50 | 53.44 | 62.49 | 3.75 | 3.01 | 2.29 | 1.48 | 5.61 | 7.19 |
| 20 | 97.35 | 92.9 | 6.33 | 5.79 | 16.31 | 9.08 | 16.41 | 9.26 |
| 8 | 103.88 | 103.69 | 13.45 | 13.44 | 9.77 | 24.96 | 31.07 | 18.62 |
| 3.2 | 104.8 | 99.48 | 34.11 | 44.07 | 31.43 | 31.51 | 54.15 | 31.49 |
| 1.28 | 99.77 | 102.88 | 57.91 | 67.23 | 63.32 | 69.34 | 78.28 | 65.69 |
| 0.512 | 102.56 | 99.81 | 80.58 | 87.32 | 83.18 | 75.78 | 94.09 | 75.96 |
| 0.205 | 111.83 | 98.89 | 71.87 | 84.73 | 74.94 | 76.52 | 87.05 | 90.6 |
| 0.082 | 102.02 | 93.55 | 74.43 | 76.07 | 82.31 | 87.03 | 97.43 | 87.48 |
| 0.033 | 93.54 | 101.84 | 77.64 | 80.62 | 89.1 | 89.96 | 108.41 | 81.93 |
| 0.013 | 101.47 | 100.78 | 77.47 | 74.02 | 83.14 | 79.83 | 100.58 | 88.97 |

| nM | WV-7830 Huh7 | | WV-7831 Huh7 | |
|---|---|---|---|---|
| 50 | 4.11 | 5.5 | 3.5 | 5.45 |
| 20 | 6.32 | 5.86 | 5.62 | 10.22 |
| 8 | 12.5 | 16.99 | 15.15 | 23.97 |
| 3.2 | 35.34 | 40.2 | 35 | 40.3 |
| 1.28 | 56.82 | 76.27 | 73.64 | 73.96 |
| 0.512 | 86.38 | 77.53 | 83.87 | 88.08 |
| 0.205 | 80.08 | 79.81 | 85.02 | 86.98 |
| 0.082 | 95.69 | 98.61 | 82.31 | 111.77 |
| 0.033 | 86.65 | 93.2 | 85.86 | 85.82 |
| 0.013 | 94.2 | 85.75 | 81.84 | 93.28 |

As shown in Table 90J, WV-993 (negative control), WV-3390 (positive control), WV-4054, WV-7850 to WV-7854 were tested. The oligonucleotides had mismatches at positions 8 and 11 (WV-7850); 9 and 12 (WV-7851); 10 and 13 (WV-7852); 11 and 14 (WV-7853); and 12 and 15 (WV-7854). Several oligonucleotides demonstrated high allele-specific knockdown of PNPLA3, particularly at concentrations of 3.2 and 8 nM.

TABLE 90J

Activity of oligonucleotides.

| nM | WV-7850 | Hep3B | WV-7851 | Hep3B | WV-7852 | Hep3B | WV-7853 | Hep3B |
|---|---|---|---|---|---|---|---|---|
| 50 | 38.95 | 43.11 | 38.2 | 54.32 | 34.89 | 44.6 | 28.33 | 29.79 |
| 20 | 65.77 | 72.48 | 80.99 | 84.09 | 69.74 | 74.87 | 66.38 | 50.49 |
| 8 | 92.95 | 82.91 | 93.58 | 96.06 | 89.54 | 101.29 | 85.15 | 81.31 |
| 3.2 | 91.26 | 86.61 | 90.46 | 94.37 | 97.29 | 91.77 |  | 96.08 |
| 1.28 | 111.06 | 94.39 | 98.64 | 92.99 | 89.98 | 111.31 | 96.26 | 97.11 |
| 0.512 | 106.14 | 87.28 | 94.61 | 94.09 | 96.79 | 95.82 | 109.19 | 105.33 |
| 0.205 | 84.62 | 87.72 | 100.09 | 99.5 | 111.54 | 99.81 | 95.06 | 94.02 |
| 0.082 | 97.3 | 89.13 | 90.19 | 87.13 | 92.11 | 100.64 | 95.93 | 104.77 |
| 0.033 | 88.83 | 89.09 | 96.09 | 101.92 | 96.1 | 95.83 | 95.56 | 95.83 |
| 0.013 | 91.98 | 92.51 | 100.59 | 92.81 | 98.94 | 109.53 | 99.05 | 97.36 |

| nM | WV-7854 | Hep3B | WV-7850 | Huh7 | WV-7851 | Huh7 | WV-7852 | Huh7 |
|---|---|---|---|---|---|---|---|---|
| 50 | 16.7 | 18.84 | 2.74 | 4.3 | 2.13 | 1.26 | 8.39 | 7.43 |
| 20 | 63.04 | 59.9 | 5.33 | 5.88 | 6.09 | 4.64 | 7.76 | 5.84 |
| 8 | 82.27 | 80.67 | 11.67 | 9.74 | 1.12 | 14.86 | 9.96 | 10.6 |
| 3.2 | 92.77 | 89.43 | 25.14 | 13.84 | 31.45 | 25.89 | 28.6 | 25.4 |
| 1.28 | 90.63 | 83.96 | 57.25 | 62.49 | 55.19 | 52.3 | 49.96 | 56.13 |
| 0.512 | 88.27 | 86.56 | 75.21 | 73.3 | 81.73 | 81.67 | 72.77 | 87.64 |
| 0.205 | 89.69 | 88.92 | 71.16 | 74.28 | 91.84 | 94.95 | 82.61 | 85.11 |
| 0.082 | 95.16 | 89.43 | 84.71 | 75.77 | 91 | 79.62 | 96.22 | 83.67 |
| 0.033 | 99.41 | 94.3 | 80.67 | 93.66 | 84.27 | 79.5 | 72.16 | 70.12 |
| 0.013 | 88 | 96.49 | 96.84 | 104.2 | 86.94 | 81.37 | 94.13 | 88.49 |

TABLE 90J-continued

Activity of oligonucleotides.

| nM | WV-7853 Huh7 | | WV-7854 Huh7 | |
| --- | --- | --- | --- | --- |
| 50 | 2.91 | 3.83 | 0.56 | 5.35 |
| 20 | 5.38 | 4.3 | 2.43 | 7.48 |
| 8 | 6.36 | 8.51 | 9.91 | 10.31 |
| 3.2 | 27.05 | 23.79 | 23.52 | 22.24 |
| 1.28 | 47.78 | 62.17 | 47.66 | 45.94 |
| 0.512 | 70.13 | 93.78 | 76.63 | 66.5 |
| 0.205 | 96.01 | 74.6 | 84.06 | 72.69 |
| 0.082 | 82.68 | 90.37 | 79.33 | 82.72 |
| 0.033 | 89.38 | 93.35 | 89.39 | 83.68 |
| 0.013 | 86.29 | 95.77 | 98.79 | 96.55 |

As shown in Table 90K and 90L, WV-3860 to WV-3864, WV-7804 to WV-7808, WV-7827 to WV-7831, and WV-7850 to WV-7854 were tested. WV-4054 demonstrated high allele-specific activity.

TABLE 90K

Activity of oligonucleotides.

| nM | WV-3390 Hep3B | | WV-3390 Huh7 | |
| --- | --- | --- | --- | --- |
| 50 | 8.21 | 7.25 | 8.29 | 8.93 |
| 20 | 6.38 | 7.65 | 8.38 | 6.55 |
| 8 | 12.25 | 18.67 | 14.29 | 10.45 |
| 3.2 | 45.11 | 53.94 | 44.3 | 57.9 |
| 1.28 | 77.33 | 87.7 | 75.75 | 79.58 |
| 0.512 | 89.66 | 91.59 | 75.55 | 114.48 |
| 0.205 | 88.47 | 99.01 | 77.44 | 93.14 |
| 0.082 | 90.52 | 101.67 | 81.19 | 91 |
| 0.033 | 100.47 | 102.34 | 78.08 | 106.05 |
| 0.013 | 111.98 | 101.98 | 93.49 | 92.23 |
| nM | WV-4054 Hep3B | | WV-4054 Huh7 | |
| 8 | 77.1 | 75.46 | 25.4 | 28.99 |
| 3.2 | 64.83 | 77.36 | 19.76 | 30.45 |
| 1.28 | 75.7 | 80.58 | 20.26 | 28 |
| 0.512 | 83.19 | 91.18 | 27.99 | 30.12 |
| 0.205 | 96.79 | 100.8 | 48.79 | 51.24 |
| 0.082 | 96.97 | 105.15 | 51.71 | 65.92 |
| 0.033 | 98.21 | 96.76 | 82.73 | 90.69 |
| 0.013 | 100.71 | 110.73 | 89.25 | 101.52 |
| nM | WV-993 Hep3B | | WV-993 Huh7 | |
| 50 | 46.96 | 63.05 | 64.33 | 84.69 |
| 20 | 85.99 | 93.33 | 85.91 | 92.58 |

TABLE 90K-continued

Activity of oligonucleotides.

| 8 | 94.55 | 112.34 | 108.31 | 90.19 |
| --- | --- | --- | --- | --- |
| 3.2 | 94.42 | 101.21 | 98.4 | 102.07 |
| 1.28 | 90.96 | 98.52 | 104.92 | 108.34 |
| 0.512 | 87.71 | 95.84 | 96.98 | 87.06 |
| 0.205 | 91.78 | 93.62 | 114.92 | 90.64 |
| 0.082 | 86.49 | 96.33 | 109.17 | 101.77 |
| 0.033 | 87.45 | 104.34 | 102.65 | 92.43 |
| 0.013 | 90.55 | 100.97 | 114.84 | 108.07 |

TABLE 90L

IC50 of various oligonucleotides in Huh7 cells (mutant allele).

| Mismatch Positions | Oligonucleotides | $IC_{50}$ (nM) | Oligonucleotides | $IC_{50}$ (nM) |
| --- | --- | --- | --- | --- |
| | 2'OMe | | 2'MOE | |
| 8, 11 | WV-3860 | 10.6 | WV-7804 | 4.0 |
| 9, 12 | WV-3861 | 10.4 | WV-7805 | 3.0 |
| 10, 13 | WV-3862 | 10.6 | WV-7806 | 2.6 |
| 11, 14 | WV-3863 | 7.8 | WV-7807 | 4.0 |
| 12, 15 | WV-3864 | 9.5 | WV-7808 | 2.9 |
| Positions | 2'MOE LNA | (nM) | 2'OMe LNA | (nM) |
| 8, 11 | WV-7850 | 1.6 | WV-7827 | 3.8 |
| 9, 12 | WV-7851 | 2.2 | WV-7828 | 2.8 |
| 10, 13 | WV-7852 | 1.9 | WV-7829 | 3.0 |
| 11, 14 | WV-7853 | 1.8 | WV-7830 | 2.6 |
| 12, 15 | WV-7854 | 1.3 | WV-7831 | 3.3 |

TABLE 91

Activity of oligonucleotides.
PNPLA3 mRNA level
(PNPLA3/HPRT1)

| Conc (nM) exp 10 | 1.477 | 1.079 | 0.681 | 0.283 | -0.114 | -0.512 | -0.910 | -1.308 |
| --- | --- | --- | --- | --- | --- | --- | --- | --- |
| WV-7808 | 0.200 | 0.366 | 0.424 | 0.576 | 0.803 | 0.910 | 1.217 | 1.131 |
| | 0.081 | 0.221 | 0.374 | 0.613 | 0.987 | 1.050 | 1.314 | 1.080 |
| WV-8690 | 0.199 | 0.388 | 0.503 | 0.808 | 0.897 | 1.000 | 1.148 | 1.068 |
| | 0.208 | 0.313 | 0.754 | 0.932 | 1.058 | 1.236 | 1.286 | 1.138 |
| WV-8858 | 0.233 | 0.446 | 0.595 | 0.838 | 0.911 | 0.916 | 0.965 | 1.213 |
| | 0.240 | 0.340 | 0.727 | 1.036 | 1.039 | 1.403 | 0.874 | |
| WV-8859 | 0.086 | 0.292 | 0.279 | 0.710 | 0.850 | 1.071 | 0.956 | 1.091 |
| | 0.083 | 0.217 | 0.505 | 0.754 | 0.981 | 1.258 | 1.131 | 1.454 |
| WV-8860 | 0.234 | 0.386 | 0.385 | 0.751 | 0.867 | 0.947 | 1.358 | 1.057 |
| | 0.162 | 0.321 | 0.503 | 1.002 | 1.100 | 1.075 | 1.250 | 1.241 |

TABLE 92

Activity of oligonucleotides.

|  | 1.477 | 1.079 | 0.681 | 0.283 | −0.115 | −0.513 | −0.911 | −1.308 |
|---|---|---|---|---|---|---|---|---|
| WV-7807 | 0.102 | 0.331 | 0.588 | 0.790 | 1.037 | 0.989 | 1.271 | 1.147 |
| WV-8854 | 0.137 | 0.397 | 0.453 | 0.814 | 1.160 | 1.099 | 1.257 | 1.027 |
| WV-8855 | 0.117 | 0.375 | 0.678 | 0.831 | 0.962 | 1.021 | 1.258 | 1.277 |
|  | 0.112 | 0.363 | 0.559 | 0.793 | 1.134 | 1.237 | 1.226 | 1.186 |
| WV-8856 | 0.174 | 0.553 | 0.745 | 0.873 | 0.890 | 0.968 | 0.954 | 1.088 |
|  | 0.181 | 0.462 | 0.690 | 0.737 | 1.102 | 1.168 | 0.930 | 1.006 |
| WV-8857 | 0.055 | 0.239 | 0.496 | 0.779 | 0.815 | 0.937 | 1.029 | 1.027 |
|  | 0.069 | 0.288 | 0.654 | 0.884 | 1.172 | 1.146 | 0.937 | 1.222 |
|  | 0.237 | 0.445 | 0.967 | 0.928 | 0.976 | 0.790 | 0.992 | 1.119 |
|  | 0.188 | 0.504 | 0.783 | 0.932 | 1.031 | 1.046 | 1.086 | 1.067 |

TABLE 93

Activity of oligonucleotides.

|  | 1.477 | 1.079 | 0.681 | 0.283 | −0.114 | −0.512 | −0.910 | −1.308 |
|---|---|---|---|---|---|---|---|---|
| WV-7806 | 0.15 | 0.24 | 0.29 | 0.71 | 0.92 | 1.03 | 1.02 | 1.10 |
| WV-8850 | 0.14 | 0.16 | 0.30 | 0.56 | 0.67 | 0.84 | 1.02 | 0.89 |
| WV-8851 | 0.57 | 0.61 | 0.59 | 1.09 | 1.08 | 1.04 | 1.11 | 1.29 |
|  | 0.44 | 0.52 | 0.60 | 0.65 | 0.81 | 0.76 | 0.96 | 0.93 |
| WV-8852 | 0.18 | 0.41 | 0.43 | 0.95 | 0.93 | 1.00 | 1.08 | 1.05 |
|  | 0.17 | 0.27 | 0.63 | 0.71 | 0.70 | 1.01 | 0.90 | 0.85 |
| WV-8853 | 0.55 | 0.29 | 0.32 | 0.83 | 1.04 | 1.23 | 0.90 | 1.28 |
|  | 0.14 | 0.18 | 0.26 | 0.49 | 0.77 | 0.83 | 1.09 | 0.92 |
|  | 0.21 | 0.38 | 0.41 | 0.76 | 1.24 | 0.92 | 1.08 | 0.93 |
|  | 0.13 | 0.20 | 0.44 | 0.61 | 0.94 | 0.64 | 0.87 | 0.95 |

TABLE 94

Activity of oligonucleotides.

|  | 1.477 | 1.079 | 0.681 | 0.283 | −0.114 | −0.512 | −0.910 | −1.308 |
|---|---|---|---|---|---|---|---|---|
| WV-7805 | 0.29 | 0.33 | 0.44 | 0.72 | 0.95 | 0.96 | 0.93 | 0.99 |
| WV-8609 | 0.15 | 0.27 | 0.41 | 0.73 | 1.12 | 1.19 | 0.78 | 0.87 |
| WV-8847 | 0.33 | 0.37 | 0.48 | 0.90 | 0.84 | 0.81 | 1.02 | 1.04 |
|  | 0.13 | 0.29 | 0.56 | 0.76 | 0.89 | 1.15 | 1.07 | 0.91 |
| WV-8848 | 0.24 | 0.37 | 0.58 | 0.78 | 0.89 | 1.20 | 0.91 | 0.97 |
|  | 0.14 | 0.23 | 0.64 | 0.79 | 0.90 | 1.16 | 0.94 | 1.19 |
| WV-8849 | 0.19 | 0.32 | 0.47 | 0.69 | 0.93 | 0.88 | 0.92 | 0.92 |
|  | 0.19 | 0.16 | 0.46 | 0.74 | 0.88 | 0.79 | 1.03 | 1.09 |
|  | 0.24 | 0.39 | 0.55 | 0.79 | 1.17 | 0.97 | 1.16 | 0.95 |
|  | 0.28 | 0.29 | 0.54 | 0.82 | 1.05 | 1.13 | 1.17 | 1.05 |

TABLE 95

|  | 1.477 | 1.079 | 0.681 | 0.283 | −0.114 | −0.512 | −0.910 | −1.308 |
|---|---|---|---|---|---|---|---|---|
| WV-7804 | 0.29 | 0.37 | 0.51 | 0.81 | 0.85 | 1.16 | 0.87 | 0.89 |
| WV-8843 | 0.19 | 0.22 | 0.47 | 0.82 | 0.85 | 0.94 | 1.05 | 1.06 |
| WV-8844 | 0.53 | 0.72 | 0.62 | 1.00 | 0.98 | 0.85 | 0.92 | 0.98 |
|  | 0.45 | 0.51 | 0.61 | 0.93 | 0.93 | 1.01 | 0.90 | 1.01 |
| WV-8845 | 0.25 | 0.44 | 0.58 | 0.78 | 0.71 | 0.86 | 0.86 | 1.00 |
|  | 0.22 | 0.21 | 0.48 | 0.76 | 1.02 | 1.06 | 0.74 | 1.16 |
| WV-8846 | 0.23 | 0.42 | 0.52 | 0.82 | 0.99 | 0.87 | 0.77 | 1.11 |
|  | 0.17 | 0.25 | 0.44 | 0.76 | 0.90 | 0.97 | 0.99 | 0.88 |
|  | 0.20 | 0.38 | 0.55 | 0.60 | 0.90 | 0.76 | 0.88 | 0.98 |
|  | 0.17 | 0.25 | 0.39 | 0.71 | 1.11 | 0.92 | 0.83 | 1.04 |

TABLE 98

Activity of oligonucleotides.
10 nM.

|  | Hep3B | | Huh7 | |
|---|---|---|---|---|
| mock | 100 | 100 | 100 | 100 |
| WV-7794 | 47.6 | 44.5 | 25.0 | 20.6 |
| WV-7795 | 58.5 | 52.8 | 14.3 | 14.8 |
| WV-7796 | 54.6 | 56.4 | 16.3 | 15.5 |
| WV-7797 | 75.1 | 74.2 | 13.5 | 12.8 |
| WV-7798 | 78.4 | 79.8 | 11.9 | 13.7 |
| WV-7799 | 89.9 | 92.4 | 23.5 | 25.7 |
| WV-7800 | 93.6 | 92.2 | 34.1 | 29.9 |
| WV-7801 | 90.3 | 90.3 | 38.4 | 29.3 |
| WV-7802 | 101.1 | 101.3 | 25.1 | 29.6 |
| WV-7803 | 102.0 | 103.2 | 24.8 | 25.8 |
| WV-7804 | 95.9 | 97.2 | 27.8 | 32.7 |
| WV-7805 | 100.5 | 95.5 | 21.9 | 22.0 |
| WV-7806 | 110.6 | 105.4 | 22.0 | 21.2 |
| WV-7807 | 96.2 | 101.5 | 21.1 | 23.8 |
| WV-7808 | 95.5 | 101.0 | 21.5 | 18.8 |
| WV-7809 | 85.3 | 84.2 | 17.1 | 15.7 |
| WV-7810 | 92.0 | 95.9 | 25.2 | 21.6 |
| WV-7811 | 100.1 | 100.0 | 26.6 | 27.1 |
| WV-7812 | 79.5 | 82.1 | 22.3 | 21.1 |
| WV-7813 | 83.7 | 76.2 | 23.7 | 18.2 |
| WV-7814 | 87.8 | 82.8 | 44.3 | 39.2 |
| WV-7815 | 78.1 | 74.8 | 45.3 | 37.1 |
| WV-7816 | 59.5 | 52.4 | 24.5 | 20.5 |

TABLE 99

Activity of oligonucleotides.
10 nM.

|  | Hep3B | | Huh7 | |
|---|---|---|---|---|
| mock | 100 | 100 | 100 | 100 |
| WV-7778 | 92.8 | 86.9 | 63.6 | 52.7 |
| WV-7779 | 92.6 | 85.8 | 59.2 | 48.0 |
| WV-7780 | 102.3 | 97.1 | 36.4 | 34.8 |
| WV-7781 | 111.8 | 102.4 | 46.1 | 38.9 |
| WV-7782 | 108.5 | 94.7 | 43.3 | 35.0 |
| WV-7783 | 110.2 | 97.5 | 36.6 | 33.7 |
| WV-7784 | 105.0 | 95.9 | 41.2 | 41.9 |
| WV-7785 | 108.7 | 107.4 | 73.8 | 57.5 |
| WV-3858 | 103.3 | 103.6 | 55.1 | 52.3 |
| WV-3859 | 94.7 | 96.1 | 41.8 | 41.2 |
| WV-3860 | 104.2 | 94.1 | 46.7 | 45.6 |
| WV-3861 | 101.8 | 99.2 | 47.1 | 45.2 |
| WV-3862 | 97.1 | 96.5 | 44.0 | 42.3 |
| WV-3863 | 99.7 | 86.0 | 42.0 | 51.5 |
| WV-3864 | 97.8 | 96.8 | 53.5 | 38.9 |
| WV-7786 | 99.1 | 104.3 | 37.0 | 38.0 |
| WV-7787 | 84.2 | 87.5 | 23.0 | 25.1 |
| WV-7788 | 80.4 | 88.0 | 35.5 | 28.5 |
| WV-7789 | 82.7 | 85.7 | 25.4 | 25.5 |
| WV-7790 | 80.8 | 85.1 | 27.4 | 29.8 |
| WV-7791 | 87.1 | 80.1 | 40.8 | 42.1 |
| WV-7792 | 78.1 | 73.1 | 42.5 | 46.5 |
| WV-7793 | 68.3 | 65.1 | 49.9 | 44.9 |

TABLE 100

Activity of oligonucleotides.
% mRNA remaining
(RhPNPLA3/hSFRS9)
Monkey hepatocytes at 48 hrs.

|  | 10 nM | | 3 nM | | 1 nM | |
|---|---|---|---|---|---|---|
| Mock | 100 | 100 | 100 | 100 | 100 | 100 |
| WV-3421 | 28.7 | 35.4 | 44.6 | 31.8 | 61.3 | 53.8 |
| WV-7794 | 64.1 | 74.4 | 104.3 | 96.2 | 115.5 | 121.3 |
| WV-7795 | 80.8 | 88.4 | 130.2 | 115.9 | 109.0 | 130.0 |
| WV-7796 | 51.3 | 53.4 | 83.8 | 95.5 | 106.9 | 103.3 |
| WV-7797 | 51.4 | 48.5 | 97.3 | 81.4 | 115.1 | 126.7 |
| WV-7798 | 65.2 | 56.8 | 84.8 | 86.8 | 106.8 | 104.0 |
| WV-7799 | 96.5 | 102.5 | 104.7 | 117.6 | 108.9 | 129.6 |
| WV-7800 | 66.1 | 78.8 | 113.3 | 111.3 | 114.9 | 128.1 |
| WV-7801 | 113.1 | 117.7 | 116.0 | 112.7 | 113.3 | 118.5 |
| WV-7802 | 101.6 | 110.7 | 105.8 | 120.3 | 113.3 | 123.9 |
| WV-7803 | 52.5 | 59.6 | 73.6 | 79.4 | 106.5 | 129.4 |
| WV-7804 | 95.5 | 91.3 | 111.3 | 137.4 | 116.5 | 122.1 |
| WV-7805 | 84.7 | 97.8 | 111.7 | 111.1 | 114.3 | 118.7 |
| WV-7806 | 91.2 | 87.2 | 129.7 | 121.3 | 124.8 | 121.8 |
| WV-7807 | 64.5 | 89.2 | 108.5 | 119.7 | 108.6 | 123.7 |
| WV-7808 | 39.4 | 48.1 | 94.7 | 105.8 | 105.1 | 125.5 |
| WV-7809 | 46.5 | 36.8 | 77.0 | 64.9 | 85.1 | 101.2 |
| WV-7810 | 46.7 | 46.5 | 62.1 | 78.5 | 75.8 | 94.7 |
| WV-7811 | 70.4 | 78.7 | 88.2 | 84.0 | 101.1 | 96.6 |
| WV-7812 | 47.2 | 53.3 | 74.5 | 80.7 | 97.7 | 77.8 |
| WV-7813 | 43.0 | 38.3 | 76.5 | 71.2 | 97.0 | 89.7 |
| WV-7814 | 49.8 | 51.2 | 102.8 | 96.1 | 105.9 | 131.8 |
| WV-7815 | 56.0 | 52.5 | 88.3 | 83.8 | 83.4 | 94.9 |
| WV-7816 | 29.3 | 19.7 | 51.5 | 57.5 | 84.4 | 68.4 |

TABLE 101

Activity of oligonucleotides.
PNPLA3 mRNA Level
(PNPLA3/GAPDH)

|  | 0.12 nM | 0.4 nM | 1.1. nM |
|---|---|---|---|
| WV-993 | 99.8 | 77.9 | 74.5 |
| WV-3421 | 74.9 | 44.6 | 24.0 |
| WV-7805 | 105.4 | 99.2 | 83.8 |
| WV-9890 | 108.6 | 78.4 | 78.3 |
| WV-12100 | 104.6 | 102.7 | 93.2 |
| WV-9893 | 93.7 | 103.8 | 79.8 |
| WV-12101 | 124.1 | 67.6 | 36.6 |

TABLE 102A

Activity of oligonucleotides.
Primary cyno hepatocytes.

| Conc. (nM) | WV-9893 | WV-3421 | | WV-1 | L2101 |
|---|---|---|---|---|---|
| 1.079181 | 116.7 | 90.2 | 13.6 | 6.5 | 20.1 | 27.6 |
| 0.681241 | 135.5 | 98.9 | 13.9 | 5.4 | 20.1 |  |
| 0.283301 | 86.5 | 126.1 | 32.9 | 23.7 | 11.0 | 37.7 |
| −0.11464 | 105.3 | 108.9 | 70.7 | 46.7 | 40.7 |  |
| −0.51258 | 121.9 | 114.1 | 89.3 | 81.5 | 70.0 | 97.1 |
| −0.91052 | 112.7 | 137.8 | 124.2 | 113.7 | 81.7 | 114.1 |
| −1.30846 | 116.0 | 110.1 | 134.7 | 80.5 | 81.0 | 72.6 |
| −1.7064 | 120.5 | 106.7 | 105.7 | 140.0 | 82.5 | 77.1 |
| −2.10434 | 120.5 | 108.0 | 131.0 | 95.2 | 98.4 | 88.2 |
| −2.50228 | 94.8 | 99.6 | 89.2 | 85.4 | 106.7 | 89.7 |

The Tm of various oligonucleotides was measured while in duplex with a RNA which was completely complementary, or which was completely complementary except for two mismatches (representing the mutant allele). Conditions used were: 1 µM Duplex in 1×PBS (pH 7.2); Temperature Range: 15° C.-90° C.; Temperature Rate: 0.5° C./min; Measurement Interval: 0.5° C.

TABLE 102B

Tm of oligonucleotides.

| ASO | Length | Duplex Tm (° C.) WV-12420 Full match | Duplex Tm(° C.) WV-12421 Two mismatches | Δ difference Full match vs two mismatches |
|---|---|---|---|---|
| WV-7805 | 20-mer | 63.52 | 47.62 | 15.9 |
| WV-9891 | 20-mer | 61.62 | 44.77 | 16.9 |
| WV-9890 | 20-mer | 61.57 | 46.67 | 14.9 |
| WV-9893 | 20-mer | 58.67 | 43.52 | 15.2 |
| WV-12106 | 24-mer | 71.52 | 59.72 | 11.8 |
| WV-12107 | 24-mer | 69.57 | 57.77 | 11.8 |
| WV-12100 | 24-mer | 70.77 | 59.57 | 11.2 |
| WV-12101 | 24-mer | 67.52 | 56.62 | 10.9 |

The Tm of various oligonucleotides was measured while in duplex with a RNA which was completely complementary, or which was completely complementary except for two mismatches (representing the mutant allele). Conditions used were: 1 µM Duplex in 1X PBS (pH 7.2); Temperature Range: 15° C.-90° C.; Temperature Rate: 0.5° C./min; Measurement Interval: 0.5° C.

TABLE 103

Activity of oligonucleotides.
Huh7 cells.

| Conc. (nM) | 1 | 0.52288 | 0.04576 | −0.4314 | −0.9085 | −1.3856 | −1.8627 |
|---|---|---|---|---|---|---|---|
| WV-7805 | 7.0 | 23.5 | 64.7 | 80.4 | 88.2 | 92.5 | 99.5 |
|  | 5.1 | 24.7 | 78.9 | 74.1 | 86.7 |  |  |
| WV-9890 | 1.6 | 35.0 |  | 90.4 | 90.3 | 92.6 | 104.6 |
|  | 13.1 | 29.2 | 73.7 | 88.5 | 87.1 | 95.8 | 105.5 |
| WV-12100 | 12.4 | 33.8 | 63.6 | 90.6 |  | 102.3 | 101.5 |
|  | 10.2 | 27.6 | 76.6 | 80.0 | 83.6 | 80.7 | 85.0 |
| WV-9893 | 10.4 | 28.7 | 74.3 | 86.3 | 87.7 | 116.1 | 93.8 |
|  | 4.3 | 36.4 | 80.4 | 91.5 | 110.3 | 108.6 | 106.5 |
| WV-12101 |  | 4.6 | 19.8 | 60.3 | 85.8 | 92.0 | 108.3 |
|  | 6.8 | 19.2 | 60.0 | 81.1 | 81.0 | 85.6 |  |

TABLE 104

Activity of oligonucleotides.
nM

| Conc. (nM) | 50 | 20 | 8 | 3.2 | 1.28 | 0.51 | 0.20 | 0.081 | 0.032 | 0.013 |
|---|---|---|---|---|---|---|---|---|---|---|
| WV-7850 | 39.0 | 65.8 | 93.0 | 91.3 | 111.1 | 106.1 | 84.6 | 97.3 | 88.8 | 92.0 |
| Hep3B | 43.1 | 72.5 | 82.9 | 86.6 | 94.4 | 87.3 | 87.7 | 89.1 | 89.1 | 92.5 |
| WV-7851 | 38.2 | 81.0 | 93.6 | 90.5 | 98.6 | 94.6 | 100.1 | 90.2 | 96.1 | 100.6 |
| Hep3B | 54.3 | 84.1 | 96.1 | 94.4 | 93.0 | 94.1 | 99.5 | 87.1 | 101.9 | 92.8 |
| WV-7852 | 34.9 | 69.7 | 89.5 | 97.3 | 90.0 | 96.8 | 111.5 | 92.1 | 96.1 | 98.9 |
| Hep3B | 44.6 | 74.9 | 101.3 | 91.8 | 111.3 | 95.8 | 99.8 | 100.6 | 95.8 | 109.5 |
| WV-7853 | 28.3 | 66.4 | 85.2 |  | 96.3 | 109.2 | 95.1 | 95.9 | 95.6 | 99.1 |
| Hep3B | 29.8 | 50.5 | 81.3 | 96.1 | 97.1 | 105.3 | 94.0 | 104.8 | 95.8 | 97.4 |
| WV-7854 | 16.7 | 63.0 | 82.3 | 92.8 | 90.6 | 88.3 | 89.7 | 95.2 | 99.4 | 88.0 |
| Hep3B | 18.8 | 59.9 | 80.7 | 89.4 | 84.0 | 86.6 | 88.9 | 89.4 | 94.3 | 96.5 |
| WV-7850 | 2.7 | 5.3 | 11.7 | 25.1 | 57.3 | 75.2 | 71.2 | 84.7 | 80.7 | 96.8 |
| Huh7 | 4.3 | 5.9 | 9.7 | 13.8 | 62.5 | 73.3 | 74.3 | 75.8 | 93.7 | 104.2 |
| WV-7851 | 2.1 | 6.1 | 1.1 | 31.5 | 55.2 | 81.7 | 91.8 | 91.0 | 84.3 | 86.9 |
| Huh7 | 1.3 | 4.6 | 14.9 | 25.9 | 52.3 | 81.7 | 95.0 | 79.6 | 79.5 | 81.4 |
| WV-7852 | 8.4 | 7.8 | 10.0 | 28.6 | 50.0 | 72.8 | 82.6 | 96.2 | 72.2 | 94.1 |
| Huh7 | 7.4 | 5.8 | 10.6 | 25.4 | 56.1 | 87.6 | 85.1 | 83.7 | 70.1 | 88.5 |
| WV-7853 | 2.9 | 5.4 | 6.4 | 27.1 | 47.8 | 70.1 | 96.0 | 82.7 | 89.4 | 86.3 |
| Huh7 | 3.8 | 4.3 | 8.5 | 23.8 | 62.2 | 93.8 | 74.6 | 90.4 | 93.4 | 95.8 |
| WV-7854 | 0.6 | 2.4 | 9.9 | 23.5 | 47.7 | 76.6 | 84.1 | 79.3 | 89.4 | 98.8 |
| Huh7 | 5.4 | 7.5 | 10.3 | 22.2 | 45.9 | 66.5 | 72.7 | 82.7 | 83.7 | 96.6 |

TABLE 105

Activity of oligonucleotides.

| nM | 50 | 20 | 8 | 3.2 | 1.28 | 0.51 | 0.204 | 0.081 | 0.032 | 0.013 |
|---|---|---|---|---|---|---|---|---|---|---|
| WV-7827 | 37.0 | 79.1 | 97.3 | 94.2 | 97.0 | 105.3 | 107.2 | 100.9 | 98.8 | 96.8 |
| Hep3B | 34.3 | 85.1 | 89.9 | 89.1 | 95.4 | 93.1 | 97.4 | 101.7 | 95.8 | 93.4 |
| WV-7828 | 37.0 | 85.9 | 93.5 | 97.6 | 94.2 | 97.3 | 92.0 | 94.4 | 92.8 | 92.9 |
| Hep3B | 32.8 | 77.2 | 91.8 | 90.6 | 88.8 | 96.7 | 91.7 | 89.0 | 92.8 | 90.3 |
| WV-7829 | 25.1 | 82.2 | 99.7 | 92.6 | 93.6 | 95.8 | 103.8 | 94.0 | 91.5 | 86.3 |
| Hep3B | 33.5 | 79.8 | 98.8 | 92.4 | 94.1 | 104.0 | 102.3 | 105.6 | 103.1 | 104.3 |
| WV-7830 | 36.8 | 79.3 | 97.9 |  | 100.2 | 107.3 | 104.6 | 95.0 | 97.7 | 96.7 |
| Hep3B | 54.2 | 87.6 | 97.8 | 104.6 | 113.1 | 109.9 | 100.8 | 110.1 | 93.5 | 98.6 |
| WV-7831 | 53.4 | 97.4 | 103.9 | 104.8 | 99.8 | 102.6 | 111.8 | 102.0 | 93.5 | 101.5 |
| Hep3B | 62.5 | 92.9 | 103.7 | 99.5 | 102.9 | 99.8 | 98.9 | 93.6 | 101.8 | 100.8 |
| WV-7827 | 3.8 | 6.3 | 13.5 | 34.1 | 57.9 | 80.6 | 71.9 | 74.4 | 77.6 | 77.5 |
| Huh7 | 3.0 | 5.8 | 13.4 | 44.1 | 67.2 | 87.3 | 84.7 | 76.1 | 80.6 | 74.0 |
| WV-7828 | 2.3 | 16.3 | 9.8 | 31.4 | 63.3 | 83.2 | 74.9 | 82.3 | 89.1 | 83.1 |
| Huh7 | 1.5 | 9.1 | 25.0 | 31.5 | 69.3 | 75.8 | 76.5 | 87.0 | 90.0 | 79.8 |
| WV-7829 | 5.6 | 16.4 | 31.1 | 54.2 | 78.3 | 94.1 | 87.1 | 97.4 | 108.4 | 100.6 |
| Huh7 | 7.2 | 9.3 | 18.6 | 31.5 | 65.7 | 76.0 | 90.6 | 87.5 | 81.9 | 89.0 |
| WV-7830 | 4.1 | 6.3 | 12.5 | 35.3 | 56.8 | 86.4 | 80.1 | 95.7 | 86.7 | 94.2 |
| Huh7 | 5.5 | 5.9 | 17.0 | 40.2 | 76.3 | 77.5 | 79.8 | 98.6 | 93.2 | 85.8 |
| WV-7831 | 3.5 | 5.6 | 15.2 | 35.0 | 73.6 | 83.9 | 85.0 | 82.3 | 85.9 | 81.8 |
| Huh7 | 5.5 | 10.2 | 24.0 | 40.3 | 74.0 | 88.1 | 87.0 | 111.8 | 85.8 | 93.3 |

TABLE 106

Activity of oligonuc eotides.

| nM | 50 | 20 | 8 | 3.2 | 1.28 | 0.51 | 0.204 | 0.081 | 0.032 | 0.013 |
|---|---|---|---|---|---|---|---|---|---|---|
| WV-7804 | 63.3 | 84.6 | 101.1 | 92.9 | 95.5 | 96.2 | 92.0 | 97.6 | 98.4 | 96.7 |
| Hep3B | 69.5 | 98.4 | 102.9 | 95.1 | 98.6 | 110.4 | 99.5 | 93.6 | 101.4 | 100.4 |
| WV-7805 | 60.3 | 81.8 | 96.9 | 90.7 | 91.3 | 95.5 | 90.5 | 92.2 | 98.5 | 95.0 |
| Hep3B | 62.7 | 86.1 | 98.5 | 98.1 | 97.0 | 97.9 | 100.7 | 107.6 | 104.0 | 105.8 |
| WV-7806 | 69.6 | 90.1 | 100.8 | 98.9 | 95.9 | 95.9 | 99.3 | 92.3 | 99.6 | 90.1 |
| Hep3B | 65.1 | 89.4 | 94.7 | 92.1 | 90.9 | 94.8 | 94.7 | 93.8 | 90.1 | 97.5 |
| WV-7807 | 75.0 | 95.3 | 101.2 |  | 97.3 | 100.9 | 96.4 | 93.4 | 89.2 | 90.6 |
| Hep3B | 75.5 | 95.4 | 95.5 | 88.8 | 103.6 | 92.7 | 99.8 | 103.7 | 93.3 | 87.5 |
| WV-7808 | 72.2 | 98.9 | 117.8 | 109.5 | 116.3 | 110.9 | 109.3 | 116.8 | 111.1 | 104.6 |
| Hep3B |  |  |  |  |  |  |  |  |  |  |
| WV-7804 | 4.4 | 3.5 | 25.1 | 45.3 | 68.9 | 74.6 | 73.6 | 82.9 | 81.8 | 86.7 |
| Huh7 | 7.5 | 11.1 | 23.3 | 48.0 | 77.1 | 76.0 | 86.5 | 89.4 | 96.1 | 90.4 |
| WV-7805 | 1.7 | 7.1 | 19.6 | 36.1 | 59.2 | 75.3 | 69.8 | 75.0 | 78.0 | 79.6 |
| Huh7 | 8.4 | 11.9 | 11.6 | 38.4 | 76.2 | 78.4 | 81.1 | 86.9 | 95.8 | 95.0 |
| WV-7806 | 9.8 | 2.8 | 13.8 | 28.8 | 68.7 | 66.6 | 69.7 | 78.6 | 89.4 | 88.6 |
| Huh7 | 3.8 | 7.2 | 12.5 | 39.7 | 68.5 | 82.4 | 80.3 | 79.7 | 87.3 | 98.0 |

TABLE 106-continued

Activity of oligonucleotides.

| nM | 50 | 20 | 8 | 3.2 | 1.28 | 0.51 | 0.204 | 0.081 | 0.032 | 0.013 |
|---|---|---|---|---|---|---|---|---|---|---|
| WV-7807 | 3.0 | 12.6 | 25.1 | 46.9 | 78.0 | 85.3 | 98.8 | 92.6 | 85.6 | 85.5 |
| Huh7 | 3.9 | 9.1 | 14.9 | 41.5 | 70.4 | 73.7 | 68.5 | 75.3 | 81.9 | 94.7 |
| WV-7808 | 1.8 | 1.9 | 14.2 | 37.1 | 63.6 | 71.0 | 79.2 | 88.0 | 84.1 | 95.3 |
| Huh7 | 1.4 | 5.2 | 9.1 | 33.2 | 65.2 | 77.4 | 92.3 | 71.2 | 83.5 | 78.1 |

TABLE 107

Activity of oligonucleotides.

| nM | WV-7805 Hep3B | | WV-7805 Huh7 | |
|---|---|---|---|---|
| 20 | 81.8 | 86.1 | 7.1 | 11.9 |
| 8 | 96.9 | 98.5 | 19.6 | 11.6 |
| 3.2 | 90.7 | 98.1 | 36.1 | 38.4 |
| 1.28 | 91.3 | 97.0 | 59.2 | 76.2 |
| 0.512 | 95.5 | 97.9 | 75.3 | 78.4 |
| 0.2048 | 90.5 | 100.7 | 69.8 | 81.1 |
| 0.08192 | 92.2 | 107.6 | 75.0 | 86.9 |
| 0.032768 | 98.5 | 104.0 | 78.0 | 95.8 |
| 0.013107 | 95.0 | 105.8 | 79.6 | 95.0 |

In some tests of PNPLA3 oligonucleotides, APOC3 oligonucleotide WV-1868 (which targets APOC3, a gene different than PNPLA2) is used as a negative control.

TABLE 108

Activity of oligonucleotides.

| nM | 2 | | 8.25 | | 33 | |
|---|---|---|---|---|---|---|
| Control | 1.002 | 1.082 | 1.192 | 1.105 | 1.031 | 1.038 |
| WV-1868 | 1.105 | 1.016 | 1.120 | 0.995 | 1.023 | 1.023 |
| WV-3451 | 0.962 | 0.975 | 0.484 | 0.617 | 0.218 | 0.256 |
| WV-3452 | 1.060 | 0.948 | 0.526 | 0.505 | 0.189 | 0.172 |
| WV-3453 | 0.388 | 0.487 | 0.181 | 0.197 | 0.217 | 0.156 |
| WV-3454 | 0.509 | 0.502 | 0.260 | 0.186 | 0.138 | 0.064 |
| WV-3455 | 0.613 | 0.617 | 0.342 | 0.347 | 0.197 | 0.155 |
| WV-3456 | 0.724 | 0.843 | 0.468 | 0.545 | 0.218 | 0.223 |
| WV-3457 | 0.714 | 0.776 | 0.367 | 0.362 | 0.132 | 0.096 |
| WV-3458 | 0.672 | 0.618 | 0.251 | 0.309 | 0.256 | 0.180 |
| WV-3459 | 1.184 | 1.105 | 1.097 | 1.067 | 0.820 | 0.975 |
| WV-3460 | 0.849 | 0.689 | 0.436 | 0.367 | 0.461 | 0.382 |
| WV-3461 | 0.989 | 1.243 | 0.471 | 0.600 | 0.261 | 0.198 |
| WV-3462 | 0.833 | 1.040 | 0.417 | 0.446 | 0.286 | 0.120 |
| Control | 1.002 | 1.082 | 1.192 | 1.105 | 1.031 | 1.038 |
| WV-1868 | 1.105 | 1.016 | 1.120 | 0.995 | 1.023 | 1.023 |
| WV-3437 | 1.045 | 1.067 | 0.564 | 0.501 | 0.256 | 0.181 |
| WV-3438 | 0.861 | 0.989 | 0.935 | 0.760 | 1.009 | 0.982 |
| WV-3439 | 1.009 | 1.016 | 0.770 | 0.734 | 0.576 | 0.530 |
| WV-3440 | | 1.038 | 1.060 | 0.982 | 0.729 | 0.613 |
| WV-3441 | 1.082 | 1.234 | 0.680 | 0.903 | 0.313 | 0.433 |
| WV-3442 | 1.120 | 0.935 | 0.477 | 0.643 | 0.223 | 0.347 |
| WV-3443 | 0.477 | 0.410 | 0.278 | 0.204 | 0.229 | 0.171 |
| WV-3444 | 0.714 | 0.592 | 0.350 | 0.396 | 0.234 | 0.209 |
| WV-3445 | 1.304 | 1.060 | 0.776 | 0.760 | 0.439 | 0.388 |
| WV-3446 | 0.849 | 0.729 | 0.455 | 0.430 | 0.247 | 0.235 |
| WV-3447 | 0.786 | 0.929 | 0.568 | 0.604 | 0.201 | 0.292 |
| WV-3448 | 0.776 | 0.837 | 0.458 | 0.568 | 0.218 | 0.226 |
| WV-3449 | 0.776 | 0.704 | 0.404 | 0.449 | 0.252 | 0.130 |
| WV-3450 | 1.084 | 0.851 | 1.077 | 0.839 | 0.924 | 0.905 |
| Control | 1.002 | 1.082 | 1.192 | 1.105 | 1.031 | 1.038 |
| WV-1868 | 1.105 | 1.016 | 1.120 | 0.995 | 1.023 | 1.023 |
| WV-3423 | 0.634 | 0.600 | 0.407 | 0.419 | 0.315 | 0.280 |
| WV-3424 | 0.634 | 0.754 | 0.350 | 0.445 | 0.124 | 0.286 |
| WV-3425 | 1.002 | 1.023 | 0.729 | 0.643 | 0.347 | 0.345 |
| WV-3426 | 1.023 | 0.797 | 0.487 | 0.427 | 0.364 | 0.367 |
| WV-3427 | 0.849 | 0.897 | 0.709 | 0.781 | 0.621 | 0.572 |
| WV-3428 | 1.052 | 1.089 | 0.831 | 0.922 | 0.942 | 1.002 |
| WV-3429 | 1.060 | 0.982 | 0.588 | 0.604 | 0.401 | 0.340 |
| WV-3430 | 1.074 | 1.184 | 0.935 | 0.942 | 0.505 | 0.449 |
| WV-3431 | 0.600 | 0.675 | 0.391 | 0.364 | 0.208 | 0.237 |
| WV-3432 | 0.975 | 0.955 | 0.630 | 0.639 | 0.276 | 0.326 |

TABLE 108-continued

Activity of oligonucleotides.

| nM | 2 | | 8.25 | | 33 | |
|---|---|---|---|---|---|---|
| WV-3433 | 0.596 | 0.685 | 0.240 | 0.270 | 0.215 | 0.146 |
| WV-3434 | 0.885 | 0.714 | 0.261 | 0.342 | 0.206 | 0.193 |
| WV-3435 | 0.584 | 0.584 | 0.350 | 0.311 | 0.288 | 0.261 |
| WV-3436 | 1.074 | 0.797 | 0.760 | 0.661 | 0.515 | 0.477 |
| Control | 0.910 | 1.000 | 0.996 | 1.136 | 1.105 | 1.136 |
| WV-1868 | 1.278 | 1.075 | 0.936 | 1.176 | 0.809 | 0.879 |
| WV-3409 | 0.690 | 0.498 | 0.329 | 0.274 | 0.488 | 0.405 |
| WV-3410 | 0.832 | 0.936 | 0.217 | 0.231 | 0.241 | 0.134 |
| WV-3411 | 0.685 | 0.588 | 0.114 | 0.116 | 0.037 | 0.108 |
| WV-3412 | | 0.873 | 0.383 | 0.286 | 0.089 | 0.070 |
| WV-3413 | 0.855 | 0.838 | 0.336 | 0.263 | 0.030 | 0.071 |
| WV-3414 | 1.105 | 1.024 | 0.798 | 0.709 | 0.290 | 0.333 |
| WV-3415 | 1.024 | | 0.298 | 0.185 | 0.484 | 0.393 |
| WV-3416 | 0.541 | 0.568 | 0.273 | 0.260 | 0.246 | 0.241 |
| WV-3417 | 0.734 | 0.622 | 0.331 | 0.137 | 0.298 | 0.300 |
| WV-3418 | 0.530 | 0.568 | 0.185 | 0.114 | 0.258 | 0.298 |
| WV-3419 | 0.962 | 0.639 | 0.680 | 0.588 | 0.377 | 0.362 |
| WV-3420 | | 1.113 | 0.956 | 0.771 | 0.375 | 0.159 |
| WV-3421 | 0.502 | 0.443 | 0.169 | 0.148 | 0.218 | 0.228 |
| WV-3422 | 0.923 | 1.083 | 0.680 | 0.516 | 0.365 | 0.372 |
| Control | 0.910 | 1.000 | 0.996 | 1.136 | 1.105 | 1.136 |
| WV-1868 | 1.278 | 1.075 | 0.936 | 1.176 | 0.809 | 0.879 |
| WV-3395 | 0.419 | 0.247 | 0.336 | 0.198 | 0.338 | 0.331 |
| WV-3396 | 1.024 | 0.982 | 0.452 | 0.553 | 0.249 | 0.195 |
| WV-3397 | 0.685 | 0.976 | 0.365 | | 0.182 | 0.096 |
| WV-3398 | 1.053 | | 0.159 | 0.273 | 0.061 | 0.052 |
| WV-3399 | 0.357 | 0.440 | 0.284 | 0.141 | 0.221 | 0.282 |
| WV-3400 | 0.867 | 0.861 | 0.553 | 0.458 | 0.184 | 0.160 |
| WV-3401 | 1.252 | 0.904 | 0.481 | 0.383 | 0.133 | 0.093 |
| WV-3402 | 0.437 | 0.302 | 0.122 | 0.096 | 0.070 | 0.046 |
| WV-3403 | 1.176 | 1.218 | 1.003 | 1.144 | 0.879 | 0.929 |
| WV-3404 | 0.195 | 0.367 | 0.155 | 0.135 | 0.269 | 0.215 |
| WV-3405 | 1.024 | 0.695 | 0.377 | 0.258 | 0.194 | 0.208 |
| WV-3406 | 1.287 | 1.075 | 1.314 | 1.201 | 1.314 | 0.969 |
| WV-3407 | 0.949 | 0.917 | 0.609 | 0.498 | 0.326 | 0.125 |
| WV-3408 | 0.239 | 0.360 | 0.107 | 0.187 | 0.265 | 0.161 |
| Control | 0.910 | 1.000 | 0.996 | 1.136 | 1.105 | 1.136 |
| WV-1868 | 1.278 | 1.075 | 0.936 | 1.176 | 0.809 | 0.879 |
| WV-3381 | 0.560 | 0.391 | 0.103 | 0.108 | 0.146 | 0.199 |
| WV-3382 | 0.949 | 1.024 | 0.393 | 0.271 | 0.132 | 0.211 |
| WV-3383 | 1.031 | 0.996 | 0.617 | 0.458 | 0.455 | 0.133 |
| WV-3384 | 1.252 | 1.060 | 0.402 | 0.416 | 0.136 | 0.133 |
| WV-3385 | 0.962 | 1.098 | 0.407 | 0.410 | 0.221 | 0.123 |
| WV-3386 | 0.680 | 0.440 | 0.186 | 0.246 | 0.265 | 0.176 |
| WV-3387 | 0.269 | 0.191 | 0.100 | 0.067 | 0.081 | 0.141 |
| WV-3388 | 1.168 | 0.982 | 0.849 | 1.053 | 1.168 | 0.892 |
| WV-3389 | 1.083 | 1.031 | 1.399 | 0.879 | 0.771 | 0.804 |
| WV-3390 | 0.676 | 0.580 | 0.226 | 0.265 | 0.035 | 0.051 |
| WV-3391 | 0.505 | 0.396 | 0.187 | 0.153 | 0.107 | 0.176 |
| WV-3392 | 0.462 | 0.362 | 0.139 | 0.116 | 0.093 | 0.070 |
| WV-3393 | 0.273 | 0.391 | 0.102 | 0.111 | 0.060 | 0.044 |
| WV-3394 | 0.509 | 0.405 | 0.263 | 0.133 | 0.109 | 0.097 |

TABLE 109A

Activity of oligonucleotides.

| Conc (nM) | 20 | 8 | 3.2 | 1.28 | 0.512 | 0.205 | 0.0819 | 0.0328 | 0.0131 | 0.0052 |
|---|---|---|---|---|---|---|---|---|---|---|
| WV-8148 | 111.7 | 111.5 | 102.6 | 105.8 | 102.9 | 103.1 | 92 | 96.5 | 99.6 | 118.7 |
| Hep3B | 97.3 | 114.3 | 107.8 | 106.6 | 105.8 | 106.6 | 90.9 | 100.8 | 95.3 | 105.5 |
| WV-8149 | 128.4 | 118 | 104.2 | 99.8 | 104.8 | 103.2 | 97.1 | 102.1 | 104.6 | 96.5 |
| Hep3B | 135.8 | 131.3 | 108.8 | 108.5 | 94.5 | 106.1 | 107.8 | 99.3 | 103.3 | 102.4 |
| WV-8150 | 120.7 | 123.7 | 115 | 99.8 | 98.6 | 100.9 | 88.5 | 92.3 | 103.1 | 102 |
| Hep3B | 113 | 111.8 | 98.4 | 102.1 | 102.3 | 100 | 103 | 100.8 | 104 | 107.9 |
| WV-8151 | 112.3 | 147 | 108.4 | 103.4 | 104.6 | 104.6 | 111.1 | 100.1 | 102.4 | 100 |
| Hep3B | 119.6 | 124.3 | 106.6 | 101.6 | 110.1 | 104.1 | 113.7 | 100.3 | 100.3 | 104.7 |
| WV-8152 | 119.1 | 139.2 | 113 | 107 | 112.7 | 121 | 112.4 | 111.7 | 88.5 | 114.7 |
| Hep3B | 133.7 | 149 | 118.1 | 103.2 | 101.7 | 101.8 | 102.5 | 94.6 | 98.3 | 104.2 |
| WV-8148 | 26.6 | 41.6 | 64.4 | 90.6 | 91.8 | 86.5 | 98.2 | 90.5 | 99.6 | 94.1 |
| Huh7 | 35.5 | 54 | 65.7 | 87.4 | 85.8 | 87.5 | 86.8 | 100.9 | 99.3 | 90.2 |
| WV-8149 | 23.2 | 33.1 | 64.6 | 83.6 | 87.2 | 94.4 | 82.9 | 94.8 | 79.1 | 92.5 |
| Huh7 | 27.5 | 44.3 | 65.5 | 89.5 | 84.5 | 87.9 | 82.9 | 92 | 94.6 | 85.1 |
| WV-8150 | 26.3 | 26.6 | 55 | 80.4 | 86.7 | 91.5 | 86.9 | 90.1 | 88.4 | 84.7 |
| Huh7 | 20 | 29.6 | 52.7 | 92.1 | 83.4 | 91.9 | 97 | 84 | 86.9 | 93.5 |
| WV-8151 | 13.4 | 28.7 | 59.7 | 82 | 90.6 | 92.4 | 90.2 | 84.4 | 78.1 | 85.7 |
| Huh7 | 23.6 | 32.8 | 63.6 | 77.7 | 101.1 | 92.6 | 91.6 | 100.9 | 83.4 | 90.2 |
| WV-8152 | 13.2 | 36.7 | 58.3 | 90.9 | 94.4 | 95.7 | 76.1 | 84.3 | 90.3 | 85.2 |
| Huh7 | 18.1 | 47.5 | 61 | 84.7 | 93.9 | 86.2 | 96 | 92.6 | 84 | 90.1 |

| nM | 20 | 8 | 3.2 | 1.28 | 0.512 | 0.205 | 0.0819 | 0.0328 | 0.0131 | 0.0052 |
|---|---|---|---|---|---|---|---|---|---|---|
| WV-8194 | 102.9 | 103.8 | 85.5 | 90.8 | 90.8 | 102.3 | 96.8 | 101.1 | 95.8 | 95.5 |
| Hep3B | 93.3 | 95.7 | 87.8 | 90 | 78.5 | 77.4 | 86.4 | 78.1 | 81 | 88.2 |
| WV-8195 | 107.9 | 103.7 | 96.6 | 91.5 | 91.7 | 92.1 | 94.1 | 105.6 | 107.4 | 95.7 |
| Hep3B | 123 | 101.5 | 92.9 | 89.4 | 92 | 86 | 88.3 | 101.9 | 104.3 | 99.3 |
| WV-8196 | 86.5 | 108.1 | 106 | 90.1 | 96.1 | 87.3 | 93.3 | 87.9 | 100.1 | 103.5 |
| Hep3B | 112.8 | 126.8 | 98.2 | 86.9 | 83.2 | 82.4 | 88.8 | 95.5 | 92.8 | 101.9 |
| WV-8197 | 140.8 | 123.5 | 108.9 | 87 | 91.5 | 92.8 | 106.1 | 98.1 | 107.7 | 94.5 |
| Hep3B | 143.8 | 132.1 | 98.1 | 85.6 | 85.3 | 80.7 | 84.6 | 88 | 95.2 | 93.5 |
| WV-8198 | 99.5 | 101 | 89.4 | 85.4 | 88.6 | 94.9 | 88.4 | 95.8 | 95 | 97.2 |
| Hep3B | 119.8 | 90.9 | 85.3 | 95.8 | 93.3 | 80.1 | 82.9 | 82.4 | 86.9 | 88 |
| WV-8194 | 8.1 | 13.3 | 32.2 | 69.5 | 91.6 | 100.4 | 89.2 | 91.8 | 90.4 | 81.5 |
| Huh7 | 7.4 | 31.2 | 38 | 76 | 86.9 | 93.6 | 92.5 | 92 | 87.5 | 104.3 |
| WV-8195 | 7.3 | 27 | 41.1 | 64.1 | 83.2 | 96.5 | 95.1 | 84.7 | 89.8 | 87.3 |
| Huh7 | 14 | 20 | 37.1 | 57.8 | 95 | 94.3 | 85.4 | 90.7 | 97.6 | 85.8 |
| WV-8196 | 8.9 | 19.5 | 26.7 | 64.4 | 78.5 | 88.3 | 83.2 | 88.1 | 81.1 | 81.1 |
| Huh7 | 14.3 | 19.9 | 37.1 | 57.3 | 91.7 | 91.8 | 88.5 | 84.5 | 84 | 91.9 |
| WV-8197 | 4.1 | 27.3 | 40.8 | 65.6 | 88.8 | 91.7 | 95.6 | 96 | 90.6 | 93.3 |
| Huh7 | 14.8 | 26.8 | 44 | 62.4 | 83.9 | 96.5 | 89.1 | 97.9 | 92.9 | 81.8 |
| WV-8198 | 7.9 | 19.9 | 36.5 | 68.6 | 94.6 | 90.6 | 90 | 94 | 90.9 | 89.9 |
| Huh7 | 6.9 | 26.7 | 47.9 | 63.8 | 83.1 | 99.5 | 97.2 | 97.1 | 88.1 | 97.8 |

| Conc (nM) | 20 | 8 | 3.2 | 1.28 | 0.512 | 0.205 | 0.0819 | 0.0328 | 0.0131 | 0.0052 |
|---|---|---|---|---|---|---|---|---|---|---|
| WV-8171 | 102.4 | 98.1 | 108.8 | 104.7 | 111.4 | 107.4 | 102.2 | 112 | 95.9 | 92.4 |
| Hep3B | 94.9 | 94.6 | 89.8 | 102.6 | 97.2 | 101.8 | 96.4 | 98.9 | 97.7 | 90.6 |
| WV-8172 | 105 | 105.3 | 116.3 | 108.9 | 120 | 105.5 | 101.4 | 100.9 | 94.3 | 99.9 |
| Hep3B | 92.8 | 90.5 | 92.7 | 90.1 | 96.8 | 90.6 | 97.9 | 92.5 | 103.3 | 84.7 |
| WV-8173 | 96.9 | 90.2 | 99.1 | 108.6 | 107.1 | 103.6 | 105.9 | 100.6 | 95.6 | 100.2 |
| Hep3B | 104.3 | 96.4 | 99 | 98.2 | 99.9 | 103.3 | 95.7 | 96.4 | 97.7 | 95.1 |
| WV-8174 | 98 | 85.2 | 93.3 | 96.1 | 83.8 | 84.7 | 83 | 86.3 | 93.7 | 105.9 |
| Hep3B | 115.5 | 112.5 | 95.7 | 98.7 | 86.6 | 97.4 | 93.6 | 82.7 | 90.9 | 99.2 |
| WV-8175 | 98.2 | 91 | 90.6 | 88 | 95.9 | 94.2 | 86.7 | 96 | 106.2 | 91.3 |
| Hep3B | 102.6 | 91.1 | 89.4 | 87.1 | 93.7 | 98.8 | 102.7 | 83.9 | 95.7 | 88.1 |
| WV-8171 | 22.1 | 39.4 | 56.7 | 76.8 | 76 | 87.5 | 75.8 | 95.2 | 83.1 | 77.8 |
| Huh7 | 19.2 | 58.8 | 66.5 | 77.9 | 89.6 | 88.9 | 93.8 | 91 | 90.8 | 97.2 |
| WV-8172 | 13.9 | 30 | 54.5 | 80.4 | 88.1 | 87.6 | 79.8 | 85.4 | 82 | 98.4 |
| Huh7 | 20.6 | 43.1 | 54.6 | 78.4 | 89.4 | 92.4 | 93.6 | 99.8 | 109.4 | 105.5 |
| WV-8173 | 37.2 | 44.1 | 78.6 | 106.3 | 113.7 | 106.6 | 105.3 | 103.7 | 97.6 | 93.3 |
| Huh7 | 41 | 75.8 | 85.6 | 100.6 | 111.3 | 103.2 | 114.4 | 117.5 | 107.3 | 107.7 |
| WV-8174 | 30.2 | 47.6 | 66.3 | 69.3 | 92.1 | 85.6 | 85.6 | 76.1 | 87.3 | 89.8 |
| Huh7 | 19 | 40.9 | 52.4 | 77.2 | 92.2 | 96.6 | 88.8 | 92 | 92.1 | 91.8 |
| WV-8175 | 11.5 | 26.5 | 45.9 | 69.1 | 86.1 | 85.6 | 82.6 | 92.9 | 97 | 83.7 |
| Huh7 | 12.5 | 26.7 | 45.2 | 77.6 | 86.4 | 94.5 | 102.9 | 91.7 | 92 | 85.9 |

| nM | 20 | 8 | 3.2 | 1.28 | 0.512 | 0.205 | 0.0819 | 0.0328 | 0.0131 | 0.0052 |
|---|---|---|---|---|---|---|---|---|---|---|
| WV-8217 | 88.4 | 85.5 | 87.5 | 86.9 | 89.2 | 90 | 98.6 | 98.5 | 97.1 | 86.5 |
| Hep3B | 93.3 | 83.5 | 76.7 | 80.1 | 78 | 77.9 | 77.6 | 74.8 | 79.8 | 86.6 |
| WV-8218 | 100.6 | 94.9 | 92 | 93.1 | 99.6 | 96 | 98.2 | 95.5 | 92.9 | 87.4 |
| Hep3B | 99.3 | 96.4 | 99.2 | 96.3 | 95.5 | 100.8 | 100.5 | 93.6 | 96.7 | 96.3 |
| WV-8219 | 147.3 | 128.9 | 107.6 | 106.1 | 104.8 | 106.8 | 98.6 | 101.5 | 96.5 | 110.7 |
| Hep3B | 126.8 | 103.2 | 94.8 | 93.5 | 94.2 | 96 | 100.6 | 103.3 | 96.7 | 102.9 |
| WV-8220 | 104.2 | 115.4 | 103.9 | 97 | 106.9 | 102.2 | 99.4 | 105.1 | 99.1 | 95.3 |

TABLE 109A-continued

Activity of oligonucleotides.

| | | | | | | | | | | |
|---|---|---|---|---|---|---|---|---|---|---|
| Hep3B | 100 | 89.8 | 96.8 | 95.5 | 107.4 | 106.4 | 104.3 | 95.9 | 117 | 101 |
| WV-8221Hep3B | 110.2 | 104.7 | 97.7 | 102.6 | 104.1 | 106.4 | 102.6 | 100.3 | 102 | 98.4 |
| | 94.5 | 98.5 | 101.6 | 99.7 | 99.4 | 108.4 | 103 | 107.1 | 100.3 | 103.3 |
| WV-8217 Huh7 | 26.8 | 37.9 | 58.2 | 81.9 | 94 | 101.3 | 112 | 105.2 | 97.8 | 28.2 |
| | 27.7 | 41 | 57.6 | 90.7 | 109.2 | 102.4 | 110.5 | 109.9 | 105.5 | 105.2 |
| WV-8218 Huh7 | 21.6 | 45.8 | 56.1 | 77.7 | 86.9 | 97.3 | 82.6 | 88.5 | 86.1 | 73.9 |
| | 20.9 | 28.8 | 55.3 | 78.1 | 106.9 | 107.3 | 107.6 | 95.6 | 104.1 | 82.8 |
| WV-8219 Huh7 | 31.5 | 31 | 42.7 | 62.7 | 92 | 91.7 | 85.7 | 75.7 | 77.2 | 85.7 |
| | 26 | 31.8 | 47.9 | 75 | 85.5 | 92.1 | 83.6 | 89.7 | 93.1 | 91.3 |
| WV-8220 Huh7 | 4.8 | 16.3 | 31.8 | 66.1 | 78.6 | 77.8 | 79.7 | 71.7 | 81.1 | 80.3 |
| | 11.8 | 30.1 | 54.4 | 77.4 | 105.6 | 98.6 | 90.5 | 85.7 | 93.9 | 85.5 |
| WV-8221 Huh7 | 6.2 | 21.4 | 31.8 | 48.6 | 78.3 | 85.8 | 75.5 | 83.8 | 85.3 | 93 |
| | 4.6 | 19.1 | 35.2 | 59.6 | 104.8 | 105.8 | 99.2 | 100.1 | 93.2 | 88.7 |

TABLE 109B

Activity of oligonucleotides.
IC50 in Huh7 cells (mutant allele):

| Oligonucleotide | IC50 (nM) |
|---|---|
| WV-8148 | 7.3 |
| WV-8149 | 9.2 |
| WV-8150 | 5.5 |
| WV-8151 | 7.9 |
| WV-8152 | 12.6 |
| WV-8171 | 11.2 |
| WV-8172 | 5.2 |
| WV-8173 | 12 |
| WV-8174 | 6.6 |
| WV-8175 | 4.2 |
| WV-8197 | 3.2 |
| WV-8198 | 3.5 |
| WV-8217 | 5.4 |
| WV-8218 | 5.9 |
| WV-8219 | 3.1 |
| WV-8220 | 5.5 |
| WV-8221 | 2.6 |
| WV-8194 | 3.5 |
| WV-8195 | 3 |
| WV-8196 | 2.8 |

TABLE 110

Activity of oligonucleotides.
Huh7 cells:

| | 50 | 20 | 8 | 3.2 | 1.28 | 0.512 | 0.204 | 0.081 | 0.032 | 0.013 |
|---|---|---|---|---|---|---|---|---|---|---|
| WV-3861 | 23.1 | 43.8 | 72.8 | 101.4 | 102.4 | 103.3 | 85.5 | 91.9 | 93.7 | 92.0 |
| | 30.1 | 52.2 | 89.3 | 103.4 | 95.9 | 93.4 | 99.4 | 104.5 | 89.7 | 104.8 |
| WV-7805 | 8.0 | 13.3 | 32.7 | 65.4 | 87.0 | 83.1 | 91.2 | 84.1 | 76.1 | 85.3 |
| | 10.1 | 22.7 | 49.1 | 82.1 | 87.8 | 81.8 | 82.5 | 77.8 | 87.9 | 79.1 |
| WV-7828 | 5.3 | 15.3 | 26.8 | 60.5 | 88.1 | 85.0 | 92.1 | 85.8 | 84.2 | 90.3 |
| | 4.3 | 10.0 | 41.1 | 54.4 | 79.6 | 90.2 | 89.0 | 90.2 | 99.3 | 83.6 |
| WV-7851 | 4.1 | 4.4 | 20.0 | 42.9 | 63.8 | 85.3 | 77.7 | 79.3 | 84.6 | 93.4 |
| | 6.7 | 6.6 | 20.3 | 47.5 | 86.7 | 79.7 | 97.4 | 97.4 | 85.0 | 89.4 |
| WV-8149 | 18.4 | 29.4 | 35.5 | 71.2 | 88.8 | 91.2 | 75.3 | 84.9 | 86.5 | 90.6 |
| | 46.2 | 21.9 | 47.2 | 80.7 | 86.5 | 93.9 | 83.9 | 90.5 | 101.4 | 95.3 |
| WV-8172 | 20.5 | 13.7 | 30.4 | 53.8 | 73.3 | 85.2 | 74.8 | 80.7 | 87.0 | 84.4 |
| | 20.3 | 21.9 | 41.3 | 59.0 | 78.7 | 83.5 | 91.1 | 92.5 | 91.8 | 104.3 |
| WV-8195 | 23.2 | 11.4 | 15.4 | 64.8 | 71.9 | 74.1 | 82.8 | 87.0 | 88.5 | 76.4 |
| | 22.7 | 14.6 | 23.5 | 62.1 | 80.2 | 85.0 | 99.0 | 99.6 | 104.0 | 100.4 |
| WV-8218 | 6.6 | 13.1 | 13.4 | 53.7 | 73.0 | 93.6 | 94.6 | 93.8 | 88.0 | 92.3 |
| | 20.2 | 14.0 | 30.6 | 57.7 | 97.4 | 117.6 | 99.8 | 101.2 | 114.2 | 109.0 |
| WV-3864 | 3.7 | 22.4 | 60.6 | 94.6 | 92.3 | 99.2 | 88.2 | 97.2 | 92.0 | 104.1 |
| | 18.9 | 27.5 | 68.5 | 114.8 | 95.1 | 113.1 | 100.1 | 117.6 | 110.2 | 118.9 |
| WV-7808 | 6.6 | 12.6 | 34.8 | 66.1 | 73.0 | 88.8 | 93.9 | 90.6 | 91.2 | 94.2 |
| | 6.4 | 14.2 | 32.3 | 80.2 | 106.0 | 106.7 | 107.6 | 89.2 | 103.4 | 97.6 |
| WV-7831 | 4.8 | 7.9 | 27.1 | 62.1 | 80.6 | 82.5 | 91.4 | 92.8 | 93.6 | 93.7 |
| | 8.0 | 13.1 | 29.4 | 62.2 | 90.7 | 122.5 | 105.5 | 120.7 | 115.5 | 97.9 |
| WV-7854 | 2.0 | 7.1 | 21.5 | 49.2 | 74.1 | 83.3 | 116.8 | 75.8 | 83.4 | 95.0 |
| | 5.0 | 5.3 | 17.0 | 50.4 | 100.7 | 99.7 | 103.2 | 99.8 | 101.7 | 90.1 |
| WV-8152 | | 14.4 | 33.7 | 80.7 | 82.8 | 80.8 | 84.3 | 86.5 | 89.7 | 88.2 |
| | 23.4 | 40.1 | 77.3 | 106.3 | 96.3 | 97.7 | 99.9 | 97.1 | 79.5 | |
| WV-8175 | 17.6 | 13.5 | 18.2 | 48.5 | 69.7 | 87.0 | 72.8 | 91.4 | 86.5 | 81.6 |
| | 22.4 | 16.5 | 19.2 | 51.1 | 108.5 | 89.7 | 87.4 | 102.0 | 91.2 | 95.4 |
| WV-8198 | 16.6 | 8.3 | 15.1 | 43.7 | 78.0 | 81.9 | 82.7 | 75.3 | 91.5 | 88.2 |
| | 7.1 | 5.1 | 23.9 | 46.3 | 93.6 | 103.2 | 103.6 | 93.8 | 125.9 | 96.0 |
| WV-8221 | 16.0 | 9.6 | 12.4 | 31.8 | 73.1 | 101.6 | 96.7 | 77.9 | 86.7 | 94.3 |
| | 13.0 | 10.9 | 16.2 | 44.1 | 85.5 | 102.0 | 110.9 | 123.8 | 101.9 | 102.9 |

Several PNPLA3 ssRNAi agents were also prepared and tested which have an abasic site, specifically a (phosphaneyl)oxy)propan-1-ol (PS) or 3'-(phosphaneyl)oxy)tetrahydrofuran. Results for oligonucleotide administration at 2 nM is shown, and oligonucleotides were also tested at 0, 0.05, 0.128, 0.32, and 0.8 nM (data not shown). Numbers are approximate and represent residual PNPLA3 mRNA level (PNPLA3/HPRT1), wherein 100 would represent 100% residual mRNA level (0% knockdown) and 0 would represent 0% residual mRNA level (100% knockdown). In the various tables herein, the level of mRNA is measured, unless otherwise noted.

TABLE 111

Activity of oligonucleotides.

| Oligonucleotide | 2 nM |
| --- | --- |
| WV-4098 | 30 |
| WV-9273 | 72 |
| WV-9274 | 73 |
| WV-9275 | 74 |
| WV-9276 | 52 |
| WV-9277 | 44 |
| WV-9278 | 55 |
| WV-9279 | 39 |
| WV-9280 | 82 |
| WV-9281 | 68 |

Several APOC3 ssRNAi agents were also prepared and tested which have C3 modification. Results for oligonucleotide administration at 2 nM is shown, and oligonucleotides were also tested at 0, 0.05, 0.128, 0.32, and 0.8 nM (data not shown). Numbers are approximate and represent residual PNPLA3 mRNA level (PNPLA3/HPRT1), wherein 100 would represent 100% residual mRNA level (0% knockdown) and 0 would represent 0% residual mRNA level (100% knockdown). In the various tables herein, the level of mRNA is measured, unless otherwise noted.

TABLE 112

Activity of oligonucleotides.

| Oligonucleotide | 2 nM |
| --- | --- |
| WV-4098 | 31 |
| WV-9261 | 62 |
| WV-9262 | 69 |
| WV-9263 | 72 |
| WV-9264 | 62 |
| WV-9265 | 56 |
| WV-9266 | 64 |
| WV-9267 | 43 |
| WV-9268 | 69 |
| WV-9269 | 71 |
| WV-4098 | 31 |
| WV-9272 | 81 |
| WV-9284 | 75 |

Data is shown for 25 nM; oligonucleotides were also tested at 0, 1.6, and 6.2 nM (data not shown). Oligonucleotides were tested in vitro in primary cynomolgus hepatocytes.

TABLE 113

Activity of oligonucleotides.

| Oligonucleotide | 25 nM |
| --- | --- |
| WV-3421 | 13 |
| WV-9434 | 63 |

TABLE 113-continued

Activity of oligonucleotides.

| Oligonucleotide | 25 nM |
| --- | --- |
| WV-9439 | 55 |
| WV-9444 | 37 |
| WV-3421 | 12 |
| WV-9435 | 62 |
| WV-9440 | 37 |
| WV-9445 | 34 |
| WV-3421 | 17 |
| WV-9431 | 92 |
| WV-9436 | 70 |
| WV-9441 | 73 |
| WV-9432 | 53 |
| WV-9437 | 36 |
| WV-9442 | 54 |
| WV-9433 | 77 |
| WV-9438 | 44 |
| WV-9443 | 69 |

Primary cynomolgus hepatocytes. Data is shown for 4 nM. Oligonucleotides were also tested at 0, 0.1, 0.25, 0.66, 1.6, and 10 nM (data not shown). Numbers represent residual PNPLA3 mRNA level (PNPLA3/HPRT1) and numbers are approximate.

TABLE 114

Activity of oligonucleotides.

| | Hep3b (wt) | Huh7 (mutant) |
| --- | --- | --- |
| WV-9890 | 88 | 37 |
| WV-12100 | 103 | 27 |
| WV-9893 | 67 | 10 |
| WV-12101 | 69 | 8 |

WV-9893 and WV-12101 have an asymmetrical format.

Additional oligonucleotides which have an asymmetrical format, but which are stereorandom, were tested, which have the double mutation at P9/P12 (positions 9 and 12). WV-8609, WV-8847, WV-8848, WV-8849 all had an IC50 of around 4 to 5 nM.

Several PNPLA3 oligonucleotides, some of which have an asymmetrical structure, were tested for stability in rat liver homogenate at 2 days. Numbers represent % of full-length oligonucleotide remaining; numbers are approximate.

TABLE 115A

Activity of oligonucleotides.

| WV-7805 | 58 |
| --- | --- |
| WV-8603 | 46 |
| WV-8608 | 73 |
| WV-9889 | 69 |
| WV-9890 | 76 |
| WV-8609 | 26 |
| WV-8601 | 61 |
| WV-8605 | 65 |
| WV-8606 | 105 |
| WV-9891 | 43 |
| WV-9892 | 52 |
| WV-9893 | 115 |

Several oligonucleotides were also prepared which target a mouse homolog of different gene, Factor XI (FXI or F11), and which comprised an additional component, which was a tri-, bi- or mono-antennary ligand which was either a GalNAc or a PFE ligand. These were administered to mice at 0.3, 1 or 3 mpK QDx3. Numbers below represent the mFXI/mHPRT1 mRNA level relative to control at 3 mpk. Mice were also administered oligonucleotides at 0.3 and 1 mpk (data not shown).

TABLE 115B

Activity of oligonucleotides.

| Oligonucleotide | Ligand | mFX1/mHPRT1 |
|---|---|---|
| WV-3969 | Tri-GalNAc | 23 |
| WV-5287 | Tri-PFE ligand | 22 |
| WV-7299 | Bi-GalNAc | 22 |
| WV-7300 | Bi-PFE ligand | 20 |
| WV-7297 | Mono-GalNAc | 74 |
| WV-7298 | Mono-PFE ligand | 43 |

TABLE 115C

Oligonucleotides.

| Oligo-nucleotide | Sequence | Naked Sequence | Stereo-chemistry |
|---|---|---|---|
| WV-7297 | Mod038L001Teo * Geo * Geo * Teo * Aeo * A * T * m5C * m5C * A * m5C * T * T * T * m5C * Aeo * Geo * Aeo * Geo * Geo | TGGTAA TCCACTT TCAGAGG | OXXXXXXXX XXXXXXXXX XX |
| WV-7298 | Mod039L001Teo * Geo * Geo * Teo * Aeo * A * T * m5C * m5C * A * m5C * T * T * T * m5C * Aeo * Geo * Aeo * Geo * Geo | TGGTAA TCCACTT TCAGAGG | OXXXXXXXX XXXXXXXXX XX |
| WV-7299 | Mod040L001Teo * Geo * Geo * Teo * Aeo * A * T * m5C * m5C * A * m5C * T * T * T * m5C * Aeo * Geo * Aeo * Geo * Geo | TGGTAA TCCACTT TCAGAGG | OXXXXXXXX XXXXXXXXX XX |
| WV-7300 | Mod041L001Teo * Geo * Geo * Teo * Aeo * A * T * m5C * m5C * A * m5C * T * T * T * m5C * Aeo * Geo * Aeo * Geo * Geo | TGGTAA TCCACTT TCAGAGG | OXXXXXXXX XXXXXXXXX XX |
| WV-5287 | Mod034L001Teo * Geo * Geo * Teo * Aeo * A * T * m5C * m5C * A * m5C * T * T * T * m5C * Aeo * Geo * Aeo * Geo * Geo | TGGTAA TCCACTT TCAGAGG | OXXXXXXXX XXXXXXXXX XX |

The various components (e.g., *, Mod038, etc.) in this table are the same as those in Table 1A. All of these oligonucleotides are single-stranded, though the sequences are split into multiple lines for formatting.

Various APOC3 oligonucleotides were constructed which comprise a tri-, bis- or mono-antennary ligand which is either the PFE ligand or GalNAc. Such oligonucleotides include:

TABLE 115D

Oligonucleotides.

| Oligonucleotide | Ligand |
|---|---|
| WV-6558 | Tri-GalNAc |
| WV-9542 | Tri-PFE |
| WV-9543 | Bis-GalNAc |
| WV-9544 | Bis-PFE |
| WV-9545 | Mono-GalNAc |
| WV-9546 | Mono-PFE |

| WAVE ID | Sequence | Naked Sequence | Stereo-chemistry |
|---|---|---|---|
| WV-6558 | Mod001L001Aeo * SGeom5CeoTeoTeo * RC * ST * ST * SG * RT * SC * SC * RA * SG * SC * RTeoTeoTeoAeo * STeo | AGCTTCTT GTCCAGCT TTAT | OSOOORSSS RSSRSSROO OS |
| WV-9542 | Mod083L001Aeo * SGeom5CeoTeoTeo * RC * ST * ST * SG * RT * SC * SC * RA * SG * SC * RTeoTeoTeoAeo * STeo | AGCTTCTT GTCCAGCT TTAT | OSOOORSSS RSSRSSROO OS |
| WV-9543 | Mod079L001Aeo * SGeom5CeoTeoTeo * RC * ST * ST * SG * RT * SC * SC * RA * SG * SC * RTeoTeoTeoAeo * STeo | AGCTTCTT GTCCAGCT TTAT | OSOOORSSS RSSRSSROO OS |
| WV-9544 | Mod080L001Aeo * SGeom5CeoTeoTeo * RC * ST * ST * SG * RT * SC * SC * RA * SG * SC * RTeoTeoTeoAeo * STeo | AGCTTCTT GTCCAGCT TTAT | OSOOORSSS RSSRSSROO OS |
| WV-9545 | Mod081L001Aeo * SGeom5CeoTeoTeo * RC * ST * ST * SG * RT * SC * SC * RA * SG * SC * RTeoTeoTeoAeo * STeo | AGCTTCTT GTCCAGCT TTAT | OSOOORSSS RSSRSSROO OS |
| WV-9546 | Mod082L001Aeo * SGeom5CeoTeoTeo * RC * ST * ST * SG * RT * SC * SC * RA * SG * SC * RTeoTeoTeoAeo * STeo | AGCTTCTT GTCCAGCT TTAT | OSOOORSSS RSSRSSROO OS |

The various components (e.g., *, Mod083, etc.) in this table are the same as those in Table 1A. All of these oligonucleotides are single-stranded, though the sequences are split into multiple lines for formatting.

All oligonucleotides were administered to animals at a 3 mg/kg single dose (s.c.) at day 1. In addition, WV-6558 and WV-9542 were also administered to animals at a 1 mg/kg single dose (s.c.) at day 1. Serum was collected at days 0, 8, 15, 22, 29, 36, 43, and 50. Each group contained 5 animals. PBS and WV-8877 (which targets a gene which is not APOC3) were negative controls.

Numbers indicate relative APOC3 protein level, wherein 1.00 represents 100% relative to PBS.
In various in vivo studies, including this one, tested animals were transgenic mice expressing the human APOC3 gene.

TABLE 115E

Activity of oligonucleotides

| Day | 0 | 8 | 15 | 22 | 29 | 36 | 43 | 50 |
|---|---|---|---|---|---|---|---|---|
| PBS | 1.52 | 0.95 | 1.50 | 0.56 | 0.96 | 1.07 | 1.57 | 1.74 |
|  | 0.59 | 0.73 | 0.74 | 0.87 | 0.90 | 0.90 | 0.73 | 0.71 |
|  | 1.21 | 0.99 | 1.10 | 1.34 | 0.89 | 0.82 | 0.62 | 0.78 |
|  | 0.67 | 1.14 | 0.89 | 0.99 | 0.89 | 0.86 | 0.95 | 0.86 |
|  | 1.01 | 1.20 | 0.76 | 1.24 | 1.35 | 1.36 | 1.13 | 0.91 |
| WV-8877 | 1.56 | 1.24 | 1.67 | 1.59 | 2.37 | 1.56 | 1.47 | 2.27 |
|  | 0.78 | 0.73 | 0.85 | 0.80 | 1.15 | 0.61 | 0.75 | 1.19 |
|  | 1.08 | 0.81 | 1.42 |  | 1.84 | 1.21 | 1.73 | 3.05 |
|  | 0.71 | 1.21 | 0.74 | 0.62 | 1.02 | 1.07 | 0.95 | 1.48 |
|  | 1.28 | 1.21 | 0.60 | 0.80 | 1.13 | 1.50 | 0.86 |  |
| WV-6558 | 2.74 | 0.06 | 0.05 | 0.06 | 0.11 | 0.38 | 0.69 | 1.43 |
|  | 1.15 | 0.17 | 0.05 | 0.04 | 0.09 | 0.27 | 0.01 | 0.81 |
|  | 0.38 | 0.04 | 0.05 | 0.10 | 0.18 | 0.45 | 0.53 | 1.07 |
|  | 0.44 |  |  |  |  |  |  |  |
|  | 0.41 | 0.04 | 0.04 | 0.08 | 0.09 | 0.11 | 0.13 | 0.22 |
| WV-9542 | 1.10 | 0.23 | 0.05 | 0.07 | 0.13 | 0.23 | 0.32 | 0.78 |
|  | 0.71 | 0.03 | 0.02 | 0.04 | 0.06 | 0.09 | 0.20 | 0.28 |
|  | 0.59 | 0.05 | 0.04 | 0.08 | 0.16 | 0.72 | 0.90 | 0.80 |
|  | 0.32 | 0.03 | 0.02 | 0.04 | 0.09 | 0.37 | 0.54 | 0.55 |
|  | 0.40 | 0.03 | 0.03 | 0.06 | 0.21 | 0.39 | 0.49 | 0.58 |
| WV-9543 | 0.48 | 0.03 | 0.05 | 0.09 | 0.08 | 0.21 | 0.27 | 0.49 |
|  | 1.19 | 0.06 | 0.06 | 0.09 | 0.06 | 0.09 | 0.57 | 0.96 |
|  | 0.79 | 0.05 | 0.04 | 0.17 | 0.06 | 0.15 | 0.42 | 0.80 |
|  | 0.79 | 0.09 | 0.03 | 0.28 | 0.20 | 0.17 | 0.28 | 0.59 |
|  | 0.48 | 0.04 | 0.02 | 0.08 | 0.06 | 0.12 | 0.17 | 0.32 |
| WV-9544 | 0.91 |  | 0.04 | 0.06 | 0.06 | 0.19 | 0.26 | 0.67 |
|  | 0.94 | 0.10 | 0.03 | 0.08 | 0.09 | 0.15 | 0.34 | 0.76 |
|  | 1.72 | 0.19 | 0.04 | 0.07 | 0.09 | 0.25 | 0.60 | 0.83 |
|  | 1.92 | 0.28 | 0.07 | 0.10 | 0.11 | 0.13 | 0.26 | 0.56 |
|  | 0.81 | 0.04 | 0.05 | 0.11 | 0.12 | 0.20 | 0.32 | 0.73 |
| WV-9545 | 0.49 | 0.03 | 0.07 | 0.16 | 0.21 | 0.32 | 0.66 | 0.60 |
|  | 1.14 | 0.22 | 0.04 | 0.10 | 0.15 | 0.58 | 0.76 | 0.97 |
|  | 0.58 | 0.03 | 0.04 | 0.15 | 0.27 | 0.67 | 1.16 | 0.97 |
|  | 0.64 | 0.03 | 0.04 | 0.19 | 0.42 | 0.98 | 1.38 | 0.96 |
|  | 0.60 | 0.05 | 0.03 | 0.08 |  |  |  |  |
| WV-9546 | 3.33 | 0.20 | 0.06 | 0.27 | 0.24 | 0.49 | 1.13 | 1.31 |
|  | 1.03 | 0.11 | 0.04 | 0.09 | 0.14 | 0.46 | 0.55 | 0.68 |
|  | 1.20 | 0.28 | 0.12 | 0.20 | 0.31 | 0.95 | 1.75 | 1.39 |
|  | 0.71 | 0.15 | 0.04 | 0.19 | 0.39 | 0.26 | 0.75 | 0.36 |
|  | 0.18 | 0.04 | 0.02 | 0.20 | 0.28 | 0.21 | 0.56 | 0.56 |

Oligonucleotide accumulation in the liver was also analyzed after a single 3 mg/kg dose, 30 min. Numbers indicate pg of oligonucleotide/g of tissue. Tested animals were transgenic mice expressing the human APOC3 gene.

TABLE 115F

Part I. Oligonucleotide accumulation in the liver

| PBS | WV-6558 | WV-9542 | WV-9543 | WV-9544 | WV-9545 | WV-9546 |
|---|---|---|---|---|---|---|
| 0 | 2.95 | 1.73 | 3.52 | 3.82 | 2.02 | 4.27 |
| 0 | 2.46 | 1.69 | 2.49 | 4.19 | 1.99 | 1.37 |
| 0 | 2.48 | 0.45 | 1.14 | 2.74 | 1.30 | 1.29 |
| 0 | 1.85 | 1.09 | 2.12 | 2.26 | 1.14 | 1.25 |
| 0 | 1.79 | 1.43 | 4.26 | 1.88 | 1.07 | 0.82 |

In the same experiment: Oligonucleotide accumulation in the liver was also analyzed for WV-6558 and WV-9542 after a single 1 mg/kg dose, 30 min. Numbers indicate pg of oligonucleotide/g of tissue.

| PBS | WV-6558 1 mpk | WV-9542 1 mpk |
|---|---|---|
| 0 | 1.92 | 0.46 |
| 0 | 1.77 | 1.08 |
| 0 | 1.43 | 0.56 |
| 0 | 0.68 | 0.30 |
| 0 | 0.18 | 0.67 |

Oligonucleotide accumulation in the liver was also analyzed after a single 3 mg/kg dose, 8 days. Numbers indicate pg of oligonucleotide/g of tissue. Tested animals were transgenic mice expressing the human APOC3 gene.

TABLE 115F

Part II. Oligonucleotide accumulation in the liver

| PBS | WV-6558 | WV-9542 | WV-9543 | WV-9544 | WV-9545 | WV-9546 |
|---|---|---|---|---|---|---|
| 0 | 3.30 | 2.93 | 6.83 | 4.56 | 3.55 | 3.83 |
| 0 | 3.49 | 2.20 | 6.56 | 4.45 | 2.23 | 4.05 |

TABLE 115F-continued

Part II. Oligonucleotide accumulation in the liver

| PBS | WV-6558 | WV-9542 | WV-9543 | WV-9544 | WV-9545 | WV-9546 |
|---|---|---|---|---|---|---|
| 0 | 3.18 | 1.34 | 4.58 | 2.72 | 1.94 | 2.28 |
| 0 | 2.41 | 1.61 | 3.87 | 2.31 | 3.03 | 2.12 |
| 0 | 1.43 | 2.90 | 4.10 | 2.36 | 1.85 | 3.50 |

In the same experiment: Oligonucleotide accumulation in the liver was also analyzed for WV-6558 and WV-9542 after a single 1 mg/kg (1 mpk) dose, 8 days. Numbers indicate ug of oligonucleotide/g of tissue.

| PBS | WV-6558 1 mpk | WV-9542 1 mpk |
|---|---|---|
| 0 | 0.72 | 1.08 |
| 0 | 0.74 | 1.20 |
| 0 | 0.60 | 0.75 |
| 0 | 0.55 | 0.57 |
| 0 | 0.63 | 0.63 |

The data show the efficacy of various ligands conjugated to APOC3 oligonucleotides; these same ligands can also be conjugated onto PNPLA3 oligonucleotides.

Various PNPLA3 RNAi agents were tested for stability in rat liver homogenate. Numbers represent percent of full-length oligonucleotide remaining at 5 days; oligonucleotides were also tested at 2 days (data not shown); and numbers are approximate. Some oligonucleotides comprise a 5'-DNA-T and some oligonucleotides comprise a 5'-Rc-Me-T.

TABLE 116

Activity of oligonucleotides.

| | |
|---|---|
| WV-8095 | 62 |
| WV-9495 | 61 |
| WV-9499 | 86 |
| WV-8701 | 49 |
| WV-9496 | 71 |
| WV-9500 | 99 |

Various PNPLA3 oligonucleotides were also tested for efficacy with an additional component which is a tri-antennary GalNAc conjugate. Oligonucleotides were tested in vitro on Huh7-148 OE cells (which comprise the mutant allele of PNPLA3) at 10 nM. Numbers represent PNPLA3 mRNA levels (PNPLA3/HPRT1), and numbers are approximate. In many cases, the oligonucleotides did not demonstrate significant knockdown of wild-type PNPLA3 in cynomolgus (non-human primate or NHP) hepatocytes. For example, WV-8132, WV-8600, WV-9868 and WV-9860 did not demonstrate significant knockdown of wild-type PNPLA3 in cynomolgus (non-human primate or NHP) hepatocytes when tested at up to 10 nM (data not shown).

Various PNPLA3 oligonucleotides were tested in vitro in cells after treatment with oligonucleotide. In this table, 100.00 would represent 100% PNPLA3 mRNA level and 0.00 would represent 0% PNPLA3 mRNA after treatment with oligonucleotides.

TABLE 118

Activity of oligonucleotides.

| Negative control | 100 | Negative control | 100 |
|---|---|---|---|
| WV-993 | 117 | WV-993 | 117 |
| WV-7805 | 20 | WV-8600 | 47 |
| WV-8132 | 54 | WV-8564 | 47 |
| WV-8566 | 67 | WV-8596 | 62 |
| WV-8599 | 82 | WV-8597 | 38 |
| WV-9859 | 56 | | |
| WV-9670 | 57 | | |
| WV-993 | 117 | WV-993 | 117 |
| WV-9868 | 48 | WV-9860 | 65 |
| WV-9869 | 50 | WV-9861 | 58 |
| WV-9870 | 53 | WV-9862 | 62 |

Various PNPLA3 oligonucleotides were tested in vitro in an RNaseH assay.

PNPLA3 oligonucleotides were incubated in the presence of target RNA which was the wt allele (WV-8808) or the 148 allele (WV-8807). Numbers represent the percentage of target RNA (WV-8808 or WV-8807) remaining. In this table, 100.00 would represent 100% PNPLA3 mRNA level and 0.00 would represent 0% PNPLA3 mRNA after treatment with oligonucleotides.

TABLE 119

Activity of oligonucleotides.

| Time (mins) | 0 | 5 | 10 | 15 | 20 | 30 | 45 | 60 |
|---|---|---|---|---|---|---|---|---|
| WV-7805 + WV-8807 | 100.0 | 94.1 | 93.4 | 88.6 | 90.6 | 82.8 | 74.5 | 73.4 |
| WV-8603 + WV-8807 | 100.0 | 93.1 | 89.7 | 84.4 | 91.0 | 82.4 | 73.0 | 66.4 |
| WV-8608 + WV-8807 | 100.0 | 95.4 | 92.2 | 89.8 | 87.4 | 81.4 | 79.7 | 72.1 |
| WV-9889 + WV-8807 | 100.0 | 90.9 | 87.7 | 81.9 | 85.7 | 74.4 | 72.9 | 66.4 |
| WV-9890 + WV-8807 | 100.0 | 92.7 | 89.6 | 85.4 | 88.7 | 77.0 | 75.8 | 66.8 |
| WV-7805 + WV-8808 | 100.0 | 99.5 | 97.7 | 98.1 | 96.9 | 96.2 | 95.6 | 93.4 |
| WV-8603 + WV-8808 | 100.0 | 102.2 | 99.4 | 100.3 | 99.1 | 98.5 | 99.2 | 95.6 |
| WV-8608 + WV-8808 | 100.0 | 98.8 | 97.5 | 96.9 | 95.9 | 96.9 | 95.5 | 94.1 |
| WV-9889 + WV-8808 | 100.0 | 99.9 | 99.2 | 99.5 | 98.6 | 97.8 | 97.2 | 96.3 |
| WV-9890 + WV-8808 | 100.0 | 107.5 | 100.7 | 100.8 | 99.1 | 104.2 | 98.3 | 97.5 |
| WV-8601 + WV-8807 | 100.0 | 93.1 | 90.9 | 90.4 | 91.4 | 88.2 | 85.6 | 80.1 |
| WV-8605 + WV-8807 | 100.0 | 98.3 | 96.0 | 96.4 | 96.0 | 96.0 | 87.1 | 86.7 |
| WV-8606 + WV-8807 | 100.0 | 90.1 | 91.6 | 90.7 | 90.9 | 86.6 | 82.4 | 79.1 |
| WV-8609 + WV-8807 | 100.0 | 92.1 | 89.0 | 83.8 | 85.5 | 75.6 | 75.7 | 69.0 |
| WV-8601 + WV-8808 | 100.0 | 99.0 | 100.2 | 100.2 | 97.8 | 97.6 | 97.2 | 94.1 |
| WV-8605 + WV-8808 | 100.0 | 100.7 | 99.7 | 100.9 | 98.4 | 99.1 | 98.5 | 94.6 |
| WV-8606 + WV-8808 | 100.0 | 101.2 | 97.6 | 98.1 | 96.3 | 97.0 | 96.5 | 93.9 |
| WV-8609 + WV-8808 | 100.0 | 96.7 | 93.7 | 98.6 | 96.8 | 95.6 | 96.2 | 94.5 |
| WV-9891 + WV-8807 | 100.0 | 91.6 | 88.3 | 86.1 | 87.9 | 79.8 | 75.6 | 75.2 |
| WV-9892 + WV-8807 | 100.0 | 93.2 | 86.9 | 83.5 | 84.3 | 74.2 | 64.2 | 58.6 |

TABLE 119-continued

Activity of oligonucleotides.

| Time (mins) | 0 | 5 | 10 | 15 | 20 | 30 | 45 | 60 |
|---|---|---|---|---|---|---|---|---|
| WV-9893 + WV-8807 | 100.0 | 94.6 | 88.6 | 86.6 | 88.6 | 77.4 | 69.0 | 65.6 |
| WV-9891 + WV-8808 | 100.0 | 98.3 | 98.6 | 96.9 | 95.0 | 94.2 | 92.8 | 89.8 |
| WV-9892 + WV-8808 | 100.0 | 100.7 | 101.8 | 100.7 | 99.3 | 97.9 | 97.4 | 95.7 |
| WV-9893 + WV-8808 | 100.0 | 100.1 | 100.3 | 100.2 | 99.3 | 96.3 | 96.1 | 93.5 |
| WV-9894 + WV-8807 | 100.0 | 96.2 | 90.1 | 85.1 | 84.7 | 79.5 | 76.8 | 74.9 |
| WV-9895 + WV-8807 | 100.0 | 97.0 | 92.5 | 87.1 | 84.3 | 77.0 | 71.8 | 70.7 |
| WV-9896 + WV-8807 | 100.0 | 98.2 | 93.2 | 86.0 | 81.8 | 74.8 | 69.2 | 70.0 |
| WV-9894 + WV-8808 | 100.0 | 98.8 | 97.1 | 97.4 | 96.1 | 94.0 | 95.4 | 91.4 |
| WV-9895 + WV-8808 | 100.0 | 99.9 | 97.1 | 98.5 | 99.3 | 96.1 | 96.4 | 93.6 |
| WV-9896 + WV-8808 | 100.0 | 99.2 | 99.0 | 98.3 | 96.4 | 95.6 | 93.8 | 90.6 |

The PNPLA3 oligonucleotides WV-980, WV-9893, WV-8606 and WV-7805 also significantly reduced PNPLA3 148 mutant mRNA levels in Huh7 cells with PNLA3 148 mutation (to between about 25 to 55% residual mutant PNPLA3, relative to HPRT1, at 12.5 nM), but these oligonucleotides did not significantly reduce wt PNPLA3 levels in Huh7 cells with wt PNPLA3 (about 90% or more residual wt PNPLA3 level at 12.5 nM).

Various PNPLA3 oligonucleotides were tested in vitro in Hep3B cells at 48 hours after treatment with oligonucleotide. In this table, 1.00 would represent 100% PNPLA3 mRNA level and 0.00 would represent 0% PNPLA3 mRNA after treatment with oligonucleotides.

TABLE 120

Activity of oligonucleotides.

| Conc. (nM) (exp 10) | 1.398 | 0.796 | 0.194 | −0.408 | −1.010 | −1.612 | −2.214 | −2.816 |
|---|---|---|---|---|---|---|---|---|
| WV-3380 | 0.059 | 0.193 | 0.568 | 0.809 | 0.809 | 0.917 | 1.032 | 0.983 |
|  | 0.092 | 0.365 | 0.720 | 0.862 |  | 1.004 | 1.121 |  |
| WV-3986 | 0.379 | 0.444 | 0.673 | 0.790 | 0.870 | 0.870 | 0.993 | 0.933 |
|  | 0.486 | 0.551 | 0.752 | 0.901 | 1.007 | 0.939 | 0.876 | 1.140 |
| WV-3987 | 0.400 | 0.521 | 0.742 | 0.870 | 0.959 | 0.889 | 0.986 | 0.952 |
|  | 0.451 | 0.594 | 0.914 | 0.966 | 1.086 | 0.972 | 1.021 | 1.072 |
| WV-3988 | 0.496 | 0.521 | 0.742 | 1.021 | 0.946 | 1.079 | 0.907 | 0.959 |
|  | 0.328 | 0.615 | 0.920 | 1.057 | 1.064 | 0.979 | 0.901 | 1.133 |
| WV-3393 | 0.115 | 0.165 | 0.438 | 0.795 | 0.882 | 1.028 | 1.086 | 0.986 |
|  | 0.080 | 0.218 | 0.555 | 0.835 | 0.952 | 1.064 | 0.933 | 1.057 |
| WV-3989 | 0.316 | 0.279 | 0.547 | 0.790 | 0.852 | 0.993 | 0.966 | 1.000 |
|  | 0.295 | 0.412 | 0.651 | 0.889 | 1.049 | 1.140 | 0.986 | 1.173 |
| WV-3990 | 0.259 | 0.444 | 0.624 | 0.979 | 1.109 | 1.021 | 1.007 | 0.993 |
|  | 0.274 | 0.559 | 0.779 | 0.959 | 1.079 | 1.042 | 1.049 | 1.164 |

Various PNPLA3 oligonucleotides were tested in vitro in Hep3B cells at 48 hours after treatment with oligonucleotide. In this table, 1.00 would represent 100% PNPLA3 mRNA level and 0.00 would represent 0% PNPLA3 mRNA after treatment with oligonucleotides.

TABLE 121

Activity of oligonucleotides.

| Conc. (nM) (exp 10) | 1.398 | 0.796 | 0.194 | −0.408 | −1.010 | −1.612 | −2.214 | −2.816 |
|---|---|---|---|---|---|---|---|---|
| WV-3402 | 0.146 | 0.207 | 0.457 | 0.907 | 0.933 | 0.959 | 0.939 | 0.952 |
|  | 0.104 | 0.319 | 0.697 | 0.914 | 0.926 | 1.028 | 1.094 | 1.102 |
| WV-3991 | 0.216 | 0.423 | 0.582 | 0.858 | 0.907 | 0.966 | 0.870 | 0.966 |
|  | 0.303 | 0.500 | 0.722 | 1.049 | 0.895 | 0.979 | 1.042 | 1.035 |
| WV-3992 | 0.303 | 0.384 | 0.594 | 0.823 | 0.818 | 0.907 | 0.847 | 0.852 |
|  | 0.321 | 0.423 | 0.673 | 0.914 | 0.933 | 0.907 | 0.959 | 1.057 |

Various PNPLA3 oligonucleotides were tested in vitro in Hep3B cells at 48 hours after treatment with oligonucleotide. In this table, 1.00 would represent 100% PNPLA3 mRNA level and 0.00 would represent 0% PNPLA3 mRNA after treatment with oligonucleotides.

TABLE 122

Activity of oligonucleotides.

| Conc. (nM) (exp 10) | 1.398 | 0.796 | 0.194 | −0.408 | −1.010 | −1.612 | −2.214 | −2.816 |
|---|---|---|---|---|---|---|---|---|
| WV-3387 | 0.091 | 0.205 | 0.527 | 0.811 | 1.070 | 0.881 | 0.977 | 0.971 |
|  | 0.081 | 0.135 | 0.391 | 0.851 | 1.033 | 0.964 | 0.944 | 1.070 |
| WV-3993 | 0.998 | 0.912 | 1.026 | 1.062 | 1.308 | 1.019 | 1.019 | 0.957 |
|  | 0.869 | 0.912 | 1.123 | 1.077 | 1.084 | 1.048 | 1.055 | 1.100 |
| WV-3994 | 0.944 | 0.991 | 1.195 | 1.040 | 1.107 | 1.012 | 1.123 | 0.971 |
|  | 0.857 | 0.991 | 1.146 | 1.077 | 1.092 | 1.138 | 1.033 | 1.154 |

Various PNPLA3 oligonucleotides were tested in vitro in Hep3B cells at 48 hours after treatment with oligonucleotide. In this table, 1.00 would represent 100% PNPLA3 mRNA level and 0.00 would represent 0% PNPLA3 mRNA after treatment with oligonucleotides.

TABLE 123

Activity of oligonucleotides.

| Conc. (nM) (exp 10) | 1.398 | 0.796 | 0.194 | −0.408 | −1.010 | −1.612 | −2.214 | −2.816 |
|---|---|---|---|---|---|---|---|---|
| WV-3391 | 0.176 | 0.264 | 0.502 | 0.912 | 0.944 | 1.170 | 1.077 | 0.887 |
|  | 0.141 | 0.230 | 0.531 | 0.788 | 1.040 | 1.146 | 1.005 | 1.005 |
| WV-3995 | 0.925 | 1.026 | 0.977 | 1.131 | 1.162 | 0.984 | 1.123 | 0.811 |
|  | 0.751 | 0.957 |  | 1.123 |  | 1.162 | 1.062 | 0.971 |
| WV-3996 | 0.893 | 0.899 | 0.833 | 0.991 | 1.203 | 1.146 | 1.138 | 0.964 |
|  | 0.875 | 0.899 | 0.851 | 1.187 |  | 1.123 | 1.040 | 1.131 |

Various PNPLA3 oligonucleotides were tested in vitro in cells after treatment with oligonucleotide. In this table, 100.00 would represent 100% PNPLA3 mRNA level and 0.00 would represent 0% PNPLA3 mRNA after treatment with oligonucleotides.

TABLE 124

Activity of oligonucleotides.

|  | 0.312 nM | | 1.25 nM | | 5 nM | |
|---|---|---|---|---|---|---|
| Control | 76.5 | 84.9 | 111.7 | 106.6 | 113.9 | 99.1 |
| WV-3380 | 86.7 | 79.0 | 58.4 | 60.3 | 27.2 | 28.6 |
| wv-4054 | 60.3 | 49.1 | 67.6 | 53.4 | 65.5 | 45.5 |
| wv-4098 | 62.0 | 43.3 | 57.7 | 50.9 | 38.5 | 52.8 |
| WV-6585 | 58.8 | 56.9 | 71.3 | 90.8 | 89.4 | 79.0 |
| WV-6586 | 82.1 | 53.7 | 82.5 | 79.5 | 89.0 | 66.2 |
| WV-6587 | 49.9 | 45.3 | 103.1 | 56.0 | 74.7 | 77.9 |
| WV-6588 | 58.6 | 60.9 | 82.1 | 84.9 | 86.5 | 85.3 |
| WV-6589 | 61.8 | 51.3 | 92.2 | 94.4 | 77.8 | 83.5 |
| WV-6590 | 63.7 | 64.3 | 62.9 | 83.9 | 85.5 | 60.8 |
| WV-6591 | 83.3 | 71.4 | 74.7 | 75.2 | 76.3 | 94.2 |
| WV-6592 | 49.7 | 39.8 | 51.4 | 40.4 | 54.3 | 39.4 |
| WV-6593 | 68.1 | 77.7 | 58.3 | 89.3 | 64.6 | 70.7 |
| WV-6594 | 82.1 | 53.7 | 58.7 | 59.1 | 61.6 | 62.2 |
| WV-4054 | 58.7 | 35.6 | 55.3 | 49.8 | 66.0 | 60.3 |
| WV-6595 | 40.9 | 52.4 | 58.0 | 54.5 | 60.5 | 56.2 |
| WV-6596 | 48.6 | 40.2 | 57.2 | 49.4 | 46.9 | 49.2 |
| WV-6597 | 27.7 | 31.4 | 41.8 | 52.7 | 61.3 | 45.0 |
| WV-6598 | 40.1 | 35.4 | 59.1 | 53.6 | 44.5 | 42.3 |
| WV-6599 | 37.3 | 54.3 | 73.0 | 61.8 | 76.6 | 69.6 |
| WV-6600 | 64.7 | 67.5 | 88.7 | 105.6 | 95.3 | 115.7 |

TABLE 124-continued

Activity of oligonucleotides.

|  | 0.312 nM | | 1.25 nM | | 5 nM | |
|---|---|---|---|---|---|---|
| WV-6601 | 74.2 | 48.0 | 64.4 | 51.4 | 97.0 | 81.9 |
| WV-6602 | 64.7 | 51.6 | 64.0 | 63.3 | 95.8 | 64.1 |
| WV-6603 | 57.8 | 40.4 | 85.7 | 73.9 | 67.1 | 71.1 |
| WV-6604 | 50.7 | 50.5 | 57.8 | 47.0 | 72.0 | 47.1 |
| WV-6605 | 52.1 | 52.5 | 58.2 | 57.8 | 58.9 | 57.8 |
| WV-6606 | 27.1 | 56.6 | 52.4 | 51.1 | 77.7 | 53.9 |
| WV-6607 | 35.7 | 41.6 | 44.0 | 37.0 | 76.2 | 53.7 |

Various PNPLA3 oligonucleotides were tested in vitro in cells after treatment with oligonucleotide. In this table, 100.00 would represent 100% PNPLA3 mRNA level and 0.00 would represent 0% PNPLA3 mRNA after treatment with oligonucleotides.

TABLE 125

Activity of oligonucleotides.

|  | 0.312 nM | | 1.25 nM | | 5 nM | |
|---|---|---|---|---|---|---|
| Control | 76.5 | 84.9 | 111.7 | 106.6 | 113.9 | 99.1 |
| WV-3380 | 86.7 | 79.0 | 58.4 | 60.3 | 27.2 | 28.6 |
| wv-4054 | 60.3 | 49.1 | 67.6 | 53.4 | 65.5 | 45.5 |
| wv-4098 | 62.0 | 43.3 | 57.7 | 50.9 | 38.5 | 52.8 |
| WV-6608 | 74.0 | 71.3 | 64.3 | 80.2 | 90.8 | 81.4 |
| WV-6609 | 88.6 | 51.9 | 71.6 | 57.7 | 66.3 | 61.2 |

TABLE 125-continued

Activity of oligonucleotides.

| | 0.312 nM | | 1.25 nM | | 5 nM | |
|---|---|---|---|---|---|---|
| WV-6610 | 51.1 | 59.5 | 65.1 | 51.7 | 61.2 | 60.6 |
| WV-6611 | 40.9 | 47.5 | 61.7 | 57.3 | 63.2 | 75.1 |
| WV-6612 | 50.9 | 59.8 | 50.6 | 53.3 | 75.4 | 54.3 |
| WV-6613 | 39.0 | 49.1 | 49.5 | 35.6 | 53.8 | 43.5 |
| WV-6614 | 51.6 | 65.2 | 43.6 | 59.6 | 47.8 | 67.1 |
| WV-6615 | 45.7 | 70.0 | 40.0 | 41.6 | 44.1 | 53.2 |
| WV-5305 | 61.4 | 82.3 | 73.1 | 100.3 | 83.3 | 101.0 |
| WV-6616 | 63.6 | 49.3 | 67.0 | 74.3 | 62.0 | 70.1 |
| WV-6617 | 67.5 | 45.2 | 44.0 | 54.6 | 54.9 | 59.2 |
| WV-6618 | 53.4 | 44.2 | 45.4 | 46.4 | 66.5 | 32.9 |
| WV-6619 | 56.7 | 28.9 | 64.4 | 50.3 | 49.7 | 42.9 |
| WV-6620 | 61.8 | 55.6 | 57.8 | 90.1 | 37.8 | 52.5 |
| WV-6621 | 63.3 | 51.1 | 55.0 | 73.3 | 31.4 | 54.7 |
| WV-6622 | 67.5 | 34.7 | 55.2 | 48.0 | 27.4 | 61.7 |
| WV-6623 | 57.1 | 56.5 | 73.3 | 88.7 | 78.4 | 95.9 |

Various PNPLA3 oligonucleotides were tested in vitro in cells after treatment with oligonucleotide. In this table, 100.00 would represent 100% PNPLA3 mRNA level and 0.00 would represent 0% PNPLA3 mRNA after treatment with oligonucleotides.

TABLE 126

Activity of oligonucleotides.

| | 0.312 nM | | 1.25 nM | | 5 nM | |
|---|---|---|---|---|---|---|
| Control | 76.5 | 84.9 | 111.7 | 106.6 | 113.9 | 99.1 |
| WV-3380 | 86.7 | 79.0 | 58.4 | 60.3 | 27.2 | 28.6 |
| wv-4054 | 60.3 | 49.1 | 67.6 | 53.4 | 65.5 | 45.5 |
| wv-4098 | 62.0 | 43.3 | 57.7 | 50.9 | 38.5 | 52.8 |
| WV-6624 | 59.2 | 71.5 | 52.2 | 78.3 | 64.7 | 59.0 |
| WV-6625 | 53.7 | 50.7 | 49.4 | 41.9 | 53.1 | 51.1 |
| WV-6626 | 62.3 | 58.2 | 65.0 | 70.4 | 39.7 | 53.9 |
| WV-6627 | 57.5 | 51.1 | 66.9 | 59.1 | 49.2 | 52.9 |
| WV-6628 | 44.8 | 48.6 | 61.5 | 59.8 | 50.4 | 63.3 |
| WV-6629 | 61.4 | 54.4 | 59.5 | 86.7 | 52.5 | 58.3 |
| WV-6630 | 40.8 | 54.1 | 44.5 | 46.3 | 56.3 | 54.3 |
| WV-6631 | 61.0 | 61.4 | 47.6 | 111.2 | 75.1 | 70.1 |
| WV-6632 | 67.5 | 96.3 | 93.1 | 79.0 | 84.8 | 86.5 |
| WV-6633 | 61.1 | 56.4 | 51.8 | 37.1 | 40.6 | 46.0 |
| WV-6634 | 66.7 | 65.7 | 52.8 | 51.9 | 39.1 | 39.0 |
| WV-6635 | 90.3 | 63.6 | 72.6 | 68.6 | 66.7 | 70.6 |
| WV-6636 | 68.0 | 40.3 | 57.7 | 55.9 | 45.1 | 50.6 |
| WV-6637 | 68.0 | 46.2 | 46.9 | 60.4 | 40.2 | 69.4 |
| WV-6638 | 46.2 | 38.0 | 64.8 | 41.3 | 40.3 | 32.9 |

Various PNPLA3 oligonucleotides were tested in vitro in cells after treatment with oligonucleotide. In this table, 100.00 would represent 100% PNPLA3 mRNA level and 0.00 would represent 0% PNPLA3 mRNA after treatment with oligonucleotides.

TABLE 127

Activity of oligonucleotides.

| | 0.312 nM | | 1.25 nM | | 5 nM | |
|---|---|---|---|---|---|---|
| Control | 76.5 | 84.9 | 111.7 | 106.6 | 113.9 | 99.1 |
| WV-3380 | 86.7 | 79.0 | 58.4 | 60.3 | 27.2 | 28.6 |
| wv-4054 | 60.3 | 49.1 | 67.6 | 53.4 | 65.5 | 45.5 |
| wv-4098 | 62.0 | 43.3 | 57.7 | 50.9 | 38.5 | 52.8 |
| WV-6639 | 94.8 | 81.0 | 113.1 | 90.2 | 68.5 | 69.4 |
| WV-6640 | 91.3 | 78.0 | 60.4 | 87.5 | 87.7 | 61.7 |
| WV-6641 | 76.4 | 113.6 | 83.1 | 87.6 | 59.6 | 65.0 |
| WV-6642 | 95.0 | 104.3 | 90.6 | 98.5 | 74.8 | 73.5 |
| WV-6643 | 126.6 | 90.1 | 96.8 | 77.1 | 60.0 | 75.3 |
| WV-6644 | 125.8 | 94.5 | 89.9 | 85.1 | 81.4 | 63.5 |
| WV-6645 | 93.1 | 74.3 | 97.7 | 66.4 | 68.9 | 40.8 |

TABLE 127-continued

Activity of oligonucleotides.

| | 0.312 nM | | 1.25 nM | | 5 nM | |
|---|---|---|---|---|---|---|
| WV-6646 | 83.5 | 80.4 | 85.1 | 60.9 | 56.7 | 33.7 |
| WV-6647 | 92.9 | 77.8 | 91.8 | 79.8 | 125.9 | 62.3 |
| WV-6648 | 104.4 | 88.7 | 92.0 | 111.5 | 67.3 | 73.3 |
| WV-6649 | 106.9 | 85.8 | 79.7 | 85.5 | 78.4 | 74.5 |
| WV-6650 | 94.6 | 79.2 | 87.4 | 91.5 | 66.5 | 97.9 |
| WV-6651 | 116.4 | 74.8 | 92.2 | 96.8 | 58.0 | 57.3 |
| WV-6652 | 114.1 | 70.2 | 110.9 | 94.0 | 88.6 | 66.4 |
| WV-6653 | 116.1 | 89.1 | 90.0 | 100.0 | 77.3 | 72.9 |
| WV-6654 | 84.9 | 99.0 | 101.1 | 128.1 | 67.4 | 70.9 |
| WV-6655 | 102.0 | 99.5 | 116.9 | 83.8 | 114.7 | 85.6 |
| WV-6656 | 115.3 | 119.9 | 114.7 | 85.2 | 101.0 | 108.4 |
| WV-6657 | 88.6 | 94.1 | 114.1 | 109.7 | 94.6 | 100.4 |
| WV-6658 | 114.4 | 92.2 | 131.2 | 134.7 | 133.3 | 90.6 |
| WV-6659 | 116.9 | 104.2 | 122.1 | 96.6 | 99.8 | 122.3 |
| WV-6660 | 104.7 | 79.5 | 124.1 | 100.2 | 79.7 | 88.5 |

Various PNPLA3 oligonucleotides were tested in vitro in cells after treatment with oligonucleotide. In this table, 100.00 would represent 100% PNPLA3 mRNA level and 0.00 would represent 0% PNPLA3 mRNA after treatment with oligonucleotides.

TABLE 129

Activity of oligonucleotides.

| | 0 | 0.1 nM | 0.4 nM | 3.0 nM | 12.5 nM |
|---|---|---|---|---|---|
| WV-4098 | 96.1 | 76.8 | 61.7 | 58.2 | 53.6 |
| | 105.7 | 73.2 | 58.3 | 47.9 | 57.9 |
| WV-7776 | 107.4 | 92.5 | 117.0 | 85.0 | 74.7 |
| | 85.4 | 93.1 | 102.7 | 73.4 | 62.5 |
| WV-7777 | 107.4 | 107.4 | 88.2 | 63.2 | 71.7 |
| | 90.9 | 90.9 | 73.4 | 73.1 | 59.8 |

Various PNPLA3 oligonucleotides were tested in vitro in Huh7 cells. Residual levels of PNPLA3 mRNA are shown, wherein PNPLA3 is relative to HPRT1. In this table, 100.00 would represent 100% PNPLA3 mRNA level and 0.00 would represent 0% PNPLA3 mRNA after treatment with oligonucleotides.

TABLE 130

Activity of oligonucleotides.

| | WV-4098 | WV-7465 | WV-8076 |
|---|---|---|---|
| 0 | 103.4 | 112.5 | 101.0 |
| | 86.2 | 95.5 | 109.7 |
| 0.02 nM | 82.5 | 62.8 | 67.2 |
| | 91.2 | 61.6 | 79.1 |
| 0.1 nM | 54.4 | 39.5 | 46.5 |
| | 56.3 | 48.4 | 72.2 |
| 0.4 nM | 49.6 | 31.2 | 46.6 |
| | 48.1 | 42.7 | 43.9 |
| 3.125 nM | 21.9 | 39.2 | 82.0 |
| | 33.7 | 37.1 | 79.7 |

Various PNPLA3 oligonucleotides were tested in vitro in Huh7 cells. Residual levels of PNPLA3 mRNA are shown, wherein PNPLA3 is relative to HPRT1. In this table, 100.00 would represent 100% PNPLA3 mRNA level and 0.00 would represent 0% PNPLA3 mRNA after treatment with oligonucleotides.

TABLE 131

Activity of oligonucleotides.

| | WV-4098 | WV-8080 | WV-8081 |
|---|---|---|---|
| 0 | 103.4 | 83.3 | 79.2 |
| | 86.2 | 109.8 | 89.9 |
| 0.02 nM | 82.5 | 58.1 | 97.2 |
| | 91.2 | 89.1 | 92.4 |
| 0.1 nM | 54.4 | 71.2 | 91.7 |
| | 56.3 | 72.1 | 95.5 |
| 0.4 nM | 49.6 | 79.8 | 94.4 |
| | 48.1 | 97.9 | 108.2 |
| 3.125 nM | 21.9 | 59.3 | 115.6 |
| | 33.7 | 62.0 | 122.4 |

Various PNPLA3 oligonucleotides were tested in vitro in Huh7 cells. Residual levels of PNPLA3 mRNA are shown, wherein PNPLA3 is relative to HPRT1. In this table, 100.00 would represent 100% PNPLA3 mRNA level and 0.00 would represent 0% PNPLA3 mRNA after treatment with oligonucleotides.

TABLE 132

Activity of oligonucleotides.

| | WV-4098 | WV-8077 | WV-8078 | WV-8079 |
|---|---|---|---|---|
| 0 | 103.4 | 108.4 | 94.0 | 80.9 |
| | 86.2 | 107.6 | 98.3 | 87.7 |
| 0.02 nM | 82.5 | 102.1 | 96.4 | 71.1 |
| | 91.2 | | 99.8 | 69.3 |
| 0.1 nM | 54.4 | 87.6 | 93.9 | 75.6 |
| | 56.3 | 87.9 | 118.3 | 97.5 |
| 0.4 nM | 49.6 | 83.4 | 91.0 | 88.6 |
| | 48.1 | 97.1 | 116.6 | 120.6 |
| 3.125 nM | 21.9 | 79.8 | 73.7 | 105.4 |
| | 33.7 | 74.8 | 87.7 | |

Various PNPLA3 oligonucleotides were tested in Huh7 cells. Residual levels of PNPLA3 mRNA are shown, wherein PNPLA3 is relative to HPRT1. In this table, 100.00 would represent 100% PNPLA3 mRNA level and 0.00 would represent 0% PNPLA3 mRNA after treatment with oligonucleotides.

TABLE 133

Activity of oligonucleotides.

| | WV-4098 | WV-7465 |
|---|---|---|
| 0 | 103.4 | 112.5 |
| | 86.2 | 95.5 |
| 0.02 nM | 82.5 | 62.8 |
| | 91.2 | 61.6 |
| 0.1 nM | 54.4 | 39.5 |
| | 56.3 | 48.4 |
| 0.4 nM | 49.6 | 31.2 |
| | 48.1 | 42.7 |
| 3.125 nM | 21.9 | 39.2 |
| | 33.7 | 37.1 |

Several PNPLA3 oligonucleotides were also tested in vitro for cytokine release, including WV-8061, WV-8291, WV-8698, and WV-8700. None of the 4 PNPLA3 ssRNAi agents induced cytokine release (IL-1β, IL-6, MCP-1, IL-12p40, IL-12p70, IL-1α, MIP-1 α, MIP-1β, TNFα) in any of the donor samples. In contrast, positive control induced cytokine activation even at low concentrations (0.78 ug/ml).

Example 27. Example Additional Components of Oligonucleotides

Various oligonucleotides were designed and constructed which comprise various additional components. Various additional PNPLA3 oligonucleotides described herein can also be conjugated to these additional components.

These additional components include those listed herein: Tri-antennary ligand is also known as Tri-PFE ASPGR ligand or Tri-PFE ligand or Tri-PFE:

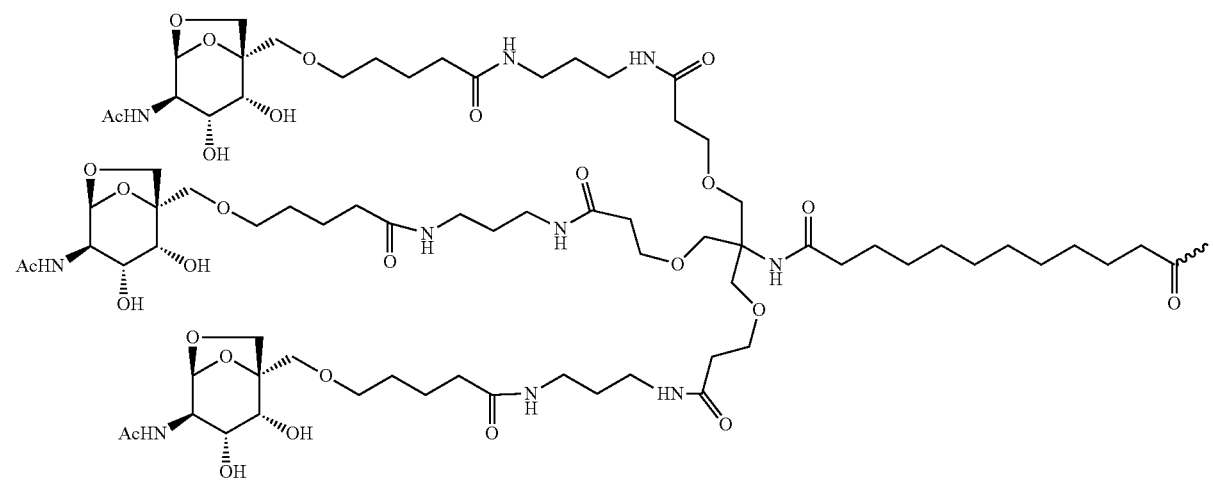

Bis-antennary (or bi-antennary) ligand, also known as bis- (or bi-) antennary PFE ligand or bis- (or bi-) antennary PFE ASPGR ligand or bis-PFE:
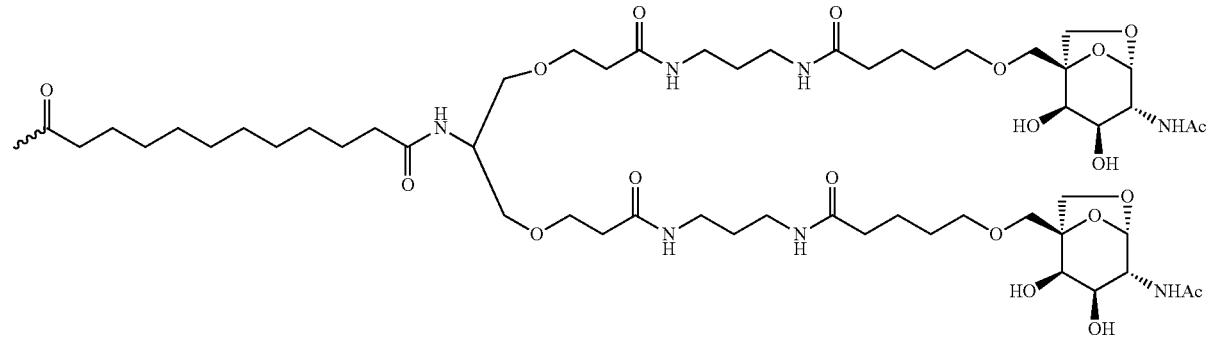
Mono-antennary ligand, also known as mono-antennary PFE ligand or mono-antennary PFE ASPGR ligand or mono-PFE:
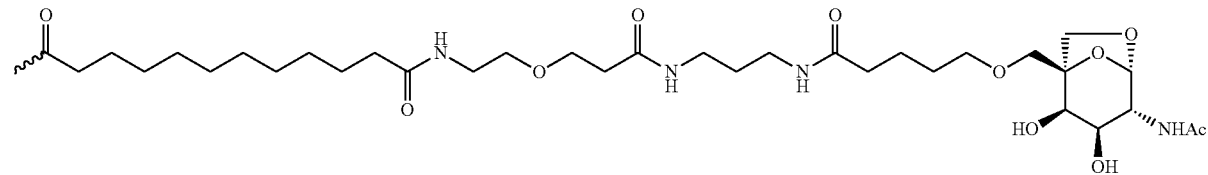
Tri-antennary GalNAc or Tri-GalNAc:
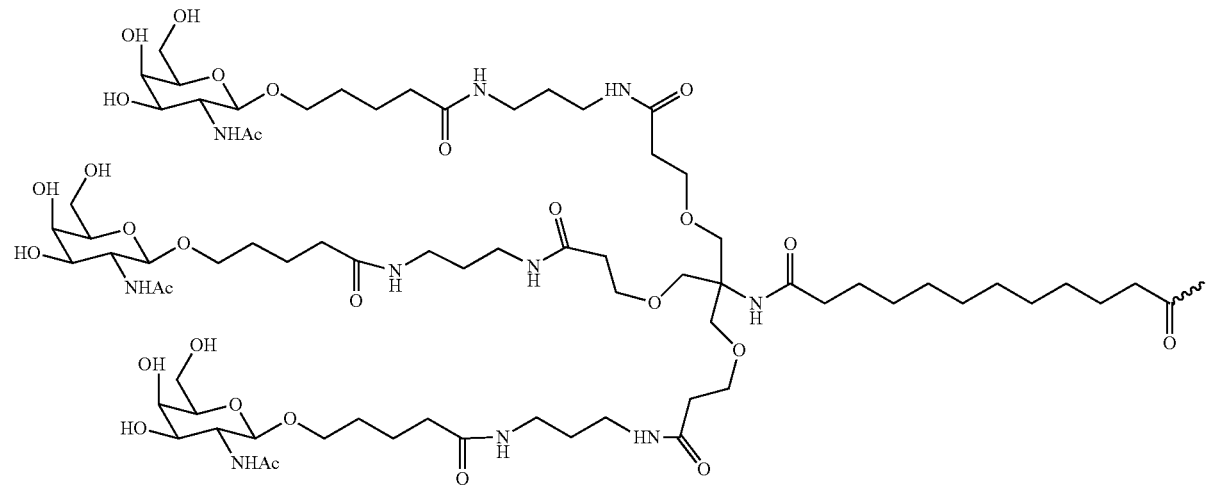

Protected versions of:
Bis-antennary (bi-antennary) GalNAc or bis-GalNAc:

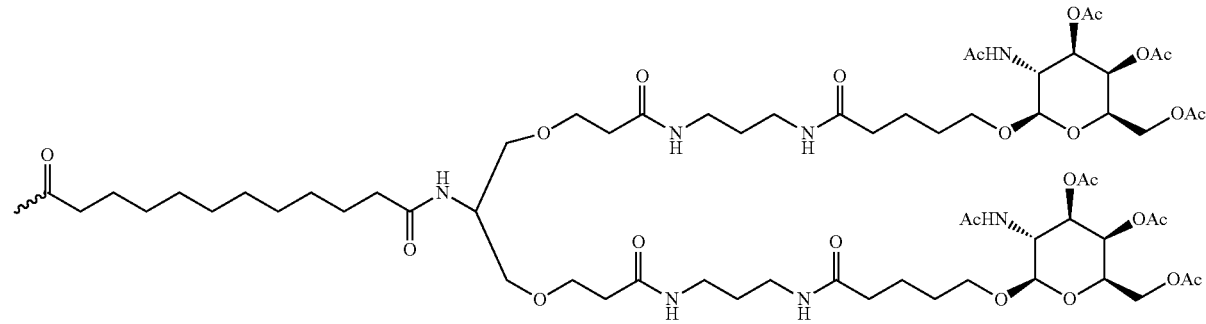

Mono-anternnary GalNAc or Mono-GalNAc:

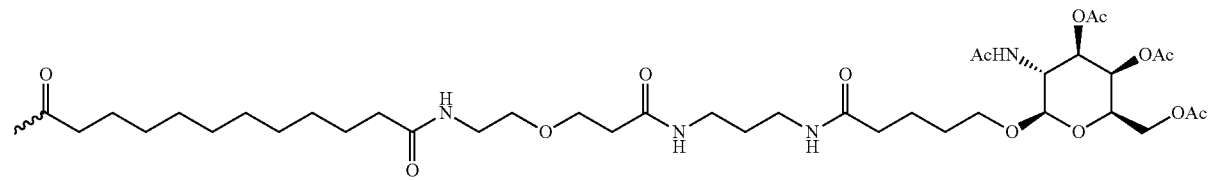

These structures represent the protected versions, as they comprise —OAc acetate groups). In some embodiments, the $A^c$ groups are removed during de-protection following conjugation of the compound to the oligonucleotide. In some embodiments, de-protection is performed with concentrated ammonium hydroxide, e.g., as described in Example 37B. In the de-protected versions of these structures, —OAc is replaced by —OH.

Some non-limiting examples of processes for production of various additional components are described below:

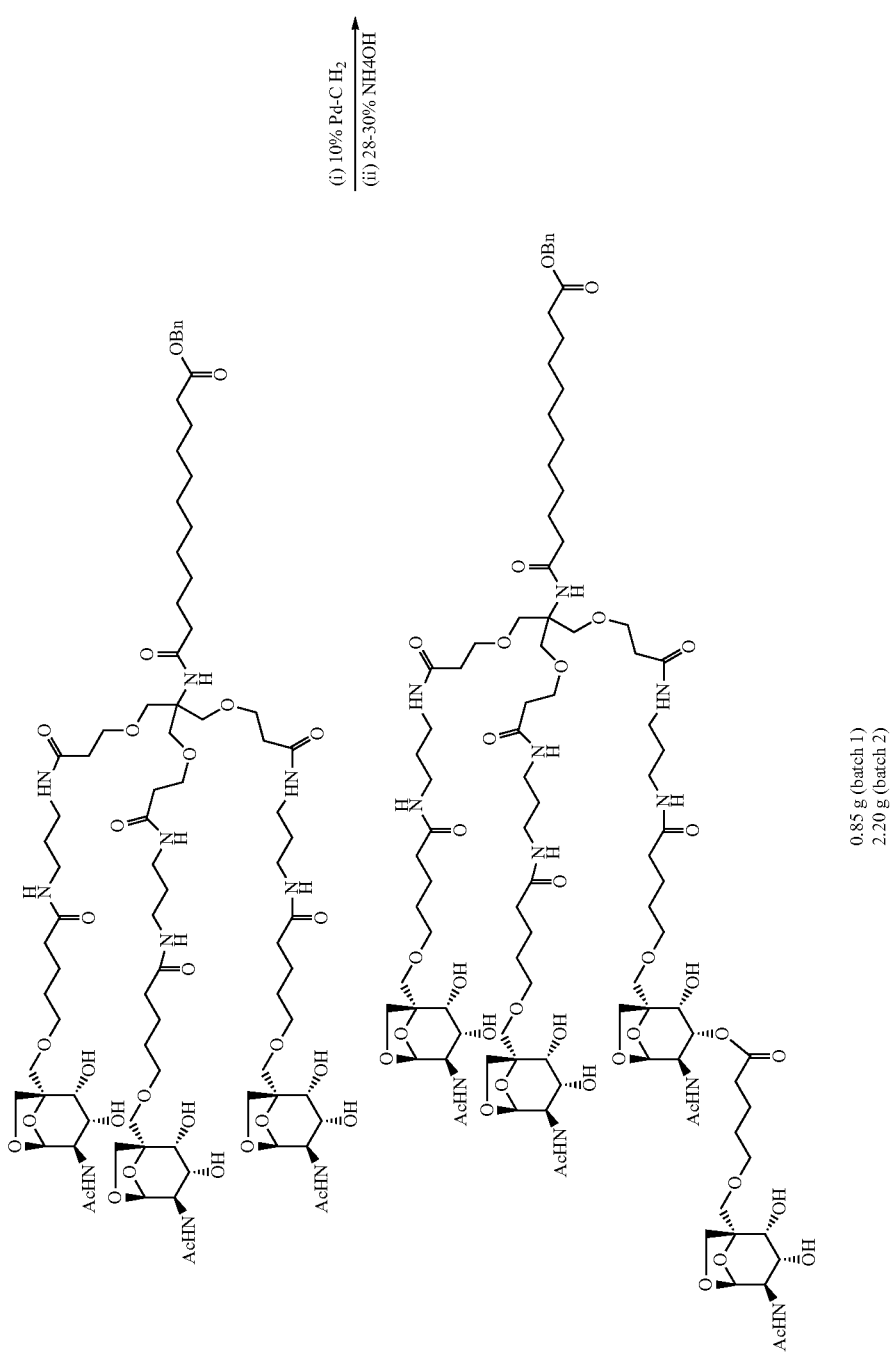

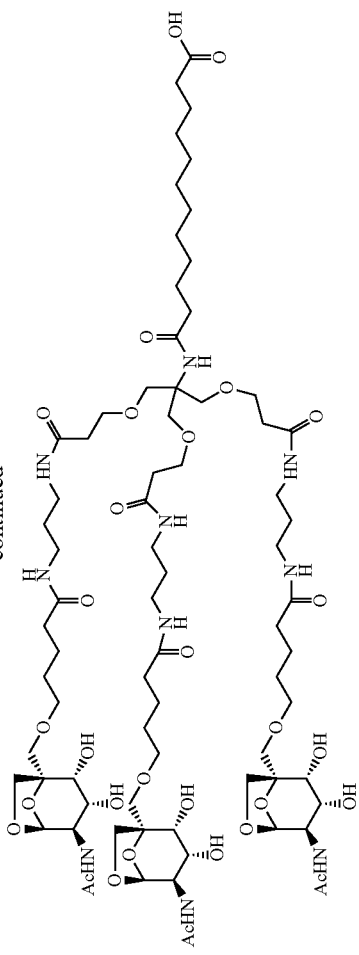
-continued
purified by C18 cartridge eluting with 0.1% TFA in water and acetonitrile
0.566 g (GL-N12-55) (containing 4 TFA)
2.14 g (GL-N12-58) (containing 3.7 TFA)
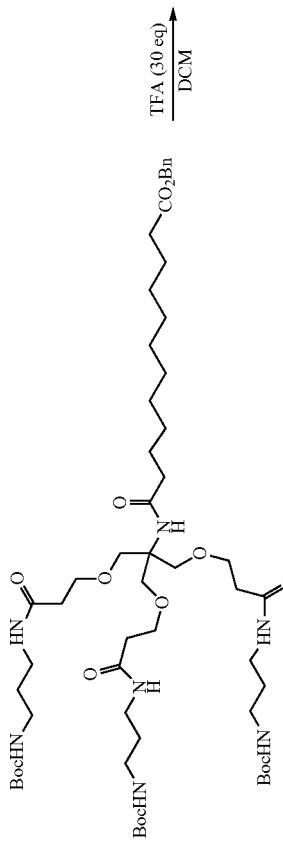
$\xrightarrow{\text{TFA (30 eq)}}{\text{DCM}}$
34.4 g

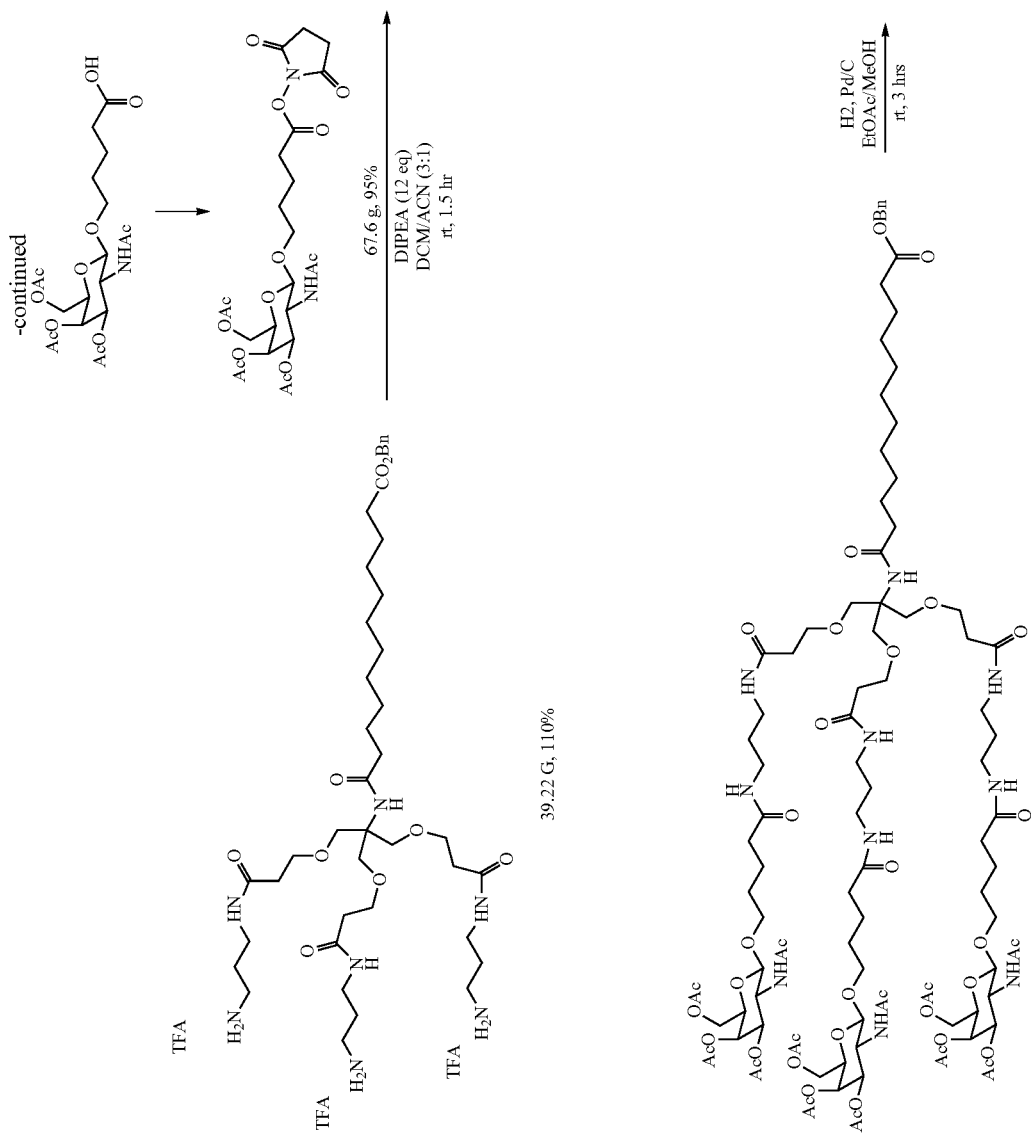

-continued
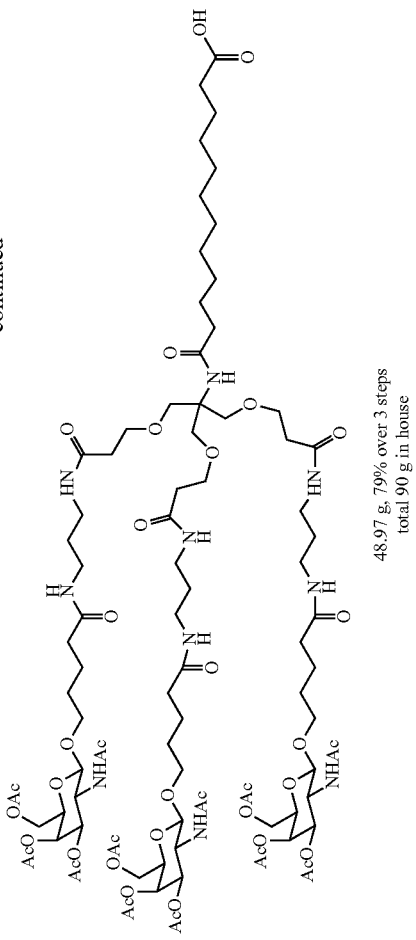
48.97 g, 79% over 3 steps
total 90 g in house
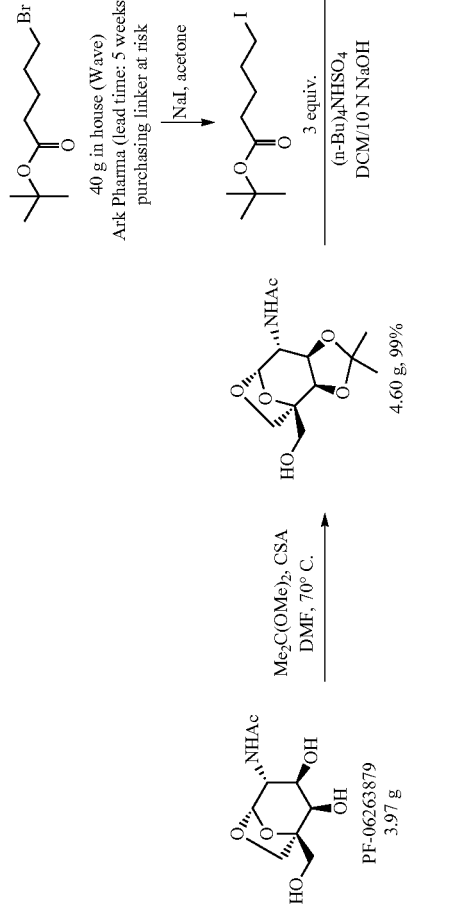

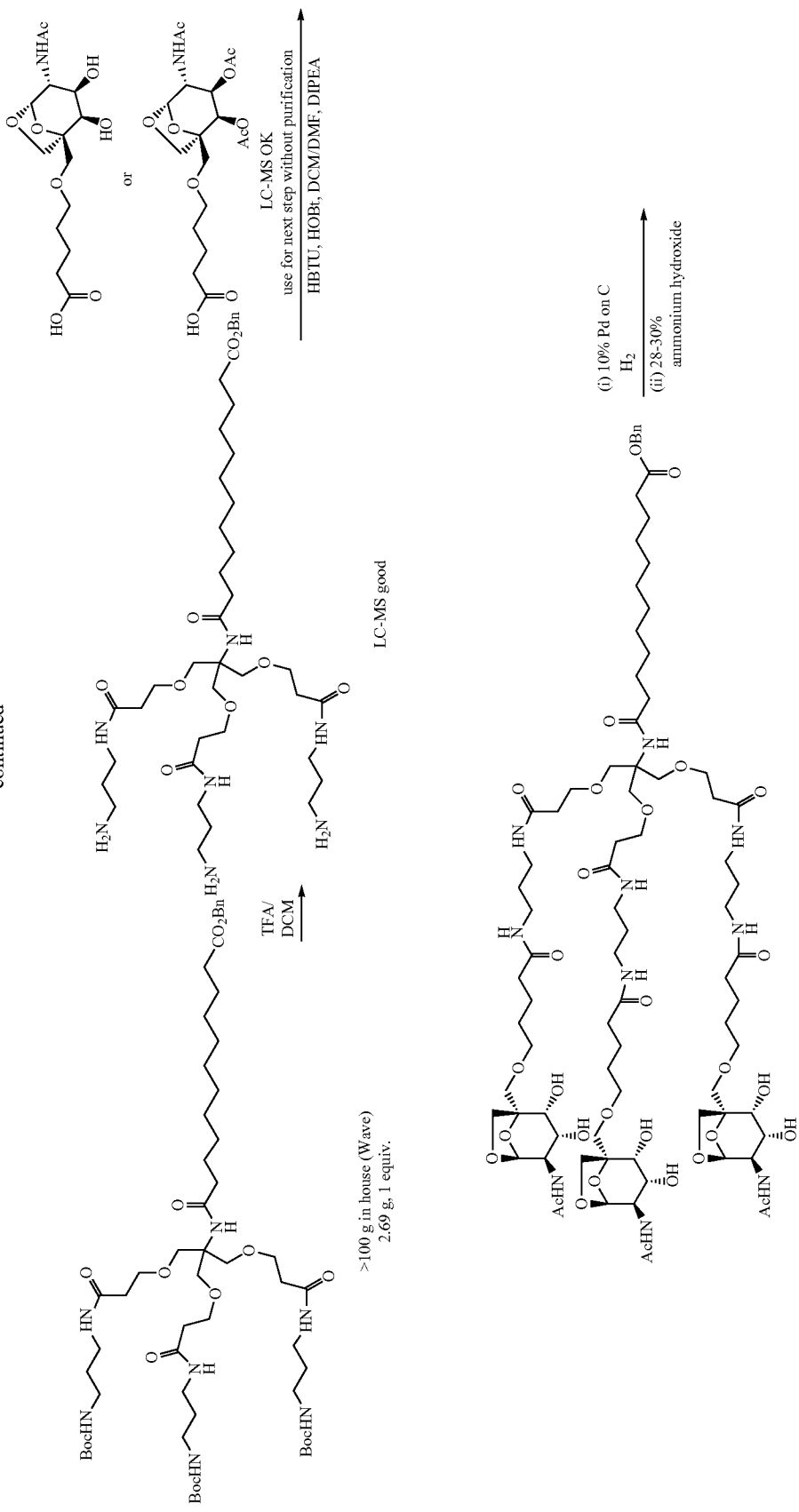

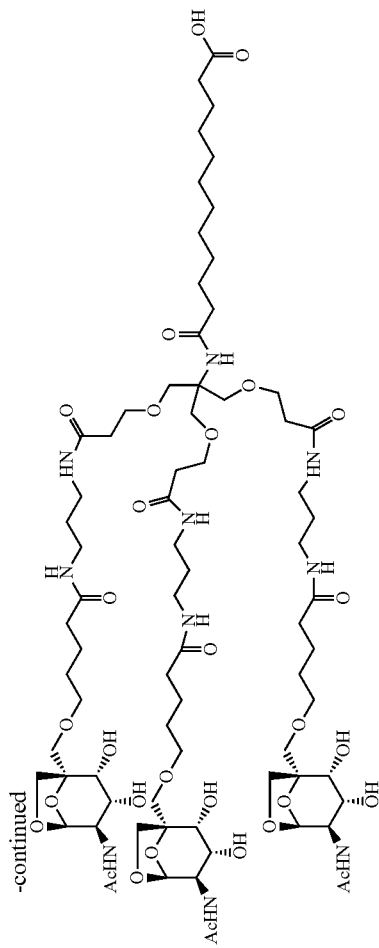
0.566 g (GL-N12-55) (containing 4 TFA)
2.14 g (GL-N12-58) (containing 3.7 TFA)
yield 53% over 3 steps
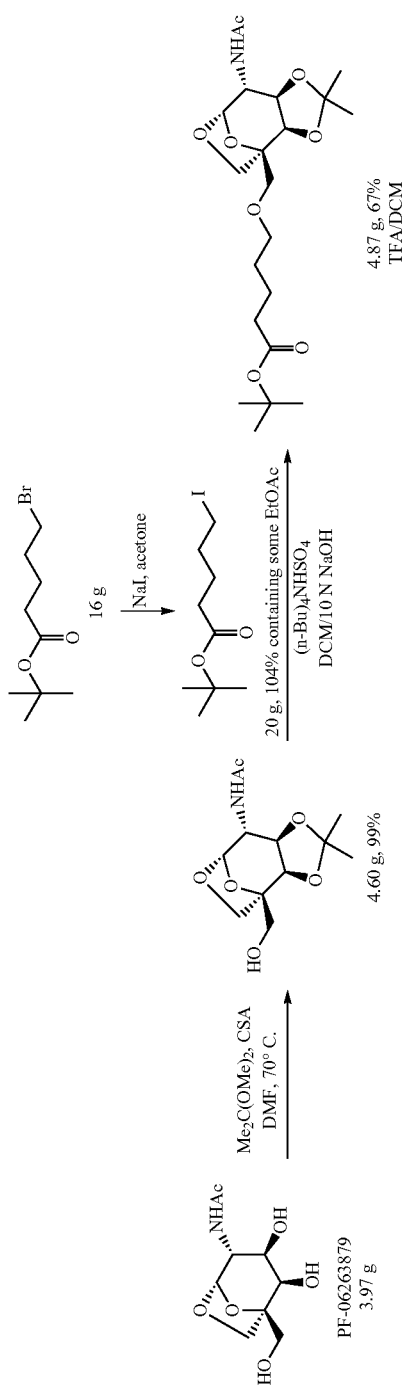

1177
1178
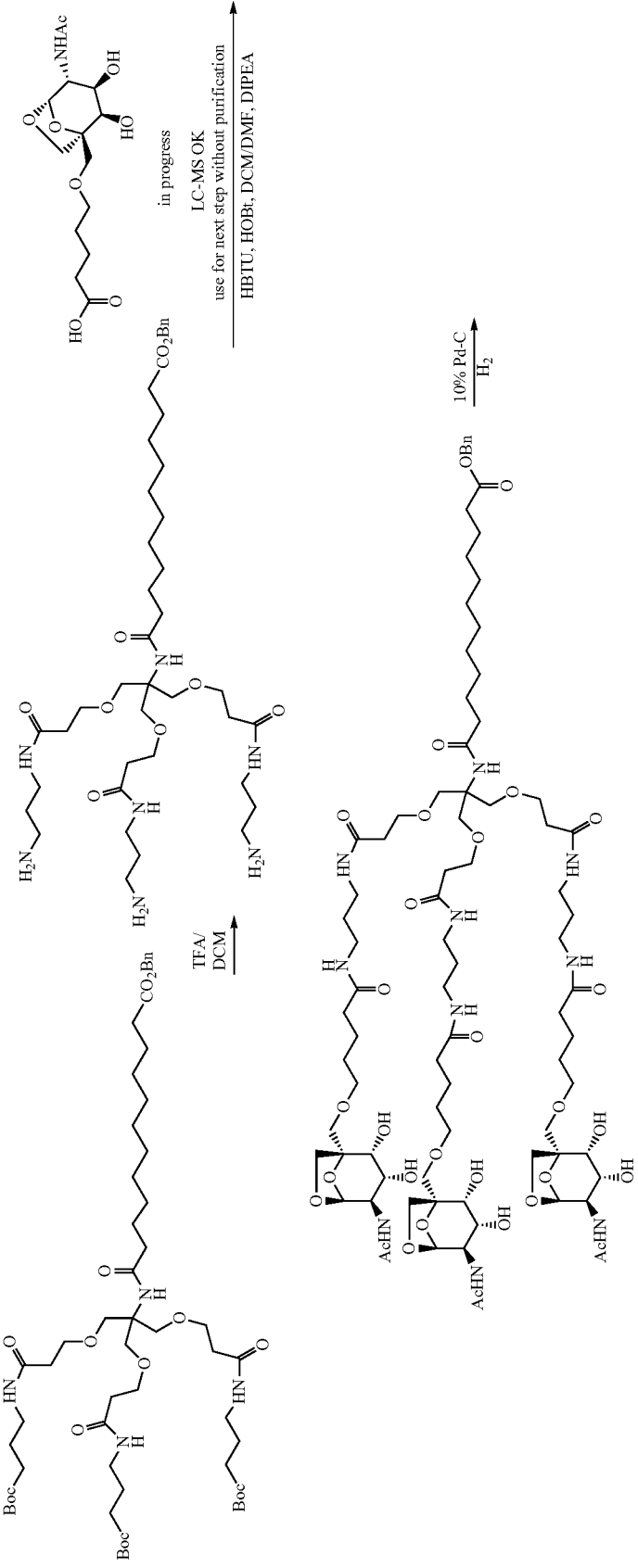
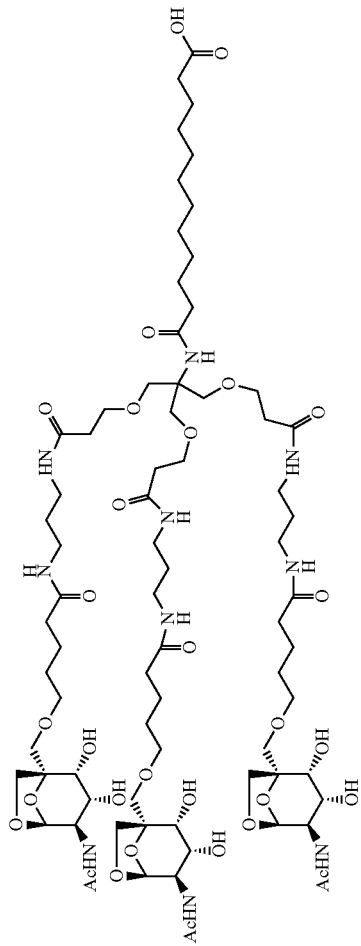

Various additional components described herein can be conjugated to various oligonucleotides described.

Example 37. Synthesis of Oligonucleotides

Synthesis of various oligonucleotides is described herein. The two digits following the decimal after the WV oligonucleotide designation indicate a batch number. For example, WV-7107.03 indicates batch 03 of WV-7107.

Example 37A. Synthesis of WV-7107 and WV-6558

WV-6558 which has the sequence 5'-Mod001L001Aeo*SGeom5CeoTeoTeo*RC*ST*ST* SG*RT*SC*SC*RA*SG*SC*RTeoTeoTeoAeo*S Teo -3' (SEQ ID NO: 3950) is a GalNAc conjugate of WV-7107 which has the sequence 5'-L001 Aeo*SGeom5CeoTeoTeo*RC*ST*ST*SG*RT*SC*SC* RA*SG*SC*RTeoTeoTeoAeo*STeo -3' (SEQ ID NO: 3951). The GalNAc conjugation step is performed on WV-7107 to make WV-6558.

Solid Phase Synthesis of WV-7107:

Synthesis of WV-7107 was performed on an AKTA OP100 synthesizer (GE healthcare) using a 6.0 cm diameter stainless steel column reactor on a 3300 µmol scale using CPG support (Loading 72 umol/g). The process consists of five steps; detritylation, coupling, capping 1, oxidation/thiolation and capping 2.

Detritylation was performed using 3% DCA in toluene with a UV watch command set at 436 nm. Following detritylation, at least 4 column volumes (CV) of ACN was used to wash off the detritylation reagent.

All phosphoramidite and activator solutions (CMIMT and ETT) were prepared and dried over 3 Å molecular sieves for at least 4 hours prior to synthesis.

Stereo-defined amidite coupling was performed using 0.2 M amidite solutions and 0.6 M CMIMT. All amidites were dissolved in ACN except dC-L and dC-D amidites which were dissolved in isobutyronitrile (IBN). Stereo-defined MOE amidites were dissolved in 20% IBN/ACN v/v. CMIMT was dissolved in ACN. Using 4 equivalents, coupling was performed by mixing 40% (by volume) of the respective amidite solution with 67% of the CMIMT activator in-line prior to addition to the column. The coupling mixture was then recirculated for a minimum of 10 minutes to maximize the coupling efficiency.

Standard stereorandom amidite coupling was performed using 0.2 M amidite solutions and 0.6 M ETT in ACN. MOE-T amidite was dissolved 20% IBN/ACN v/v. Using 4 equivalents, coupling was performed by mixing 40% (by volume) of the respective amidite solution with 60% of the ETT activator in-line prior to addition to the column. The coupling mixture was then recirculated for a minimum of 6 minutes to maximize the coupling efficiency.

After coupling in both instances, the column was washed with 2CV of ACN.

For stereo-defined couplings, the column was then treated with Capping 1 solution (Acetic Anhydride, Lutidine, ACN) mixture for 1 CV to in 4 minutes acetylate the Chiral axillary amine. Following this step the column was washed with ACN for at least 2 CV. Thiolation was then performed with 0.2 M Xanthane Hydride in pyridine with a contact time of 6 min for 2 CV. After a 2 CV thiolation wash step using ACN, capping 2 was performed using 0.5 CV of Capping A and Capping B reagents mixed inline (1:1) followed by a 2 CV ACN wash.

For stereorandom coupling cycles, there is no Capping 1 step. Oxidation was performed using 50 mM Iodine in /Pyridine/H$_2$O (9:1) for 2.5 min and 3.5 equivalents. After a 2CV ACN wash, capping 2 was performed using 0.5 CV of Capping A and Capping B reagents mixed inline (1:1) followed by a 2 CV ACN wash.

Cleavage and Deprotection of WV-7107:

67% (or 2200 µmol) of the material synthesized above was used in this step. The DPSE protecting groups on WV-7107 were removed by treating the oligo bound solid support with a 1M solution of TEA.HF made by mixing DMSO, Water, TEA and TEA.3HF in a v/v ratio of 39:8:1:2.5, to make a 100 mL solution per mmol of oligo. The mixture was then shaken at 25° C. for 6 hours in an incubator shaker. The mixture was cooled (ice bath) then 200 mL of aqueous ammonia per mmol of oligo added. The mixture was then shaken at 45° C. for 16 hours. The mixture was then filtered (0.2-1.2 µm filters) and the cake rinsed with water. The filtrate liquor was obtained and analyzed by UPLC and a purity of 30.8% FLP obtained. Quantitation was done using a Nano Drop one spectrophotometer (Thermo Scientific) and a yield of about 101,200 OD/mmol obtained.

Purification and Desalting of WV-7107:

The crude WV-7107 loaded on to an Agilent Load & Lock column (5 cm×32 cm) packed with Source 15Q (GE healthcare). Purification was performed on an AKTA 150 Pure (GE Healthcare) using 20 mM NaOH and 2.5 M NaCl as eluents. Fractions were analyzed and pooled to obtain material with a purity >70%. The purified material was then desalted on 2K re-generated cellulose membranes followed by lyophilization to obtain WV-7107 as a white powder. This material was then used for conjugation experiments.

Example 37B. Synthesis of WV-6558

Protocol for GalNAc Conjugation
Precursor material: WV-7107.03
Final Conjugated product: WV-6558.03
Reagents for Conjugation

| Oligonucleotide/ Reagents | MW | Equivalent to Oligo-nucleotide | mg | µL | µmole |
|---|---|---|---|---|---|
| WV-7107.03 | 7191.7 | 1 | 400 | — | 55.62 |
| Tri-antennary GalNAc Lot: GL-N12-26 | 2005 | 1.6 | 178.4 | — | 88.99 |
| HATU P/N Sigma 445460 Lot: MKBV8272V | 382 | 1.4 | 29.75 | — | 77.87 |
| DIEA P/N Sigma 387649 Lot: SHBG2052V | 129 | 10.0 | — | 98.83 | 556.2 |
| Acetonitrile | — | — | — | 4000 | — |

TABLE 2

Aqueous Oligonucleotide Solution

| Oligonucleotide/ Solvent | Conc (mg/mL) | Total volume (mL) | Total mg |
|---|---|---|---|
| WV-7107.01 in water | 50 | 8 | 400 |

Procedure for Conjugation

Weighed 1-(((2R,3R,4R,5R,6R)-3-acetamido-4,5-diacetoxy-6-(acetoxymethyl)tetrahydro-2H-pyran-2-yl)oxy)-16,16-bis((3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropoxy)methyl)-5,11, 18-trioxo-14-oxa-6,10,17-triazanonacosan-29-oic acid (1.6 eq), and HATU (1.4 eq.) and transferred to a 50 ml plastic tube. Dissolved the material in anhydrous acetonitrile then add DIEA (d=0.742) (10 eq) into the tube. The clear mixture was stirred for 20 min at 37° C. Reconstituted the lyophilized WV-7107 sample with 8 mL water to a concentration at 50 mg/mL. Then the GalNac mixture was added to sample WV-7107 and stirred for 60 min at 37° C. The progress of the reaction was monitored by UPLC. The reaction is complete after 1 h of incubation. The solution was concentrated under vacuum (by speed vac) to remove acetonitrile and the resultant GalNAc-conjugated oligo was treated with concentrated Ammonium hydroxide (5 mL) for deprotection by incubating for 1 h at 37° C. The formation of the final product WV-6558 was confirmed by UPLC and Mass Spectrometry. The conjugated samples were purified by anion exchange chromatography. Observed Mass: 8802.4 (Deconvoluted), Target Mass: 8801.6.

Example 37C. Synthesis of WV-9542

Protocol for PFE Conjugation
Precursor material: WV-7107.02
Final Conjugated product: WV-9542.01
Reagents for Conjugation

| Oligonucleotide/ Reagents | MW | Equivalent to Oligo-nucleotide | mg | µL | µmole |
|---|---|---|---|---|---|
| WV-7107.02 | 7191.7 | 1 | 1700 | — | 236.38 |
| Tri-antennary PFE ASGPR ligand Lot: GL-N12-58 | 2065.8 | 1.6 | 781.3 | — | 378.21 |
| HATU P/N Sigma 445460 Lot: MKBV8272V | 382 | 1.2 | 108.36 | — | 283.66 |
| DIEA P/N Sigma 387649 Lot: SHBG2052V | 129 | 10.0 | 304.93 | 420.02 | 2363.84 |
| DMF | — | — | — | 13000 | — |

TABLE 2

Aqueous Oligonucleotide Solution

| Oligonucleotide/ Solvent | Conc (mg/mL) | Total volume (mL) | Total mg |
|---|---|---|---|
| WV-7107.01 in water | 60 | 13 | 1800 |

Procedure for Conjugation

Weighed Tri-antennary PFE ASGPR ligand (18,18-bis(17-(((1S,2R,3R,4R,5S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5 S)-4-acetamido-2,3-dihydroxy-6,8-dioxabicyclo[3.2.1]octan-1-yl)-7,13,20-trioxo-2,16-dioxa-8,12,19-triazahentriacontan-31-oic acid) (1.6 eq), and HATU (1.2 eq.) and transferred to a 50 mL tube. Dissolved the material in anhydrous Dimethylformamide then add DIEA (d=0.742) (10 eq) into the tube. The solution was sonicated till it became clear, and it was stirred for 20 min at 37° C. Reconstituted WV-7107 sample with 13 mL water. Then the Tri-antennary PFE ligand mixture was added to sample WV-7107 and stirred for 1 hr at 37° C. The progress of the reaction was monitored by UPLC. The reaction was incomplete after 1 hr incubation. Second addition of Tri-antennary PFE ligand (1.2 eq) and HATU (1 eq) were weighed out and dissolved in 5 mL DMF with DIEA (15 eq). Incubated the ligand for 20 min at 37° C. for activation. Then added the activated ligand to the reaction mixture and incubated for 1 hr at 37° C. The reaction completed and the formation of the final product WV-9542 was confirmed by UPLC and Mass Spectrometry. The conjugated samples were purified by anion exchange chromatography. Observed Mass: 8837.6 (Deconvoluted), Target Mass: 8837.6.

Example 37D. Synthesis of WV-9543

Protocol for PFE Conjugation
Precursor material: WV-7107.02
Final Conjugated product: WV-9543.01
Reagents for Conjugation

| Oligonucleotide/ Reagents | MW | Equivalent to Oligo-nucleotide | mg | µL | µmole |
|---|---|---|---|---|---|
| WV-7107.02 | 7191.7 | 1 | 90 | — | 12.51 |
| Bis-antennary GalNAc Lot: PF-07075575 | 1418.59 | 2 | 35.5 | — | 25.03 |
| HATU P/N Sigma 445460 Lot: MKBV8272V | 382 | 1.8 | 8.6 | — | 22.53 |
| DIEA P/N Sigma 387649 Lot: SHBG2052V | 129 | 10.0 | 16.14 | 22.24 | 125.14 |
| Dimethylformamide | — | — | — | 1500 | — |

TABLE 2

Aqueous Oligonucleotide Solution

| Oligonucleotide/ Solvent | Conc (mg/mL) | Total volume (mL) | Total mg |
|---|---|---|---|
| WV-7107.01 in water | 60 | 1.5 | 90 |

Procedure for Conjugation

Weighed the Bis-antennary GalNAc (1-(((2R,3R,4R,5R,6R)-3-acetamido-4,5-diacetoxy-6-(acetoxymethyl)tetrahydro-2H-pyran-2-yl)oxy)-16-((3-((3-(5-(((2R,3R,4R,5R,6R)-3-acetamido-4,5-diacetoxy-6-(acetoxymethyl) tetrahydro-2H-pyran-2-yl)oxy)pentanamido)propyl)amino)-3-oxopropoxy)methyl)-5,11,18-trioxo-14-oxa-6,10,17-triazanonacosan-29-oic acid) (2.0 eq), and HATU (1.8 eq) and transferred to a 50 mL tube. Dissolved the material in anhydrous Dimethylformamide (1.5 mL) then add DIEA (d=0.742) (10 eq) into the tube. The solution was sonicated till it became clear, and it was stirred for 20 min at 37° C. Reconstituted WV-7107 sample with 1.5 mL water. Then the Bis-antennary GalNAc mixture was added to sample WV-7107 and stirred for 1 hr at 37° C. The progress of the reaction was monitored by UPLC. The reaction was completed after 1 hr incubation. The mixture was treated with concentrated Ammonium hydroxide (2 mL) for deprotection by incubating for 1 h at 37° C. Formation of the final product WV-9543 was confirmed by UPLC and Mass Spectrometry. The conjugated samples were purified by anion exchange chromatography. Observed Mass: 8342.6 (Deconvoluted), Target Mass: 8340.1.

Example 37E. Synthesis of WV-9544

Protocol for PFE Conjugation
Precursor material: WV-7107.02
Final Conjugated product: WV-9544.01
Reagents for Conjugation

| Oligonucleotide/Reagents | MW | Equivalent to Oligo-nucleotide | mg | μL | μmole |
|---|---|---|---|---|---|
| WV-7107.02 | 7191.7 | 1 | 90 | — | 12.51 |
| Bis-antennary PFE ASGPR ligand Lot: PF-07075667 | 1190.39 | 2 | 29.8 | — | 25.03 |
| HATU P/N Sigma 445460 Lot: MKBV8272V | 382 | 1.8 | 8.6 | — | 22.53 |
| DIEA P/N Sigma 387649 Lot: SHBG2052V | 129 | 10.0 | 16.14 | 22.24 | 125.14 |
| Dimethylformamide | — | — | — | 1500 | — |

TABLE 2

Aqueous Oligonucleotide Solution

| Oligonucleotide/Solvent | Conc (mg/mL) | Total volume (mL) | Total mg |
|---|---|---|---|
| WV-7107.01 in water | 60 | 1.5 | 90 |

Procedure for Conjugation

Weighed the Bis-antennary PFE ASGPR ligand (18-(17-((1S,2R,3R,4R,5S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5 S)-4-acetamido-2,3-dihydroxy-6,8-dioxabicyclo[3.2.1]octan-1-yl)-7,13,20-trioxo-2,16-dioxa-8,12,19-triazahentriacontan-31-oic acid) (2.0 eq), and HATU (1.8 eq) and transferred to a 50 mL tube. Dissolved the material in anhydrous Dimethylformamide (1.5 mL) then add DIEA (d=0.742) (10 eq) into the tube. The solution was sonicated till it became clear, and it was stirred for 20 min at 37° C. Reconstituted WV-7107 sample with 1.5 mL water. Then the Bis-antennary PFE ASGPR ligand mixture was added to sample WV-7107 and stirred for 1 hr at 37° C. The progress of the reaction was monitored by UPLC. The reaction was completed after 1 hr incubation. Formation of the final product WV-9544 was confirmed by UPLC and Mass Spectrometry. The conjugated samples were purified by anion exchange chromatography. Observed Mass: 8367.2 (Deconvoluted), Target Mass: 8364.1.

Example 37F. Synthesis of WV-9545

Protocol for PFE Conjugation
Precursor material: WV-7107.02
Final Conjugated product: WV-9545.01
Reagents for Conjugation

| Oligonucleotide/Reagents | MW | Equivalent to Oligo-nucleotide | mg | μL | μmole |
|---|---|---|---|---|---|
| WV-7107.02 | 7191.7 | 1 | 90 | — | 12.51 |
| Mono GalNAc Lot: PF-07075574 | 830.97 | 2 | 20.8 | — | 25.03 |
| HATU P/N Sigma 445460 Lot: MKBV8272V | 382 | 1.8 | 8.6 | — | 22.53 |
| DIEA P/N Sigma 387649 Lot: SHBG2052V | 129 | 10.0 | 16.14 | 22.24 | 125.14 |
| Dimethylformamide | — | — | — | 1500 | — |

TABLE 2

Aqueous Oligonucleotide Solution

| Oligonucleotide/Solvent | Conc (mg/mL) | Total volume (mL) | Total mg |
|---|---|---|---|
| WV-7107.01 in water | 60 | 1.5 | 90 |

Procedure for Conjugation

Weighed the Mono GalNAc (1-(((2R,3R, 4R, 5R, 6R)-3-acetamido-4,5-diacetoxy-6-(acetoxymethyl)tetrahydro-2H-pyran-2-yl)oxy)-5,11,18-tri oxo-14-oxa-6,10,17-triazanonacosan-29-oic acid) (2.0 eq), and HATU (1.8 eq) and transferred to a 50 mL tube. Dissolved the material in anhydrous Dimethylformamide (1.5 mL) then add DIEA (d=0.742) (10 eq) into the tube. The solution was sonicated till it became clear, and it was stirred for 20 min at 37° C. Reconstituted WV-7107 sample with 1.5 mL water. Then the Mono GalNAc ligand mixture was added to sample WV-7107 and stirred for 1 hr at 37° C. The progress of the reaction was monitored by UPLC. The reaction was completed after 1 hr incubation. The mixture was treated with concentrated Ammonium hydroxide (2 mL) for deprotection by incubating for 1 h at 37° C. Formation of the final product WV-9545 was confirmed by UPLC and Mass Spectrometry. The conjugated samples were purified by anion exchange chromatography. Observed Mass: 7881.3 (Deconvoluted), Target Mass: 7878.6.

Example 37G. Synthesis of WV-9546

Protocol for PFE Conjugation
Precursor material: WV-7107.02
Final Conjugated product: WV-9546.01
Reagents for Conjugation

| Oligonucleotide/Reagents | MW | Equivalent to Oligo-nucleotide | mg | μL | μmole |
|---|---|---|---|---|---|
| WV-7107.02 | 7191.7 | 1 | 90 | — | 12.51 |
| Mono PFE ASGPR ligand Lot: PF-07075666 | 716.87 | 2 | 17.9 | — | 25.03 |
| HATU P/N Sigma 445460 Lot: MKBV8272V | 382 | 1.8 | 8.6 | — | 22.53 |

-continued

| Oligonucleotide/ Reagents | MW | Equivalent to Oligo- nucleotide | mg | μL | μmole |
|---|---|---|---|---|---|
| DIEA P/N Sigma 387649 Lot: SHBG2052V | 129 | 10.0 | 16.14 | 22.24 | 125.14 |
| Dimethylformamide | — | — | — | 1500 | — |

TABLE 2

Aqueous Oligonucleotide Solution

| Oligonucleotide/ Solvent | Conc (mg/mL) | Total volume (mL) | Total mg |
|---|---|---|---|
| WV-7107.01 in water | 60 | 1.5 | 90 |

Procedure for Conjugation

Weighed the Mono PFE ASGPR ligand (1-((1S,2R,3R,4R,5S)-4-acetamido-2,3-dihydroxy-6,8-dioxabicyclo[3.2.1]octan-1-yl)-'7,13,20-trioxo-2,16-dioxa-8,12,19-triazahentriacontan-31-oic acid) (2.0 eq), and HATU (1.8 eq) and transferred to a 50 mL tube. Dissolved the material in anhydrous Dimethylformamide (1.5 mL) then add DIEA (d=0.742) (10 eq) into the tube. The solution was sonicated till it became clear, and it was stirred for 20 min at 37° C. Reconstituted WV-7107 sample with 1.5 mL water. Then the Mono GalNAc ligand mixture was added to sample WV-7107 and stirred for 1 hr at 37° C. The progress of the reaction was monitored by UPLC. The reaction was completed after 1 hr incubation. Formation of the final product WV-9546 was confirmed by UPLC and Mass Spectrometry. The conjugated samples were purified by anion exchange chromatography. Observed Mass: 7893.1 (Deconvoluted), Target Mass: 7890.6.

Example 37H. IEX Purification Condition

For sample WV-9542

| Buffer A | 20 mM Sodium Hydroxide | |
|---|---|---|
| Buffer B | 2.5 N sodium chloride in 20 mM Sodium hydroxide | |
| Column | 2.5 cm × 33 cm Source 15Q | |
| Gradient | % B | Column Vol (160 mL) |
| | 0 | 2 |
| | 0-15 | 2 |
| | 15 | 1 |
| | 15-90 | 15 |
| | 100 | 1 |

For sample WV-6558, WV-9542- WV-9546

| Buffer A | 20 mM Sodium Hydroxide | |
|---|---|---|
| Buffer B | 2.5 N sodium chloride in 20 mM Sodium hydroxide | |
| Column | 2.0 cm × 10 cm Source 15Q | |
| Gradient | % B | Column Vol (160 mL) |
| | 0 | 2 |
| | 0-20 | 5 |
| | 20 | 1 |
| | 20-90 | 15 |
| | 100 | 1 |

Example 38. Synthesis of Ligand

Synthesis of 1-(((2R,3R,4R,5R,6R)-3-acetamido-4,5-diacetoxy-6-(acetoxymethyl)tetrahydro-2H-pyran-2-yl)oxy)-16,16-bis((3-((5-(02R,3R,4R,5R,6R)-3-acetamido-4,5-diacetoxy-6-(acetoxymethyl)tetrahydro-2H-pyran-2-yl)oxy)pentanamido)propyl)amino)-3-oxopropoxy)methyl)-5,11,18-trioxo-14-oxa-6,10,17-triazanonacosan-29-oic acid

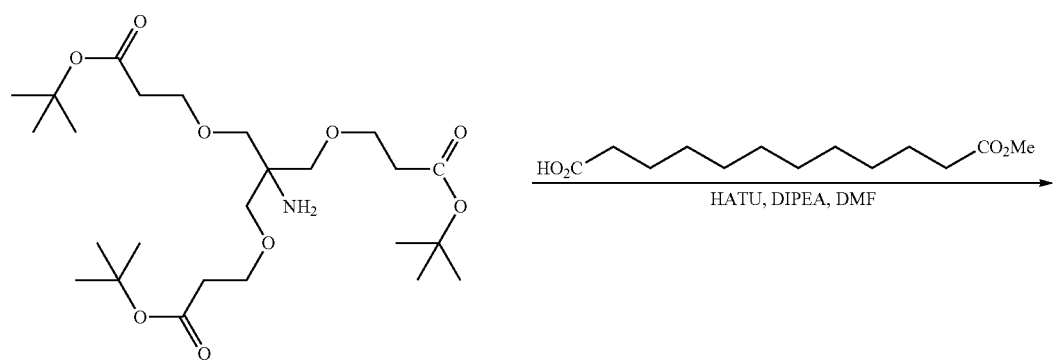

-continued
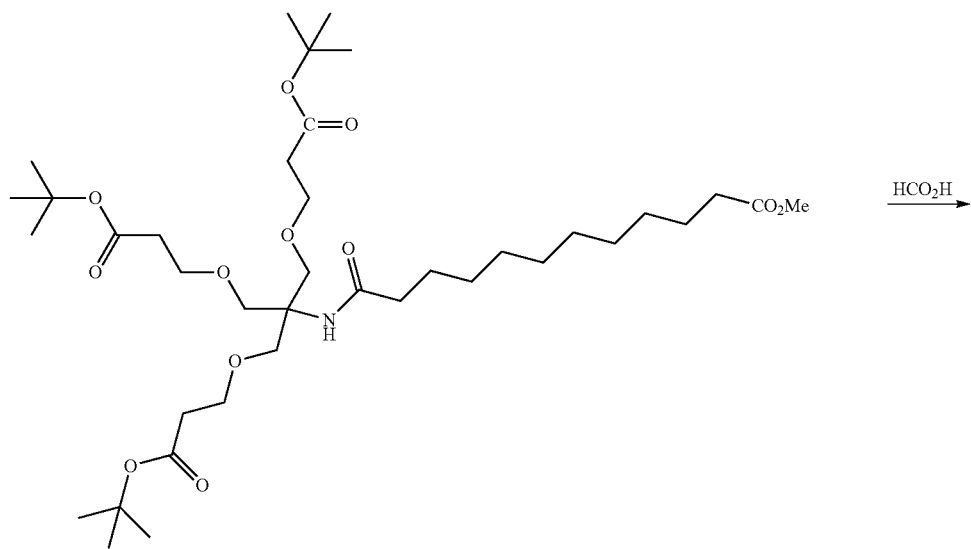
71%
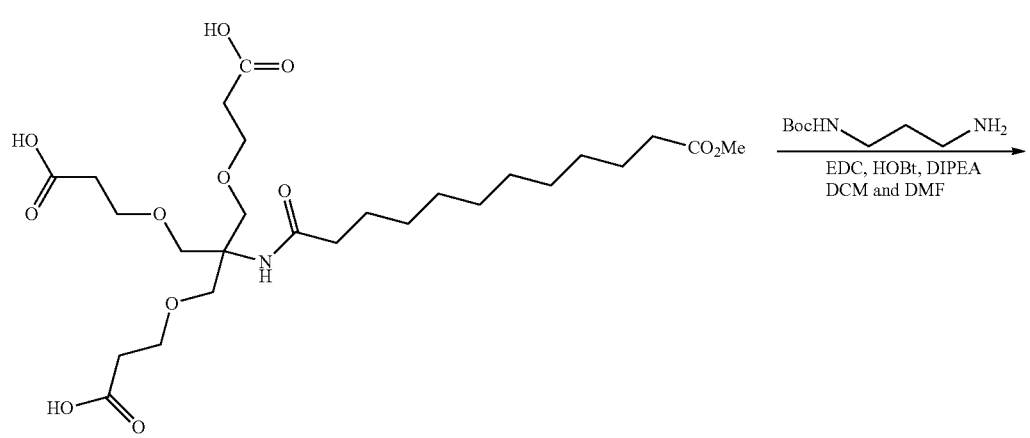
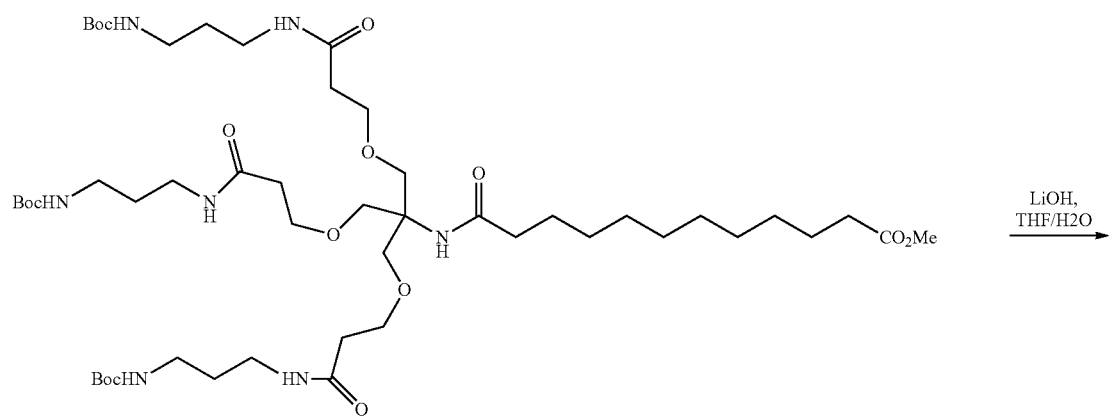
94% over 2 steps

-continued
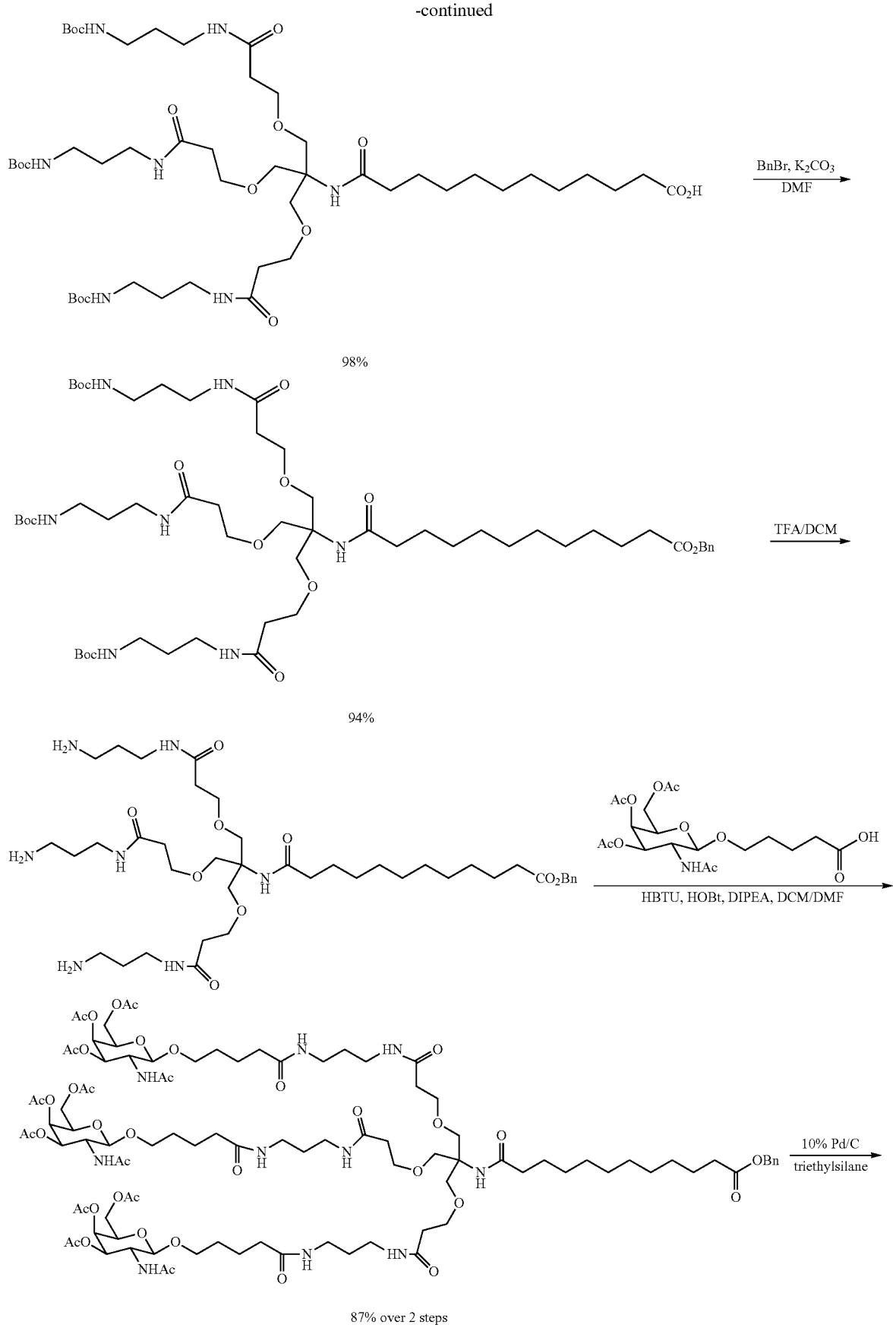

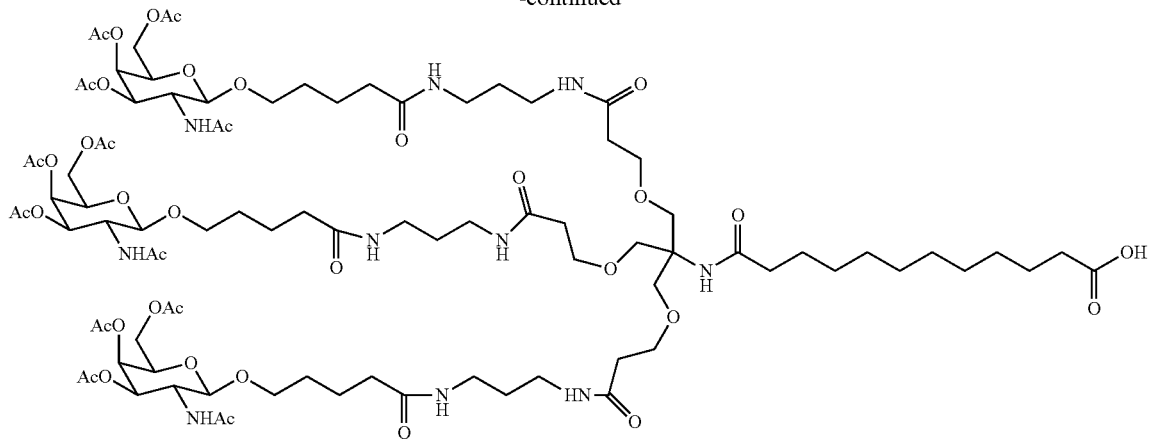

100%

Step 1: To a solution of di-tert-butyl 3,3'-((2-amino-243-(tert-butoxy)-3-oxopropoxy)methyl)propane-1,3-diyl)bis(oxy))dipropanoate (5.0 g, 9.89 mmol) and 12-methoxy-12-oxododecanoic acid (2.416 g, 9.89 mmol) in DMF (45 mL) was added HATU (3.76 g, 9.89 mmol) and DIPEA (2.58 ml, 14.83 mmol). The reaction mixture was stirred at room temperature for 5 hrs. Solvent was concentrated under reduced pressure, and diluted with brine, extracted with EtOAc, dried over anhydrous sodium sulfate, and concentrated to give a residue, which was purified by ISCO (120 g gold silica gel cartridge) eluting with 10% EtOAc in hexane to 40% EtOAc in hexane to give di-tert-butyl 3,3'-((2-((3-(tert-butoxy)-3-oxopropoxy)methyl)-2-(12-methoxy-12-oxododecanamido)propane-1,3-diyl)bis(oxy))dipropanoate (5.13 g, 7.01 mmol, 70.9% yield) as a colorless oil. $^1$H NMR (400 MHz, Chloroform-d) δ 6.03 (s, 1H), 3.74-3.61 (m, 15H), 2.45 (t, J=6.3 Hz, 6H), 2.31 (td, J=7.5, 3.9 Hz, 2H), 2.19-2.10 (m, 2H), 1.64-1.59 (m, 4H), 1.46 (s, 27H), 1.32-1.24 (m, 12H); MS (ESI), 732.6 (M+H)+.

Step 2: A solution of di-tert-butyl 3,3'-((2-((3-(tert-butoxy)-3-oxopropoxy)methyl)-2-(12-methoxy-12-oxododecanamido)propane-1,3-diyl)bis(oxy))dipropanoate (5.0 g, 6.83 mmol) in formic acid (50 mL) was stirred at room temperature for 48 hrs. Solvent was evaporated under reduced pressure, co-evaporated with toluene (3 X) to give a white solid, which was dried under high vacuum for 2 days. LC-MS and H NMR showed the reaction is not complete. The crude product was redissolved in formic acid (50 mL). The reaction mixture was stirred at room temperature for 24 hrs. LC-MS showed the reaction was complete. Solvent was evaporated under reduced pressure, co-evaporated with toluene (3×), dried over high vacuum to give 3,3'-((2-((2-carboxyethoxy)methyl)-2-(12-methoxy-12-oxododecanamido)propane-1,3-diyl)bis(oxy))dipropanoic acid (4.00 g) as a white solid. MS (ESI): 562.4 (M−H)−.

Step 3: A solution of 3,3'-((2-((2-carboxyethoxy)methyl)-2-(12-methoxy-12-oxododecanamido)propane-1,3-diyl)bis(oxy))dipropanoic acid (3.85 g, 6.83 mmol) and HOBt (3.88 g, 28.7 mmol) in DCM (60 mL) and DMF (15 mL) at 0° C. was added tert-butyl (3-aminopropyl)carbamate (4.76 g, 27.3 mmol), EDAC HCl salt (5.24 g, 27.3 mmol) and DIPEA (8.33 ml, 47.8 mmol). The reaction mixture was stirred at 0° C. for 15 minutes and at room temperature for 20 hrs. LC-MS showed the reaction was not complete. t-Butyl (3-aminopropyl) carbamate (1.59 g, 9.12 mmol) and EDC HCl salt (1.75 g, 9.13 mol) was added into the reaction mixture. The reaction mixture was continually stirred at room temperature for 4 hrs. Solvent was evaporated to give a residue, which was dissolved in EtOAc (300 mL), washed with water (1×), saturated sodium bicarbonate (2×), 10% citric acid (2×) and water, dried over sodium sulfate, and concentrated to give a residue which was purified by ISCO (80 g gold cartridge) eluting with DCM to 30% MeOH in DCM to give methyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazaoctacosan-28-oate (6.61 g, 6.40 mmol, 94% yield over 2 steps) as a white solid. MS (ESI): 1033.5 (M+H)+.

Step 4: To a solution of methyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazaoctacosan-28-oate (6.56 g, 6.35 mmol) in THF (75 mL) was added aq. LiOH (0.457 g, 19.06 mmol) in water (25 mL). The mixture was stirred at room temperature for overnight. LC-MS showed the reaction was completed. Solvent was evaporated, acidified using 1 N HCl (45 mL), extracted with DCM (3×), dried over anhydrous sodium sulfate, concentrated to give 15,15-bis(13,13-dimethyl-5,11-dioxo-2,12-dioxa-6,10-diazatetradecyl)-2,2-dimethyl-4,10,17-trioxo-3,13-dioxa-5,9,16-triazaoctacosan-28-oic acid (6.31 g, 6.20 mmol, 98% yield) as a white solid. MS (ESI): 1019.6 (M+H)+.

Step 5: To a solution of 15,15-bis(13,13-dimethyl-5,11-dioxo-2,12-dioxa-6,10-diazatetradecyl)-2,2-dimethyl-4,10,17-trioxo-3,13-dioxa-5,9,16-triazaoctacosan-28-oic acid (6.31 g, 6.20 mmol) and (bromomethyl)benzene (1.272 g, 7.44 mmol) in DMF (40 mL) was added K2CO3 (2.57 g, 18.59 mmol). The mixture was stirred at 40° C. for 4 hrs and at room temperature for overnight. Solvent was evaporated under reduced pressure. The reaction mixture was diluted with EtOAc, washed with water, dried over anhydrous sodium sulfate, concentrated under reduced pressure to give a residue, which was purified by ISCO (80 g cartridge)

eluting with DCM to 30% MeOH in DCM to give benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazaoctacosan-28-oate (6.41 g, 5.78 mmol, 93% yield) as a colorless oil. $^1$H NMR (400 MHz, DMSO-d6) δ 7.80 (t, J=5.7 Hz, 3H), 7.39-7.30 (m, 5H), 6.95 (s, 1H), 6.74 (t, J=5.8 Hz, 3H), 5.07 (s, 2H), 3.53 (J, J=7.3 Hz, 6H), 3.51 (s, 6H), 3.02 (q, J=6.7 Hz, 6H), 2.94-2.85 (m, 6H), 2.29 (dt, J=26.1, 6.9 Hz, 8H), 2.02 (q, J=9.7, 8.6 Hz, 2H), 1.56-1.39 (m, 10H), 1.35 (s, 27H), 1.20 (brs, 14H); MS (ESI): 1019.6 (M+H)$^+$.

Step 6: To a solution of benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazaoctacosan-28-oate (2.42 g, 2.183 mmol) in DCM (40 mL) was added 2,2,2-trifluoroacetic acid (8 ml, 105 mmol). The reaction mixture was stirred at room temperature for overnight. Solvent was evaporated under reduced pressure, co-evaporated with toluene (2 X), triturated with ether, dried under high vacuum for overnight. Directly use TFA salt for next step.

Step 7: To a solution of 5-(((2R,3R,4R,5R,6R)-3-acetamido-4,5-diacetoxy-6-(acetoxymethyl)tetrahydro-2H-pyran-2-yl)oxy)pentanoic acid (3.91 g, 8.73 mmol), HBTU (3.48 g, 9.17 mmol) and HOBT (1.239 g, 9.17 mmol) in DCM (25 mL) was added DIPEA (6.08 ml, 34.9 mmol) followed by benzyl 12-((1,19-diamino-10-((3-((3-aminopropyl)amino)-3-oxopropoxy)methyl)-5,15-dioxo-8,12-dioxa-4,16-diazanonadecan-10-yl)amino)-12-oxododecanoate (1.764 g, 2.183 mmol) in DMF (4.0 mL). The mixture was stirred at room temperature for 5 hrs. Solvent was evaporated under reduced pressure to give a residue, which was purified by ISCO (40 g gold column) eluting with 5% MeOH in DCM for 5 column value to remove HOBt followed by 5% to 30% MeOH in DCM to give 1-(((2R,3R,4R,5R,6R)-3-acetamido-4,5-diacetoxy-6-(acetoxymethyl)tetrahydro-2H-pyran-2-yl)oxy)-16,16-b i s((3-((3-(5-(((2R,3R,4R,5R, 6R)-3-acetamido-4,5-diacetoxy-6-(acetoxymethyl)tetrahydro-2H-pyran-2-yl)oxy)pentanamido)propyl)amino)-3-oxopropoxy)methyl)-5,11,18-tri oxo-14-oxa-6,10,17-triazanonacosan-29-oic benzyl ester (3.98 g, 87% yield) as a white solid. 41 NMR (400 MHz, DMSO-d6) δ 7.82-7.74 (m, 6H), 7.69 (t, J=5.6 Hz, 3H), 7.33-7.27 (m, 5H), 6.94 (s, 1H), 5.16 (d, J=3.4 Hz, 3H), 5.03 (s, 2H), 4.92 (dd, J=11.2, 3.4 Hz, 3H), 4.43 (d, J=8.4 Hz, 3H), 4.02-3.95 (m, 9H), 3.82 (dt, J=11.2, 8.8 Hz, 3H), 3.65 (dt, J=10.5, 5.6 Hz, 3H), 3.51-3.44 (m, 12H), 3.36 (dt, J=9.6, 6.0 Hz, 3H), 3.01-2.95 (m, 12H), 2.29 (t, J=7.4 Hz, 2H), 2.23 (t, J=6.3 Hz, 6H), 2.05 (s, 9H), 1.99 (t, J=7.0 Hz, 8H), 1.94 (s, 9H), 1.84 (s, 9H), 1.72 (s, 9H), 1.50-1.14 (m, 34H); MS (ESI): 1049.0 (M/2+H)+.

Step 8: To a round bottom flask flushed with Ar was added 10% Pd/C (165 mg, 0.835 mmol) and EtOAc (15 mL). A solution of Benzyl protected tris-GalNAc (1.75 g, 0.835 mmol) in methanol (15 mL) was added followed by triethylsilane (2.67 ml, 16.70 mmol) dropwise. The mixture was stirred at room temperature for 3 hrs. LC-MS showed the reaction was complete, diluted with EtOAc, and filtered through celite, washed with 20% MeOH in EtOAc, concentrated under reduced pressure to give 1-

(((2R,3R,4R,5R, 6R)-3-acetamido-4,5-diacetoxy-6-(acetoxymethyl)tetrahydro-2H-pyran-2-yl)oxy)-16,16-bis((3-((3-(5-(((2R,3R,4R,5R,6R)-3-acetamido-4,5-diacetoxy-6-(acetoxymethyl)tetrahydro-2H-pyran-2-yl)oxy)pentanamido)propyl)amino)-3-oxopropoxy)methyl)-5,11,18-trioxo-14-oxa-6,10,17-triazanonacosan-29-oic acid (1.67 g, 0.832 mmol, 100% yield) as a white solid. $^1$H NMR (400 MHz, DMSO-d6) δ 11.95 (s, 1H), 7.83-7.74 (m, 6H), 7.69 (t, J=5.7 Hz, 3H), 6.93 (s, 1H), 5.16 (d, J=3.4 Hz, 3H), 4.92 (dd, J=11.2, 3.4 Hz, 3H), 4.43 (d, J=8.4 Hz, 3H), 4.01-3.94 (m, 9H), 3.82 (dt, J=11.3, 8.8 Hz, 3H), 3.66 (dt, J=10.7, 5.6 Hz, 3H), 3.54-3.43 (m, 12H), 3.41-3.33 (m, 3H), 3.03-2.94 (m, 12H), 2.24 (t, J=7.4 Hz, 10H), 2.14 (t, J=7.4 Hz, 2H), 2.06 (s, 9H), 2.00 (t, J=7.2 Hz, 8H), 1.95 (s, 9H), 1.84 (s, 9H), 1.73 (s, 9H), 1.51-1.14 (m, 34H). MS (ESI): 1003.8 (M/2+H)+.

Example 39. Synthesis of Ligand

Synthesis of 18,18-bis(17-((1S,2R,3R,4R,5S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5S)-4-acetamido-2,3-dihydroxy-6,8-dioxabicyclo[3.2.1]octan-1-yl)-7,13,20-trioxo-2,16-dioxa-8,12,19-triazatetracosan-24-oic acid

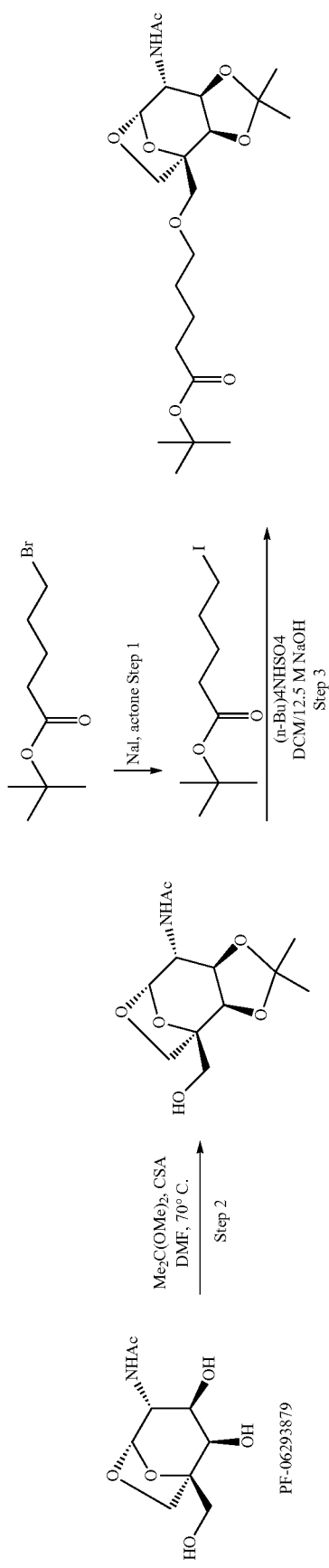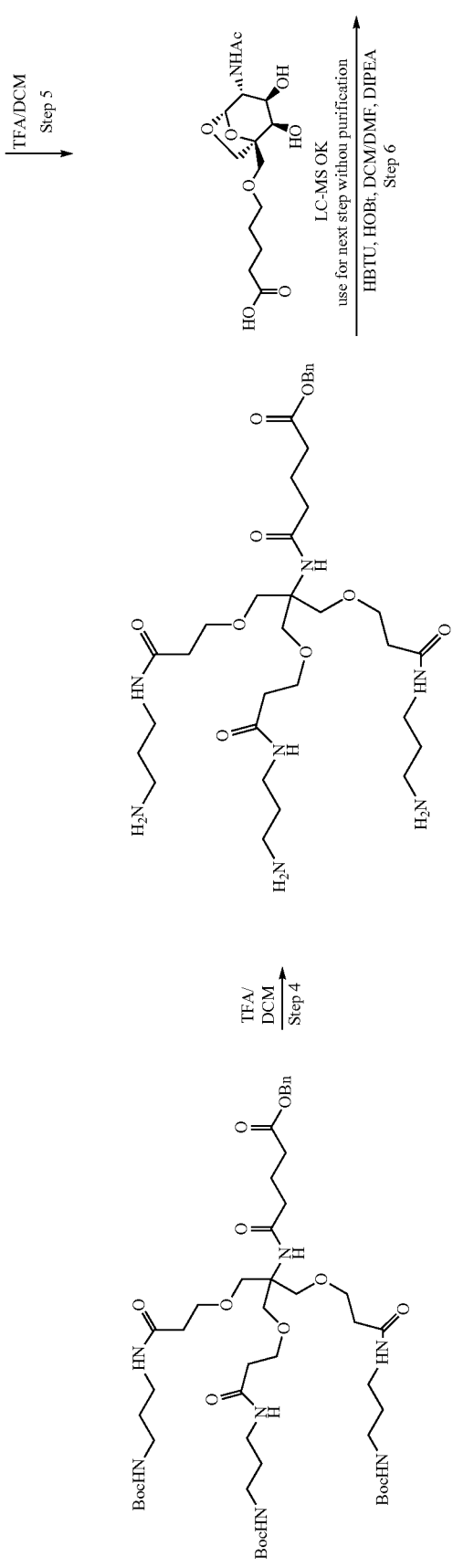

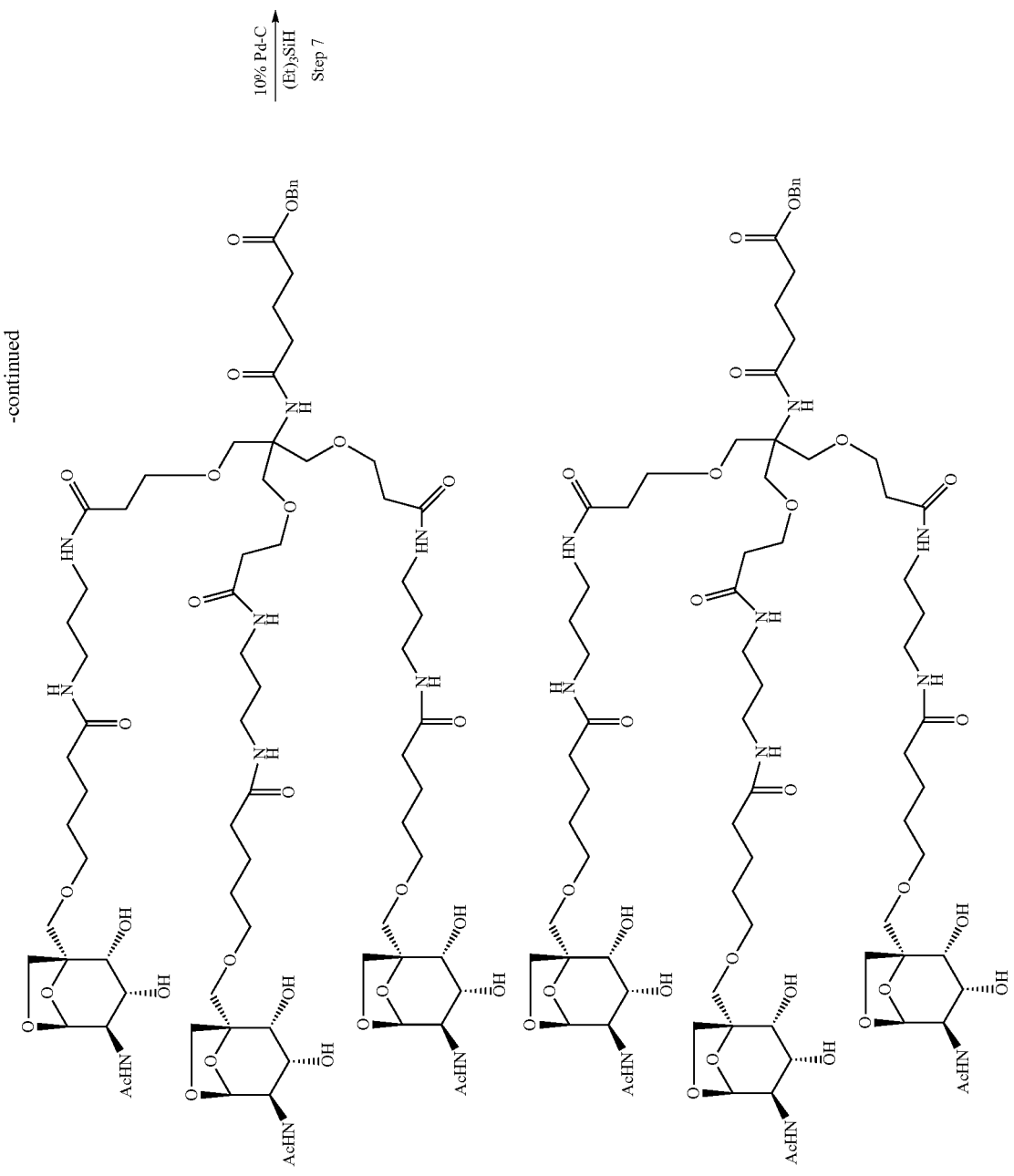

Step 1: To a solution of tert-butyl 5-bromopentanoate (4.0 g, 16.87 mmol) in acetone (80 mL) was added NaI (7.59 g, 50.6 mmol). The reaction mixture was stirred at 57° C. for 2 hrs, filtered, and washed with EtOAc. Solvent was evaporated under reduced pressure to give a residue, which was dissolved in EtOAc, washed with water, brine, dried over $Na_2SO_4$, concentrated to give a residue, which was purified by ISCO (40 g column) eluting with 20% EtOAc in hexane to 50% EtOAc in hexane to give tert-butyl 5-iodopentanoate 6 (4.54 g, 15.98 mmol, 95% yield) as a yellow oil. $^1$H NMR (500 MHz, Chloroform-d) δ 3.19 (t, J=6.9 Hz, 2H), 2.24 (t, J=7.3 Hz, 2H), 1.86 (p, J=7.1 Hz, 2H), 1.70 (p, J=7.4 Hz, 2H), 1.45 (s, 9H).

Step 2: To a solution of N-((1S,2R,3R,4R,5S)-2,3-dihydroxy-1-(hydroxymethyl)-6,8-dioxabicyclo[3.2.1]octan-4-yl)acetamide (600 mg, 2.57 mmol) in DMF (15 mL) was added 2,2-dimethoxypropane (2087 μl, 17.03 mmol) followed by (+/−)-camphor-10-sulphonic acid (264 mg, 1.135 mmol). The reaction mixture was stirred at 70° C. for 24 hrs. The reaction mixture was cooled down to room temperature, and then methanol (2.5 mL) was added. The reaction mixture was stirred at room temperature for 30 minutes and neutralized with TEA (0.10 mL). The solvent was evaporated and the residue was coevaporated with toluene. The residue was purified by ISCO (24 g gold) eluting with EtOAc to 10% MeOH in EtOAc to give N-((3aR,4S,7S,8R,8aR)-4-(hydroxymethyl)-2,2-dimethylhexahydro-4,7-epoxy[1,3]dioxolo[4,5-d]oxepin-8-yl)acetamide 7 (666 mg, 2.437 mmol, 95% yield). 41 NMR (500 MHz, DMSO-d6) δ 8.09 (d, J=8.1 Hz, 1H), 5.15-5.05 (m, 2H), 4.26 (d, J=5.8 Hz, 1H), 4.09 (dd, J=7.3, 5.8 Hz, 1H), 3.80-3.60 (m, 5H), 1.83 (s, 3H), 1.37 (s, 3H), 1.26 (s, 3H); MS, 274.3 (M+H)+.

Step 3: To a solution of tert-butyl 5-iodopentanoate (1310 mg, 4.61 mmol) and N-((3 aR,4 S,7 S, 8R, 8aR)-4-(hydroxymethyl)-2,2-dimethylhexahydro-4,7-epoxy[1,3]dioxolo[4,5-d]oxepin-8-yl)acetamide 7 (420 mg, 1.537 mmol) in DCM (10.5 mL) was added tetrabutylammonium hydrogensulfate (783 mg, 2.305 mmol) followed by 12.5 M sodium hydroxide solution (7 mL). The reaction mixture was stirred at room temperature for 24 hrs. The reaction mixture was diluted with DCM and water, extracted with DCM (2×).

The organic layer was washed with 1 N HCl solution, and dried over sodium sulfate. Solvent was concentrated under reduce pressure to give a residue. The resulting crude material was added ethyl acetate (30 mL) and sonicated for 5 minutes. The result precipitate was filtered, washed with ethyl acetate (10 mL×2). LC MS showed the filter doesn't contain desired product and was tetrabutylammonium salt. The filtrate was concentrated under reduced pressure to give a residue, which was purified by ISCO (40 g silica gel gold cartridge) eluting with 50% EtOAc in hexane to EtOAc to give tert-butyl 5-(((3 aR,4 S,7 S,8R,8aR)-8-acetamido-2,2-dimethylhexahydro-4,7-epoxy[1,3]dioxolo[4,5-d]oxepin-4-yl)methoxy)pentanoate (0.470 g, 1.094 mmol, 71.2% yield) as a yellowish oil. $^1$H NMR (500 MHz, Chloroform-d) δ 5.56 (d, J=9.1 Hz, 1H), 4.21 (d, J=5.9 Hz, 1H), 4.12 (dtd, J=7.7, 3.8, 1.7 Hz, 1H), 3.99 (t, J=6.3 Hz, 1H), 3.90 (d, J=9.5 Hz, 1H), 3.77 (d, J=2.0 Hz, 2H), 3.67 (d, J=9.5 Hz, 1H), 3.52 (ddt, J=30.5, 9.2, 5.8 Hz, 2H), 2.23 (t, J=7.1 Hz, 2H), 2.03 (d, J=14.5 Hz, 3H), 1.65-1.55 (m, 7H), 1.44 (s, 9H), 1.35 (s, 3H); MS, 452.4 (M+Na)+.

Step 4: To a solution of benzyl 15,15-bis(13,13-dimethyl-5,11-dioxo-2,12-dioxa-6,10-diazatetradecyl)-2,2-dimethyl-4,10,17-trioxo-3,13-dioxa-5,9,16-triazahenicosan-21-oate (0.168 g, 0.166 mmol) in DCM (3 mL) was added TFA (3 mL). The reaction mixture was stirred at room temperature for 3 hrs. LC-MS showed the reaction was completed. Solvent was evaporated under reduced pressure to give benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate as a colorless oil. MS, 710.5 (M+H)+. Directly use for next step without purification.

Step 5: To a solution of tert-butyl 5-(((3aR,4S,7S,8R,8aR)-8-acetamido-2,2-dimethylhexahydro-4,7-epoxy[1,3]dioxolo[4,5-d]oxepin-4-yl)methoxy)pentanoate (285 mg, 0.664 mmol) in DCM (5 mL) was added TFA (5 mL) was stirred at room temperature for 4 hrs. LC-MS showed the reaction was complete. Solvent was evaporated to give 5-(((1S,2R,3R,4R,5S)-4-acetamido-2,3-dihydroxy-6,8-dioxabicyclo[3.2.1]octan-1-yl)methoxy)pentanoic acid. MS (ESI): 334.3 (M+H)+. Directly use for next step without purification.

Step 6: To a solution of 5-(((1S,2R,3R,4R,5S)-4-acetamido-2,3-dihydroxy-6,8-dioxabicyclo[3.2.1]octan-1-yl)methoxy)pentanoic acid (221 mg, 0.664 mmol) in DCM (10 mL) was added DIPEA (2313 μl, 13.28 mmol), HBTU (208 mg, 0.548 mmol), HOBT (67.3 mg, 0.498 mmol), a solution of benzyl 5-((1,19-diamino-10-((3-((3-aminopropyl)amino)-3-oxopropoxy)methyl)-5,15-dioxo-8,12-dioxa-4,16-diazanonadecan-10-yl)amino)-5-oxopentanoate (118 mg, 0.166 mmol) (GL08-02) in DMF (3.0 mL) and DCM (5.0 mL). The reaction mixture was stirred at room temperature for overnight. LC-MS showed the desired product. Solvent was evaporated under reduced pressure to give a residue, which was purified by ISCO (24 g gold cartridge) eluting with DCM to 80% MeOH in DCM to give benzyl 18,18-bi s(17-((1S,2R,3R,4R,5 S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5 S)-4-acetamido-2,3-dihydroxy-6,8-dioxabicyclo[3.2.1]octan-1-yl)-7,13,20-trioxo-2,16-dioxa-8,12,19-triazatetracosan-24-oate (272 mg, 0.164 mmol, 99% yield) (product @ tube 30 to 42 (40% MeOH in DCM to 60% MeOH in DCM)

$^1$H NMR (500 MHz, DMSO-d6) δ 7.89 (d, J=7.8 Hz, 3H), 7.81 (t, J=5.7 Hz, 3H), 7.75 (s, 3H), 7.34 (q, J=7.5, 6.9 Hz, 5H), 7.05 (s, 1H), 5.07 (s, 5H), 4.83 (d, J=5.3 Hz, 3H), 4.56 (d, J=7.1 Hz, 3H), 3.73 (dd, J=23.3, 9.2 Hz, 6H), 3.64 (d, J=7.0 Hz, 6H), 3.58-3.35 (m, 27H), 3.02 (p, J=6.2 Hz, 12H), 2.33 (t, J=7.6 Hz, 2H), 2.26 (t, J=6.4 Hz, 6H), 2.10 (t, J=7.6 Hz, 2H), 2.04 (t, J=7.4 Hz, 6H), 1.82 (s, 9H), 1.72 (q, J=7.6 Hz, 2H), 1.52-1.39 (m, 18H); MS (ESI), 1656.3 (M+H)+.

Step 7: To a solution of benzyl 18,18-bis(17-((1S,2R,3R,4R,5S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5 S)-4-acetamido-2,3-dihydroxy-6,8-dioxabicyclo[3.2.1]octan-1-yl)-7,13,20-trioxo-2,16-dioxa-8,12,19-triazatetracosan-24-oate (270 mg, 0.163 mmol) in EtOAc (10 mL) was added 10% Pd—C(50 mg), and MeOH (5.0 mL), and triethylsilane (1042 μl, 6.52 mmol). The reaction mixture was stirred at room temperature for 1 hr, filtered, and concentrated to give 18,18-bis(17-((1S,2R,3R,4R,5 S)-4-acetamido-2,3-dihydroxy-6,8-dioxabicyclo[3.2.1]octan-1-yl)-5,11-dioxo-2,16-dioxa-6,10-diazahepta-decyl)-1-((1S,2R,3R,4R,5 S)-4-acetamido-2,3-dihydroxy-6,8-dioxabicyclo[3.2.1]octan-1-yl)-7,13,20-trioxo-2,16-dioxa-8,12,19-triazatetracosan-24-oic acid (246 mg, 0.157 mmol, 96% yield) as a white solid. $^1$H NMR (500 MHz, DMSO-d6) δ 11.99 (brs, 1H), 7.89 (d, J=7.9 Hz, 3H), 7.82 (t, J=5.4 Hz, 3H), 7.75 (t, J=5.7 Hz, 3H), 7.03 (s, 1 H), 5.07 (d, J=1.6 Hz, 3H), 4.83 (brs, 3H), 4.56 (brs, 3H), 3.79-3.68 (m, 6H), 3.64 (d, J=7.2 Hz, 6H), 3.58-3.34 (m, 27H), 3.02 (p, J=6.3 Hz, 12H), 2.27 (t, J=6.4 Hz, 6H), 2.17 (t, J=7.5 Hz, 2H), 2.08 (t, J=7.5 Hz, 2H), 2.04 (t, J=7.3 Hz, 6H), 1.82 (s, 9H), 1.65 (p, J=7.5 Hz, 2H), 1.54-1.40 (m, 18H); MS(ESI), 1566.3 (M+H)+.

Example 40. Synthesis of Ligand

Synthesis of 18,18-bis(17-((1S,2R,3R,4R,5S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5S)-4-acetamido-2,3-dihydroxy-6,8-dioxabicyclo[3.2.1]octan-1-yl)-7,13,20-trioxo-2,16-dioxa-8,12,19-triazahentriacontan-31-oic acid

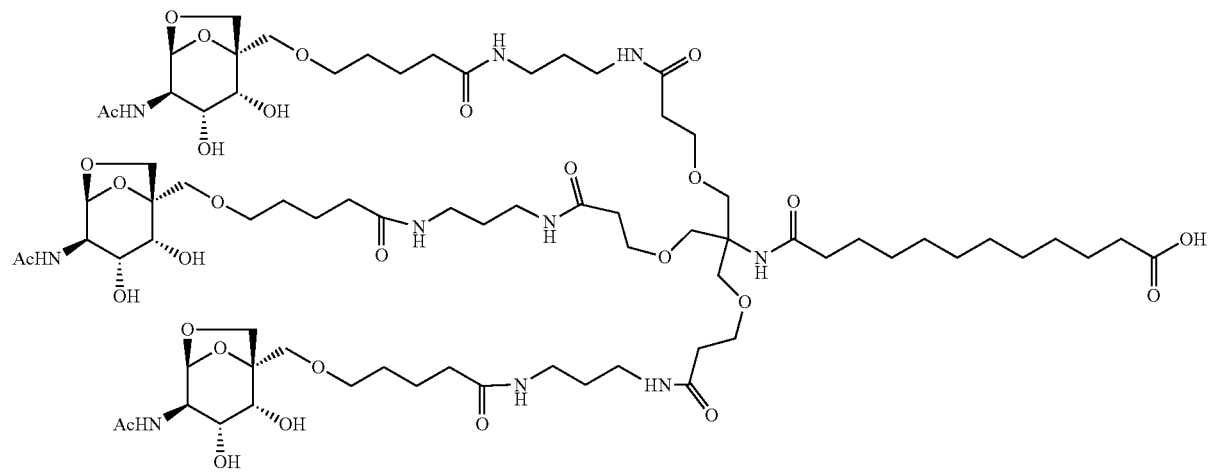 [SMILES: CC(=O)N[C@H]1[C@H]2OC[C@](COCCCCC(=O)NCCCNC(=O)CCOCC(COCCC(=O)NCCCNC(=O)CCCCOC[C@@]34CO[C@@H](O3)[C@H](NC(C)=O)[C@@H](O)[C@H]4O)(COCCC(=O)NCCCNC(=O)CCCCOC[C@@]34CO[C@@H](O3)[C@H](NC(C)=O)[C@@H](O)[C@H]4O)NC(=O)CCCCCCCCCCC(=O)O)(O2)[C@H](O)[C@@H]1O]

18,18-bis(17-((1S,2R,3R,4R,5 S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5 S)-4-acetamido-2,3-dihydroxy-6,8-dioxabicyclo[3.2.1]octan-1-yl)-'7,13,20-trioxo-2,16-dioxa-8,12,19-triazahentriacontan-31-oic acid was synthesized using the same procedure as 18,18-bis(17-((1S,2R,3R,4R,5S)-4-acetamido-2,3-dihydroxy-6,8-dioxabicyclo[3.2.1]octan-1-yl)-5,11-dioxo-2,16-dioxa-6,10-diazaheptadecyl)-1-((1S,2R,3R,4R,5 S)-4-acetamido-2,3-dihydroxy-6,8-dioxabicyclo[3.2.1]octan-1-yl)-7,13,20-trioxo-2,16-dioxa-8,12,19-triazatetracosan-24-oic acid. $^1$H NMR (400 MHz, DMSO-d6) δ 7.90 (d, J=7.8 Hz, 3H), 7.83 (t, J=5.7 Hz, 3H), 7.76 (t, J=5.7 Hz, 3H), 6.98 (d, J=6.2 Hz, 1H), 5.09 (s, 3H), 3.81-3.69 (m, 6H), 3.69-3.62 (m, 6H), 3.62-3.40 (m, 24H), 3.04 (p, J=6.1 Hz, 9H), 2.28 (t, J=6.4 Hz, 4H), 2.18 (t, J=7.3 Hz, 2H), 2.06 (t, J=7.7 Hz, 6H), 1.84 (s, 6H), 1.48 (tq, J=14.9, 7.4 Hz, 16H), 1.23 (s, 8H). MS(ESI), 1664.0 (M+H)$^+$.

EQUIVALENTS

Having described some illustrative embodiments of the present disclosure, it should be apparent to those skilled in the art that the foregoing is merely illustrative and not limiting, having been presented by way of example only. Numerous modifications and other illustrative embodiments are within the scope of one of ordinary skill in the art and are contemplated as falling within the scope of the disclosure. In particular, although many of the examples presented herein involve specific combinations of method acts or system elements, it should be understood that those acts and those elements may be combined in other ways to accomplish the same objectives. Acts, elements, and features discussed only in connection with one embodiment are not intended to be excluded from a similar role in other embodiments. Further, for the one or more means-plus-function limitations recited, for example, in claimed inventions, if any, the means are not intended to be limited to the means disclosed herein for performing the recited function, but are intended to cover in scope any means, known now or later developed, for performing the recited function.

Use of ordinal terms such as "first", "second", "third", etc., in claims to modify a claim element does not by itself connote any priority, precedence, or order of one claim element over another or the temporal order in which acts of a method are performed, but are used merely as labels to distinguish one claim element having a certain name from another element having a same name (but for use of the ordinal term) to distinguish the claim elements. Similarly, use of a), b), etc., or i), ii), etc. does not by itself connote any priority, precedence, or order of steps in the claims. Similarly, use of these terms in the specification does not by itself connote any required priority, precedence, or order. Neither does use of any such terms indicate number of elements in described (including claimed) inventions.

The foregoing written specification is sufficient to enable one skilled in the art to practice any invention described in the present disclosure. The present disclosure is not to be limited in scope by examples provided, which are intended as illustrations of one or more aspects of described inventions and other functionally equivalent embodiments are within the scope of described inventions. Various modifications of described inventions in addition to those shown and described herein will become apparent to those skilled in the art from the foregoing description and fall within the scope of described inventions. Advantages and objects of described inventions are not necessarily encompassed by each embodiment of described inventions.

The foregoing written specification is considered to be sufficient to enable one skilled in the art to practice the invention. The present disclosure is not to be limited in scope by examples provided, since the examples are intended as a single illustration of one aspect of the invention and other functionally equivalent embodiments are within the scope of the invention. Various modifications of the invention in addition to those shown and described

LENGTHY TABLES

The patent contains a lengthy table section. A copy of the table is available in electronic form from the USPTO web site (https://seqdata.uspto.gov/?pageRequest=docDetail&DocID=US11603532B2). An electronic copy of the table will also be available from the USPTO upon request and payment of the fee set forth in 37 CFR 1.19(b)(3).

SEQUENCE LISTING (3951 sequences)

SEQ ID NO: 1 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 2 - RNA, 21 nt, Artificial Sequence
  Description of Artificial Sequence: Synthetic oligonucleotide
gcauagcgagcgagggaaaac

SEQ ID NO: 3 - RNA, 21 nt, Artificial Sequence
  Description of Artificial Sequence: Synthetic oligonucleotide
guuuucccucgcucgcuaugc

SEQ ID NO: 4 - RNA, 21 nt, Artificial Sequence
  Description of Artificial Sequence: Synthetic oligonucleotide
gcauagcgagcgagggaaaac

SEQ ID NO: 5 - DNA, 21 bp, Artificial Sequence
  Description of Artificial Sequence: Synthetic oligonucleotide
  Description of Combined DNA/RNA Molecule: Synthetic oligonucleotide
tuuuucccucgcucgcuautu

SEQ ID NO: 6 - DNA, 19 bp, Artificial Sequence
  Description of Artificial Sequence: Synthetic oligonucleotide
aaagctggacaagaagcta

SEQ ID NO: 7 - DNA, 20 bp, Artificial Sequence
  Description of Artificial Sequence: Synthetic oligonucleotide
aaccttagctgggtctgcca

SEQ ID NO: 8 - DNA, 19 bp, Artificial Sequence
  Description of Artificial Sequence: Synthetic oligonucleotide
aagcagcttcttgtccagc

SEQ ID NO: 9 - DNA, 20 bp, Artificial Sequence
  Description of Artificial Sequence: Synthetic oligonucleotide
aagggaggcatcctcggcct

SEQ ID NO: 10 - DNA, 20 bp, Artificial Sequence
  Description of Artificial Sequence: Synthetic oligonucleotide
aagttggtctgacctcaggg

SEQ ID NO: 11 - DNA, 26 bp, Artificial Sequence
  Description of Artificial Sequence: Synthetic oligonucleotide
aataaagctggacaagaagctgctat

SEQ ID NO: 12 - DNA, 19 bp, Artificial Sequence
  Description of Artificial Sequence: Synthetic oligonucleotide
aatactgtcccttttaagc

SEQ ID NO: 13 - DNA, 20 bp, Artificial Sequence
  Description of Artificial Sequence: Synthetic oligonucleotide
acaccaccctctcaacttca

SEQ ID NO: 14 - DNA, 20 bp, Artificial Sequence
  Description of Artificial Sequence: Synthetic oligonucleotide
acacccatgtccccactgga

SEQ ID NO: 15 - DNA, 24 bp, Artificial Sequence
  Description of Artificial Sequence: Synthetic oligonucleotide
accgccaaggatgcactgagcagc

SEQ ID NO: 16 - DNA, 19 bp, Artificial Sequence
  Description of Artificial Sequence: Synthetic oligonucleotide
acttgtccagctttattgg

SEQ ID NO: 17 - DNA, 24 bp, Artificial Sequence
  Description of Artificial Sequence: Synthetic oligonucleotide
agcagcgtgcaggagtcccaggtg

SEQ ID NO: 18 - DNA, 18 bp, Artificial Sequence
  Description of Artificial Sequence: Synthetic oligonucleotide
agcagcttcttgtccagc

SEQ ID NO: 19 - DNA, 19 bp, Artificial Sequence
  Description of Artificial Sequence: Synthetic oligonucleotide
agcagcttcttgtccagct

SEQ ID NO: 20 - DNA, 17 bp, Artificial Sequence
  Description of Artificial Sequence: Synthetic oligonucleotide
agcagcttcttgtccag

SEQ ID NO: 21 - DNA, 20 bp, Artificial Sequence
  Description of Artificial Sequence: Synthetic oligonucleotide
agccacggctgaagttggtc

SEQ ID NO: 22 - DNA, 20 bp, Artificial Sequence
  Description of Artificial Sequence: Synthetic oligonucleotide
agccatcggtcacccagccc

SEQ ID NO: 23 - DNA, 20 bp, Artificial Sequence
  Description of Artificial Sequence: Synthetic oligonucleotide
agcttcttgtccagctttat

SEQ ID NO: 24 - DNA, 14 bp, Artificial Sequence
  Description of Artificial Sequence: Synthetic oligonucleotide
agcttcttgtccag

SEQ ID NO: 25 - DNA, 18 bp, Artificial Sequence
  Description of Artificial Sequence: Synthetic oligonucleotide
agcttcttgtccagcttt

SEQ ID NO: 26 - DNA, 22 bp, Artificial Sequence
  Description of Artificial Sequence: Synthetic oligonucleotide
agcttcttgtccagctttattt

SEQ ID NO: 27 - DNA, 16 bp, Artificial Sequence
  Description of Artificial Sequence: Synthetic oligonucleotide
agcttcttgtccagct

SEQ ID NO: 28 - DNA, 18 bp, Artificial Sequence
  Description of Artificial Sequence: Synthetic oligonucleotide
agcttcttgtccagcttt

SEQ ID NO: 29 - DNA, 19 bp, Artificial Sequence
  Description of Artificial Sequence: Synthetic oligonucleotide
agcttcttgtccagcttta

SEQ ID NO: 30 - DNA, 20 bp, Artificial Sequence
  Description of Artificial Sequence: Synthetic oligonucleotide
aggcatcctcggcctctgaa

SEQ ID NO: 31 - DNA, 20 bp, Artificial Sequence
  Description of Artificial Sequence: Synthetic oligonucleotide
aggccagcatgcctggaggg

SEQ ID NO: 32 - DNA, 19 bp, Artificial Sequence
  Description of Artificial Sequence: Synthetic oligonucleotide
aggccagcatgcctggagg

SEQ ID NO: 33 - DNA, 20 bp, Artificial Sequence
  Description of Artificial Sequence: Synthetic oligonucleotide
agggaggcatcctcggcctc

SEQ ID NO: 34 - DNA, 19 bp, Artificial Sequence
  Description of Artificial Sequence: Synthetic oligonucleotide
agggttacatgaagcacgc

SEQ ID NO: 35 - DNA, 20 bp, Artificial Sequence
  Description of Artificial Sequence: Synthetic oligonucleotide
aggtctcaggcagccacggc

SEQ ID NO: 36 - DNA, 18 bp, Artificial Sequence
  Description of Artificial Sequence: Synthetic oligonucleotide
aggtctcaggcagccacg

SEQ ID NO: 37 - DNA, 19 bp, Artificial Sequence
  Description of Artificial Sequence: Synthetic oligonucleotide
aggtctcaggcagccacgg

SEQ ID NO: 38 - DNA, 19 bp, Artificial Sequence
  Description of Artificial Sequence: Synthetic oligonucleotide
agtccagctttattgggag

SEQ ID NO: 39 - DNA, 20 bp, Artificial Sequence
  Description of Artificial Sequence: Synthetic oligonucleotide
atagcagcttcttgtcgagc

SEQ ID NO: 40 - DNA, 20 bp, Artificial Sequence
  Description of Artificial Sequence: Synthetic oligonucleotide
atagcagcttcttgtccagc

SEQ ID NO: 41 - DNA, 18 bp, Artificial Sequence
  Description of Artificial Sequence: Synthetic oligonucleotide
atagcagcttcttgtcca

SEQ ID NO: 42 - DNA, 19 bp, Artificial Sequence
  Description of Artificial Sequence: Synthetic oligonucleotide
atagcagcttcttgtccag

SEQ ID NO: 43 - DNA, 20 bp, Artificial Sequence
  Description of Artificial Sequence: Synthetic oligonucleotide
atccttggcggtcttggtgg

SEQ ID NO: 44 - DNA, 20 bp, Artificial Sequence
  Description of Artificial Sequence: Synthetic oligonucleotide
atcggtcacccagcccctgg

SEQ ID NO: 45 - DNA, 19 bp, Artificial Sequence
  Description of Artificial Sequence: Synthetic oligonucleotide
atcttgtccagctttattg

SEQ ID NO: 46 - DNA, 19 bp, Artificial Sequence
  Description of Artificial Sequence: Synthetic oligonucleotide
atgaagcacgccaccaaga

SEQ ID NO: 47 - DNA, 32 bp, Artificial Sequence
  Description of Artificial Sequence: Synthetic oligonucleotide
atgcactgagcagcgtgcaggagtcccaggtg

SEQ ID NO: 48 - DNA, 19 bp, Artificial Sequence
  Description of Artificial Sequence: Synthetic oligonucleotide
atgtccagctttattggga

SEQ ID NO: 49 - DNA, 23 bp, Artificial Sequence
  Description of Artificial Sequence: Synthetic oligonucleotide
caataaagctggacaagaagcta

SEQ ID NO: 50 - DNA, 30 bp, Artificial Sequence
  Description of Artificial Sequence: Synthetic oligonucleotide
caccaagaccgccaaggatgcactgagcag

SEQ ID NO: 51 - DNA, 20 bp, Artificial Sequence
  Description of Artificial Sequence: Synthetic oligonucleotide
cacccattgggactgggatc

SEQ ID NO: 52 - DNA, 20 bp, Artificial Sequence
  Description of Artificial Sequence: Synthetic oligonucleotide
cacgctgctcagtgcatcct

SEQ ID NO: 53 - DNA, 20 bp, Artificial Sequence
  Description of Artificial Sequence: Synthetic oligonucleotide
cacggctgaagttggtctga

SEQ ID NO: 54 - DNA, 20 bp, Artificial Sequence
  Description of Artificial Sequence: Synthetic oligonucleotide
cactgagaatactgtcccaa

SEQ ID NO: 55 - DNA, 18 bp, Artificial Sequence
  Description of Artificial Sequence: Synthetic oligonucleotide
cactgagaatactgtccc

SEQ ID NO: 56 - DNA, 24 bp, Artificial Sequence
  Description of Artificial Sequence: Synthetic oligonucleotide
cagccgtggctgcctgagacctca

SEQ ID NO: 57 - DNA, 25 bp, Artificial Sequence
  Description of Artificial Sequence: Synthetic oligonucleotide
cagccgtggctgcctgagacctcaa

SEQ ID NO: 58 - DNA, 20 bp, Artificial Sequence
  Description of Artificial Sequence: Synthetic oligonucleotide
cagcttcttgtccagcttta

SEQ ID NO: 59 - DNA, 18 bp, Artificial Sequence
  Description of Artificial Sequence: Synthetic oligonucleotide
cagcttcttgtccagctt

SEQ ID NO: 60 - DNA, 19 bp, Artificial Sequence
  Description of Artificial Sequence: Synthetic oligonucleotide
cagcttcttgtccagcttt

SEQ ID NO: 61 - DNA, 22 bp, Artificial Sequence
  Description of Artificial Sequence: Synthetic oligonucleotide
caggggctgggtgaccgatggc

SEQ ID NO: 62 - DNA, 20 bp, Artificial Sequence
  Description of Artificial Sequence: Synthetic oligonucleotide
cagtgcatccttggcggtct

SEQ ID NO: 63 - DNA, 20 bp, Artificial Sequence
  Description of Artificial Sequence: Synthetic oligonucleotide
catagcagcttcttgtccag

SEQ ID NO: 64 - DNA, 20 bp, Artificial Sequence
  Description of Artificial Sequence: Synthetic oligonucleotide
catcctcggcctctgaagct

SEQ ID NO: 65 - DNA, 20 bp, Artificial Sequence
  Description of Artificial Sequence: Synthetic oligonucleotide
catccttggcggtcttggtg

SEQ ID NO: 66 - DNA, 19 bp, Artificial Sequence
  Description of Artificial Sequence: Synthetic oligonucleotide
catcctcggcctctgaagc

SEQ ID NO: 67 - DNA, 18 bp, Artificial Sequence
  Description of Artificial Sequence: Synthetic oligonucleotide
catccttggcggtcttgg

SEQ ID NO: 68 - DNA, 20 bp, Artificial Sequence
  Description of Artificial Sequence: Synthetic oligonucleotide
catcggtcacccagcccctg

SEQ ID NO: 69 - DNA, 24 bp, Artificial Sequence
  Description of Artificial Sequence: Synthetic oligonucleotide
ccaccaagaccgccaaggatgcac

SEQ ID NO: 70 - DNA, 20 bp, Artificial Sequence
  Description of Artificial Sequence: Synthetic oligonucleotide
ccacctgggactcctgcacg

SEQ ID NO: 71 - DNA, 19 bp, Artificial Sequence
  Description of Artificial Sequence: Synthetic oligonucleotide
ccacctgggactcctgcac

SEQ ID NO: 72 - DNA, 20 bp, Artificial Sequence
  Description of Artificial Sequence: Synthetic oligonucleotide
ccacggctgaagttggtctg

SEQ ID NO: 73 - DNA, 20 bp, Artificial Sequence
  Description of Artificial Sequence: Synthetic oligonucleotide
ccagctttattagggacagc

SEQ ID NO: 74 - DNA, 19 bp, Artificial Sequence
  Description of Artificial Sequence: Synthetic oligonucleotide
ccagctttattgggaggcc

SEQ ID NO: 75 - DNA, 17 bp, Artificial Sequence
  Description of Artificial Sequence: Synthetic oligonucleotide
ccagctttattagggac

SEQ ID NO: 76 - DNA, 18 bp, Artificial Sequence
  Description of Artificial Sequence: Synthetic oligonucleotide
ccagctttattgggaggc

SEQ ID NO: 77 - DNA, 20 bp, Artificial Sequence
  Description of Artificial Sequence: Synthetic oligonucleotide
ccaggagcgccaggagggca

SEQ ID NO: 78 - DNA, 20 bp, Artificial Sequence
  Description of Artificial Sequence: Synthetic oligonucleotide
ccatcggtcacccagcccct

SEQ ID NO: 79 - DNA, 18 bp, Artificial Sequence
  Description of Artificial Sequence: Synthetic oligonucleotide
ccatcggtcacccagccc

SEQ ID NO: 80 - DNA, 18 bp, Artificial Sequence
  Description of Artificial Sequence: Synthetic oligonucleotide
ccctggagattgcaggac

SEQ ID NO: 81 - DNA, 19 bp, Artificial Sequence
  Description of Artificial Sequence: Synthetic oligonucleotide
ccgtggctgcctgagacct

SEQ ID NO: 82 - DNA, 18 bp, Artificial Sequence
  Description of Artificial Sequence: Synthetic oligonucleotide
cctcagtctgcttcgcac

SEQ ID NO: 83 - DNA, 22 bp, Artificial Sequence
  Description of Artificial Sequence: Synthetic oligonucleotide
cctcagtctgcttcgcaccttc

SEQ ID NO: 84 - DNA, 20 bp, Artificial Sequence
  Description of Artificial Sequence: Synthetic oligonucleotide
cctcagtctgcttcgcacct

SEQ ID NO: 85 - DNA, 19 bp, Artificial Sequence
  Description of Artificial Sequence: Synthetic oligonucleotide
cctccaggcatgctggcct

SEQ ID NO: 86 - DNA, 20 bp, Artificial Sequence
  Description of Artificial Sequence: Synthetic oligonucleotide
cctcccaataaagctggaca

SEQ ID NO: 87 - DNA, 19 bp, Artificial Sequence
  Description of Artificial Sequence: Synthetic oligonucleotide
cctcggcctctgaagctcg

SEQ ID NO: 88 - DNA, 20 bp, Artificial Sequence
  Description of Artificial Sequence: Synthetic oligonucleotide
cctcggcctctgaagctcgg

SEQ ID NO: 89 - DNA, 20 bp, Artificial Sequence
  Description of Artificial Sequence: Synthetic oligonucleotide
cctctgaaagtggattacca

SEQ ID NO: 90 - DNA, 20 bp, Artificial Sequence
  Description of Artificial Sequence: Synthetic oligonucleotide
cctctgaagctcgggcagag

SEQ ID NO: 91 - DNA, 20 bp, Artificial Sequence
  Description of Artificial Sequence: Synthetic oligonucleotide
cctggagattgcaggaccca

SEQ ID NO: 92 - DNA, 20 bp, Artificial Sequence
  Description of Artificial Sequence: Synthetic oligonucleotide
cctgggactcctgcacgctg

SEQ ID NO: 93 - DNA, 19 bp, Artificial Sequence
  Description of Artificial Sequence: Synthetic oligonucleotide
ccttgcaggaaccccagca

SEQ ID NO: 94 - DNA, 20 bp, Artificial Sequence
  Description of Artificial Sequence: Synthetic oligonucleotide
ccttggcggtcttggtggcg

SEQ ID NO: 95 - DNA, 19 bp, Artificial Sequence
  Description of Artificial Sequence: Synthetic oligonucleotide
ccttggcggtcttggtggc

SEQ ID NO: 96 - DNA, 19 bp, Artificial Sequence
  Description of Artificial Sequence: Synthetic oligonucleotide
cggcctctgaagctcgggc

SEQ ID NO: 97 - DNA, 20 bp, Artificial Sequence
  Description of Artificial Sequence: Synthetic oligonucleotide
cggcctctgaagctcgggca

SEQ ID NO: 98 - DNA, 19 bp, Artificial Sequence
  Description of Artificial Sequence: Synthetic oligonucleotide
cggtcacccagcccctggc

SEQ ID NO: 99 - DNA, 20 bp, Artificial Sequence
  Description of Artificial Sequence: Synthetic oligonucleotide
cgtgcttcatgtaaccctgc

SEQ ID NO: 100 - DNA, 17 bp, Artificial Sequence
  Description of Artificial Sequence: Synthetic oligonucleotide
ctcaggcagccacggct

SEQ ID NO: 101 - DNA, 20 bp, Artificial Sequence
  Description of Artificial Sequence: Synthetic oligonucleotide
ctcctgcacgctgctcagtg

SEQ ID NO: 102 - DNA, 20 bp, Artificial Sequence
  Description of Artificial Sequence: Synthetic oligonucleotide
ctcctgcttgaccacccatt

SEQ ID NO: 103 - DNA, 29 bp, Artificial Sequence
  Description of Artificial Sequence: Synthetic oligonucleotide
ctccttgggtcctgcaactccagggctgc

SEQ ID NO: 104 - DNA, 20 bp, Artificial Sequence
  Description of Artificial Sequence: Synthetic oligonucleotide
ctcggcctctgaagctcggg

SEQ ID NO: 105 - DNA, 20 bp, Artificial Sequence
  Description of Artificial Sequence: Synthetic oligonucleotide
ctctgaagctcgggcagagg

SEQ ID NO: 106 - DNA, 20 bp, Artificial Sequence
  Description of Artificial Sequence: Synthetic oligonucleotide
ctgaagccatcggtcaccca

SEQ ID NO: 107 - DNA, 20 bp, Artificial Sequence
  Description of Artificial Sequence: Synthetic oligonucleotide
ctgcatggcacctctgttcc

SEQ ID NO: 108 - DNA, 20 bp, Artificial Sequence
  Description of Artificial Sequence: Synthetic oligonucleotide
ctgcctctagggatgaactg

SEQ ID NO: 109 - DNA, 20 bp, Artificial Sequence
  Description of Artificial Sequence: Synthetic oligonucleotide
ctgctgggccacctgggact

SEQ ID NO: 110 - DNA, 19 bp, Artificial Sequence
  Description of Artificial Sequence: Synthetic oligonucleotide
ctgctgggccacctgggac

SEQ ID NO: 111 - DNA, 18 bp, Artificial Sequence
  Description of Artificial Sequence: Synthetic oligonucleotide
ctggagattgcaggaccc

SEQ ID NO: 112 - DNA, 22 bp, Artificial Sequence
  Description of Artificial Sequence: Synthetic oligonucleotide
ctggagcaccgttaaggacaag

SEQ ID NO: 113 - DNA, 20 bp, Artificial Sequence
  Description of Artificial Sequence: Synthetic oligonucleotide
ctggcctgctgggccacctg

SEQ ID NO: 114 - DNA, 24 bp, Artificial Sequence
  Description of Artificial Sequence: Synthetic oligonucleotide
ctggcctcccaataaagctggaca

SEQ ID NO: 115 - DNA, 18 bp, Artificial Sequence
  Description of Artificial Sequence: Synthetic oligonucleotide
ctgggactcctgcacgct

SEQ ID NO: 116 - DNA, 30 bp, Artificial Sequence
  Description of Artificial Sequence: Synthetic oligonucleotide
cttcagccgtggctgcctgagacctcaata

SEQ ID NO: 117 - DNA, 20 bp, Artificial Sequence
  Description of Artificial Sequence: Synthetic oligonucleotide
cttcttgtccagctttattg

SEQ ID NO: 118 - DNA, 18 bp, Artificial Sequence
  Description of Artificial Sequence: Synthetic oligonucleotide
cttcttgtccagctttat

SEQ ID NO: 119 - DNA, 19 bp, Artificial Sequence
  Description of Artificial Sequence: Synthetic oligonucleotide
cttcttgtccagctttatt

SEQ ID NO: 120 - DNA, 20 bp, Artificial Sequence
  Description of Artificial Sequence: Synthetic oligonucleotide
cttggcggtcttggtggcgt

SEQ ID NO: 121 - DNA, 25 bp, Artificial Sequence
  Description of Artificial Sequence: Synthetic oligonucleotide
cttgggtcctgcaatctccagggct

SEQ ID NO: 122 - DNA, 19 bp, Artificial Sequence
  Description of Artificial Sequence: Synthetic oligonucleotide
cttggtggcgtgcttcatg

SEQ ID NO: 123 - DNA, 18 bp, Artificial Sequence
  Description of Artificial Sequence: Synthetic oligonucleotide
cttggtggcgtgcttcat

SEQ ID NO: 124 - DNA, 17 bp, Artificial Sequence
  Description of Artificial Sequence: Synthetic oligonucleotide
cttgtccagctttattg

SEQ ID NO: 125 - DNA, 18 bp, Artificial Sequence
  Description of Artificial Sequence: Synthetic oligonucleotide
cttgtccagctttattgg

SEQ ID NO: 126 - DNA, 19 bp, Artificial Sequence
  Description of Artificial Sequence: Synthetic oligonucleotide
cttgtccagctttattggg

SEQ ID NO: 127 - DNA, 20 bp, Artificial Sequence
  Description of Artificial Sequence: Synthetic oligonucleotide
cttgtccagctttattggga

SEQ ID NO: 128 - DNA, 20 bp, Artificial Sequence
  Description of Artificial Sequence: Synthetic oligonucleotide
cttgtccttaacggtgctcc

SEQ ID NO: 129 - DNA, 19 bp, Artificial Sequence
  Description of Artificial Sequence: Synthetic oligonucleotide
gaagccatcggtcacccag

SEQ ID NO: 130 - DNA, 18 bp, Artificial Sequence
  Description of Artificial Sequence: Synthetic oligonucleotide
gaagccatcggtcaccca

SEQ ID NO: 131 - DNA, 20 bp, Artificial Sequence
  Description of Artificial Sequence: Synthetic oligonucleotide
gaagggaggcatcctcggcc

SEQ ID NO: 132 - DNA, 19 bp, Artificial Sequence
  Description of Artificial Sequence: Synthetic oligonucleotide
gaagttggtctgacctcag

SEQ ID NO: 133 - DNA, 18 bp, Artificial Sequence
  Description of Artificial Sequence: Synthetic oligonucleotide
gaagttggtctgacctca

SEQ ID NO: 134 - DNA, 19 bp, Artificial Sequence
  Description of Artificial Sequence: Synthetic oligonucleotide
gaccctgaggtcagaccaa

SEQ ID NO: 135 - DNA, 19 bp, Artificial Sequence
  Description of Artificial Sequence: Synthetic oligonucleotide
gagaactcctctgtaggca

SEQ ID NO: 136 - DNA, 19 bp, Artificial Sequence
  Description of Artificial Sequence: Synthetic oligonucleotide
gagaagggaggcatcctcg

SEQ ID NO: 137 - DNA, 20 bp, Artificial Sequence
  Description of Artificial Sequence: Synthetic oligonucleotide
gaggcatcctcggcctctga

SEQ ID NO: 138 - DNA, 19 bp, Artificial Sequence
  Description of Artificial Sequence: Synthetic oligonucleotide
gaggtctcaggcagccacg

SEQ ID NO: 139 - DNA, 18 bp, Artificial Sequence
  Description of Artificial Sequence: Synthetic oligonucleotide
gaggtcagaccaacttca

SEQ ID NO: 140 - DNA, 20 bp, Artificial Sequence
  Description of Artificial Sequence: Synthetic oligonucleotide
gaggtctcaggcagccacgg

SEQ ID NO: 141 - DNA, 18 bp, Artificial Sequence
  Description of Artificial Sequence: Synthetic oligonucleotide
gaggtctcaggcagccac

SEQ ID NO: 142 - DNA, 29 bp, Artificial Sequence
  Description of Artificial Sequence: Synthetic oligonucleotide
gcactgagcagcgtgcaggagtcccaggt

SEQ ID NO: 143 - DNA, 18 bp, Artificial Sequence
  Description of Artificial Sequence: Synthetic oligonucleotide
gcagcttcttgtccagct

SEQ ID NO: 144 - DNA, 19 bp, Artificial Sequence
  Description of Artificial Sequence: Synthetic oligonucleotide
gcagcttcttgtccagctt

SEQ ID NO: 145 - DNA, 26 bp, Artificial Sequence
  Description of Artificial Sequence: Synthetic oligonucleotide
gcaggagtcccaggtggcccagcagg

SEQ ID NO: 146 - DNA, 19 bp, Artificial Sequence
  Description of Artificial Sequence: Synthetic oligonucleotide
gcatccttggcggtcttgg

SEQ ID NO: 147 - DNA, 20 bp, Artificial Sequence
  Description of Artificial Sequence: Synthetic oligonucleotide
gcatccttggcggtcttggt

SEQ ID NO: 148 - DNA, 18 bp, Artificial Sequence
  Description of Artificial Sequence: Synthetic oligonucleotide
gcatccttggcggtcttg

SEQ ID NO: 149 - DNA, 20 bp, Artificial Sequence
  Description of Artificial Sequence: Synthetic oligonucleotide
gccacggctgaagttggtct

SEQ ID NO: 150 - DNA, 20 bp, Artificial Sequence
  Description of Artificial Sequence: Synthetic oligonucleotide
gccatcggtcacccagcccc

SEQ ID NO: 151 - DNA, 19 bp, Artificial Sequence
  Description of Artificial Sequence: Synthetic oligonucleotide
gccatcggtcacccagccc

SEQ ID NO: 152 - DNA, 20 bp, Artificial Sequence
  Description of Artificial Sequence: Synthetic oligonucleotide
gcccctggcctgctgggcca

SEQ ID NO: 153 - DNA, 20 bp, Artificial Sequence
  Description of Artificial Sequence: Synthetic oligonucleotide
gccctggagattgcaggacc

SEQ ID NO: 154 - DNA, 24 bp, Artificial Sequence
  Description of Artificial Sequence: Synthetic oligonucleotide
gccgtggctgcctgagacctcaat

SEQ ID NO: 155 - DNA, 20 bp, Artificial Sequence
  Description of Artificial Sequence: Synthetic oligonucleotide
gcctgacaaaggccctgtga

SEQ ID NO: 156 - DNA, 19 bp, Artificial Sequence
  Description of Artificial Sequence: Synthetic oligonucleotide
gcctcccaataaagctgga

SEQ ID NO: 157 - DNA, 19 bp, Artificial Sequence
  Description of Artificial Sequence: Synthetic oligonucleotide
gcctctagggatgaactga

SEQ ID NO: 158 - DNA, 20 bp, Artificial Sequence
  Description of Artificial Sequence: Synthetic oligonucleotide
gcctctgaagctcgggcaga

SEQ ID NO: 159 - DNA, 18 bp, Artificial Sequence
  Description of Artificial Sequence: Synthetic oligonucleotide
gcggtcttggtggcgtgc

SEQ ID NO: 160 - DNA, 20 bp, Artificial Sequence
  Description of Artificial Sequence: Synthetic oligonucleotide
gcgtgcttcatgtaaccctg

SEQ ID NO: 161 - DNA, 19 bp, Artificial Sequence
  Description of Artificial Sequence: Synthetic oligonucleotide
gctcagtgcatccttggcg

SEQ ID NO: 162 - DNA, 18 bp, Artificial Sequence
  Description of Artificial Sequence: Synthetic oligonucleotide
gctcagtgcatccttggc

SEQ ID NO: 163 - DNA, 20 bp, Artificial Sequence
  Description of Artificial Sequence: Synthetic oligonucleotide
gctcctgcttgaccacccat

SEQ ID NO: 164 - DNA, 20 bp, Artificial Sequence
  Description of Artificial Sequence: Synthetic oligonucleotide
gctgaagttggtctgacctc

SEQ ID NO: 165 - DNA, 30 bp, Artificial Sequence
  Description of Artificial Sequence: Synthetic oligonucleotide
gctggcctcccaataaagctggacaagaag

SEQ ID NO: 166 - DNA, 17 bp, Artificial Sequence
  Description of Artificial Sequence: Synthetic oligonucleotide
gctgggccacctgggac

SEQ ID NO: 167 - DNA, 17 bp, Artificial Sequence
  Description of Artificial Sequence: Synthetic oligonucleotide
gcttaaaagggacagta

SEQ ID NO: 168 - DNA, 19 bp, Artificial Sequence
  Description of Artificial Sequence: Synthetic oligonucleotide
gcttaaaagggacagtatt

SEQ ID NO: 169 - DNA, 19 bp, Artificial Sequence
  Description of Artificial Sequence: Synthetic oligonucleotide
gcttcagaggccgaggatg

SEQ ID NO: 170 - DNA, 18 bp, Artificial Sequence
  Description of Artificial Sequence: Synthetic oligonucleotide
gcttcttgtccagcttta

SEQ ID NO: 171 - DNA, 17 bp, Artificial Sequence
  Description of Artificial Sequence: Synthetic oligonucleotide
gcttcttgtccagcttt

SEQ ID NO: 172 - DNA, 19 bp, Artificial Sequence
  Description of Artificial Sequence: Synthetic oligonucleotide
gcttcttgtccagctttat

SEQ ID NO: 173 - DNA, 20 bp, Artificial Sequence
  Description of Artificial Sequence: Synthetic oligonucleotide
ggactcctgcacgctgctca

SEQ ID NO: 174 - DNA, 21 bp, Artificial Sequence
  Description of Artificial Sequence: Synthetic oligonucleotide
ggagcaccgttaaggacaagt

SEQ ID NO: 175 - DNA, 19 bp, Artificial Sequence
  Description of Artificial Sequence: Synthetic oligonucleotide
ggagcagctgcctctaggg

SEQ ID NO: 176 - DNA, 20 bp, Artificial Sequence
  Description of Artificial Sequence: Synthetic oligonucleotide
ggagcagctgcctctaggga

SEQ ID NO: 177 - DNA, 20 bp, Artificial Sequence
  Description of Artificial Sequence: Synthetic oligonucleotide
ggaggcatcctcggcctctg

SEQ ID NO: 178 - DNA, 24 bp, Artificial Sequence
  Description of Artificial Sequence: Synthetic oligonucleotide
ggagtcccaggtggcccagcaggc

SEQ ID NO: 179 - DNA, 20 bp, Artificial Sequence
  Description of Artificial Sequence: Synthetic oligonucleotide
ggcagaggccaggagcgcca

SEQ ID NO: 180 - DNA, 20 bp, Artificial Sequence
  Description of Artificial Sequence: Synthetic oligonucleotide
ggcatcctcggcctctgaag

SEQ ID NO: 181 - DNA, 30 bp, Artificial Sequence
  Description of Artificial Sequence: Synthetic oligonucleotide
ggccaggggctgggtgaccgatggcttcag

SEQ ID NO: 182 - DNA, 31 bp, Artificial Sequence
  Description of Artificial Sequence: Synthetic oligonucleotide
ggccaggggctgggtgaccgatggcttcagt

SEQ ID NO: 183 - DNA, 22 bp, Artificial Sequence
  Description of Artificial Sequence: Synthetic oligonucleotide
ggcctcccaataaagctggaca

SEQ ID NO: 184 - DNA, 24 bp, Artificial Sequence
  Description of Artificial Sequence: Synthetic oligonucleotide
ggcctcccaataaagctggacaag

SEQ ID NO: 185 - DNA, 26 bp, Artificial Sequence
  Description of Artificial Sequence: Synthetic oligonucleotide
ggcctcccaataaagctggacaagaa

SEQ ID NO: 186 - DNA, 19 bp, Artificial Sequence
  Description of Artificial Sequence: Synthetic oligonucleotide
ggcggtcttggtggcgtgc

SEQ ID NO: 187 - DNA, 20 bp, Artificial Sequence
  Description of Artificial Sequence: Synthetic oligonucleotide
ggcggtcttggtggcgtgct

SEQ ID NO: 188 - DNA, 24 bp, Artificial Sequence
  Description of Artificial Sequence: Synthetic oligonucleotide
ggctgggtgaccgatggcttcagt

SEQ ID NO: 189 - DNA, 19 bp, Artificial Sequence
  Description of Artificial Sequence: Synthetic oligonucleotide
gggacagtattctcagtga

SEQ ID NO: 190 - DNA, 19 bp, Artificial Sequence
  Description of Artificial Sequence: Synthetic oligonucleotide
gggactcctgcacgctgct

SEQ ID NO: 191 - DNA, 20 bp, Artificial Sequence
  Description of Artificial Sequence: Synthetic oligonucleotide
gggactcctgcacgctgctc

SEQ ID NO: 192 - DNA, 20 bp, Artificial Sequence
  Description of Artificial Sequence: Synthetic oligonucleotide
gggaggcatcctcggcctct

SEQ ID NO: 193 - DNA, 20 bp, Artificial Sequence
  Description of Artificial Sequence: Synthetic oligonucleotide
gggcctcccaaggcaaaccc

SEQ ID NO: 194 - DNA, 19 bp, Artificial Sequence
  Description of Artificial Sequence: Synthetic oligonucleotide
gggctcctgcttgaccacc

SEQ ID NO: 195 - DNA, 20 bp, Artificial Sequence
  Description of Artificial Sequence: Synthetic oligonucleotide
gggctgcatggcacctctgt

SEQ ID NO: 196 - DNA, 19 bp, Artificial Sequence
  Description of Artificial Sequence: Synthetic oligonucleotide
gggctgggtgaccgatggc

SEQ ID NO: 197 - DNA, 19 bp, Artificial Sequence
  Description of Artificial Sequence: Synthetic oligonucleotide
ggtctgacctcagggtcca

SEQ ID NO: 198 - DNA, 18 bp, Artificial Sequence
  Description of Artificial Sequence: Synthetic oligonucleotide
ggtctcaggcagccacgg

SEQ ID NO: 199 - DNA, 20 bp, Artificial Sequence
  Description of Artificial Sequence: Synthetic oligonucleotide
ggtcttggtggcgtgcttca

SEQ ID NO: 200 - DNA, 19 bp, Artificial Sequence
  Description of Artificial Sequence: Synthetic oligonucleotide
gtccagctttattgggagg

SEQ ID NO: 201 - DNA, 19 bp, Artificial Sequence
  Description of Artificial Sequence: Synthetic oligonucleotide
gtccagcttattgggaggc

SEQ ID NO: 202 - DNA, 14 bp, Artificial Sequence
  Description of Artificial Sequence: Synthetic oligonucleotide
gtccagctttattg

SEQ ID NO: 203 - DNA, 16 bp, Artificial Sequence
  Description of Artificial Sequence: Synthetic oligonucleotide
gtccagctttattggg

SEQ ID NO: 204 - DNA, 17 bp, Artificial Sequence
  Description of Artificial Sequence: Synthetic oligonucleotide
gtccagctttattggga

SEQ ID NO: 205 - DNA, 18 bp, Artificial Sequence
  Description of Artificial Sequence: Synthetic oligonucleotide
gtccagctttattgggag

SEQ ID NO: 206 - DNA, 20 bp, Artificial Sequence
  Description of Artificial Sequence: Synthetic oligonucleotide
gtccagctttattgggaggc

SEQ ID NO: 207 - DNA, 22 bp, Artificial Sequence
  Description of Artificial Sequence: Synthetic oligonucleotide
gtccagctttattgggaggcca

SEQ ID NO: 208 - DNA, 22 bp, Artificial Sequence
  Description of Artificial Sequence: Synthetic oligonucleotide
gtccagctttattgggaggcct

SEQ ID NO: 209 - DNA, 18 bp, Artificial Sequence
  Description of Artificial Sequence: Synthetic oligonucleotide
gtccagctttattgggat

SEQ ID NO: 210 - DNA, 19 bp, Artificial Sequence
  Description of Artificial Sequence: Synthetic oligonucleotide
gtcccaggtggcccagcag

SEQ ID NO: 211 - DNA, 20 bp, Artificial Sequence
  Description of Artificial Sequence: Synthetic oligonucleotide
gtctcaggcagccacggctg

SEQ ID NO: 212 - DNA, 20 bp, Artificial Sequence
  Description of Artificial Sequence: Synthetic oligonucleotide
gtcttggtggcgtgcttcat

SEQ ID NO: 213 - DNA, 19 bp, Artificial Sequence
  Description of Artificial Sequence: Synthetic oligonucleotide
gtgcaggagtcccaggtgg

SEQ ID NO: 214 - DNA, 20 bp, Artificial Sequence
  Description of Artificial Sequence: Synthetic oligonucleotide
gtgcatccttggcggtcttg

SEQ ID NO: 215 - DNA, 19 bp, Artificial Sequence
  Description of Artificial Sequence: Synthetic oligonucleotide
gtgcatccttggcggtctt

SEQ ID NO: 216 - DNA, 19 bp, Artificial Sequence
  Description of Artificial Sequence: Synthetic oligonucleotide
gttcctggagcagctgcct

SEQ ID NO: 217 - DNA, 25 bp, Artificial Sequence
  Description of Artificial Sequence: Synthetic oligonucleotide
gttgcttaaaagggacagtattctc

SEQ ID NO: 218 - DNA, 20 bp, Artificial Sequence
  Description of Artificial Sequence: Synthetic oligonucleotide
gtttatgcccctgggcctga

SEQ ID NO: 219 - DNA, 19 bp, Artificial Sequence
  Description of Artificial Sequence: Synthetic oligonucleotide
tcttgtccagctttattgg

SEQ ID NO: 220 - DNA, 17 bp, Artificial Sequence
  Description of Artificial Sequence: Synthetic oligonucleotide
tcttgtccagctttatt

SEQ ID NO: 221 - DNA, 18 bp, Artificial Sequence
  Description of Artificial Sequence: Synthetic oligonucleotide
tcttgtccagctttattg

SEQ ID NO: 222 - DNA, 19 bp, Artificial Sequence
  Description of Artificial Sequence: Synthetic oligonucleotide
tggcggtcttggtggcgtg

SEQ ID NO: 223 - DNA, 23 bp, Artificial Sequence
  Description of Artificial Sequence: Synthetic oligonucleotide
tgggtcctgcaatctccagggct

SEQ ID NO: 224 - DNA, 19 bp, Artificial Sequence
  Description of Artificial Sequence: Synthetic oligonucleotide
tggtctgacctcagggtcc

SEQ ID NO: 225 - DNA, 18 bp, Artificial Sequence
  Description of Artificial Sequence: Synthetic oligonucleotide
tggtctgacctcagggtc

SEQ ID NO: 226 - DNA, 19 bp, Artificial Sequence
  Description of Artificial Sequence: Synthetic oligonucleotide
tggtggcgtgcttcatgta

SEQ ID NO: 227 - DNA, 17 bp, Artificial Sequence
  Description of Artificial Sequence: Synthetic oligonucleotide
tgtccagctttattggg

SEQ ID NO: 228 - DNA, 18 bp, Artificial Sequence
  Description of Artificial Sequence: Synthetic oligonucleotide
tgtccagctttattggga

SEQ ID NO: 229 - DNA, 19 bp, Artificial Sequence
  Description of Artificial Sequence: Synthetic oligonucleotide
tgtccagctttattgggag

SEQ ID NO: 230 - DNA, 17 bp, Artificial Sequence
  Description of Artificial Sequence: Synthetic oligonucleotide
tgtccttaacggtgctc

SEQ ID NO: 231 - DNA, 18 bp, Artificial Sequence
  Description of Artificial Sequence: Synthetic oligonucleotide
aaaggcatgaagcaggaa

SEQ ID NO: 232 - DNA, 20 bp, Artificial Sequence
  Description of Artificial Sequence: Synthetic oligonucleotide
aaaggcatgaagcaggaaca

SEQ ID NO: 233 - DNA, 27 bp, Artificial Sequence
  Description of Artificial Sequence: Synthetic oligonucleotide
aacgtctccatggcgggggtaacaaga

SEQ ID NO: 234 - DNA, 18 bp, Artificial Sequence
  Description of Artificial Sequence: Synthetic oligonucleotide
aaggcatgaagcaggaac

SEQ ID NO: 235 - DNA, 20 bp, Artificial Sequence
  Description of Artificial Sequence: Synthetic oligonucleotide
aaggcatgaagcaggaacat

SEQ ID NO: 236 - DNA, 24 bp, Artificial Sequence
  Description of Artificial Sequence: Synthetic oligonucleotide
aaggccactgtagaaaggcatgaa

SEQ ID NO: 237 - DNA, 25 bp, Artificial Sequence
  Description of Artificial Sequence: Synthetic oligonucleotide
aaggccactgtagaaaggcatgaag

SEQ ID NO: 238 - DNA, 17 bp, Artificial Sequence
  Description of Artificial Sequence: Synthetic oligonucleotide
aaggccactgtagaaag

SEQ ID NO: 239 - DNA, 18 bp, Artificial Sequence
  Description of Artificial Sequence: Synthetic oligonucleotide
aaggccactgtagaaagg

SEQ ID NO: 240 - DNA, 19 bp, Artificial Sequence
  Description of Artificial Sequence: Synthetic oligonucleotide
aaggccactgtagaaaggc

SEQ ID NO: 241 - DNA, 20 bp, Artificial Sequence
  Description of Artificial Sequence: Synthetic oligonucleotide
aaggccactgtagaaaggca

SEQ ID NO: 242 - DNA, 20 bp, Artificial Sequence
  Description of Artificial Sequence: Synthetic oligonucleotide
aagggaccctctgcactggg

SEQ ID NO: 243 - DNA, 20 bp, Artificial Sequence
  Description of Artificial Sequence: Synthetic oligonucleotide
aagggcatgaagcaggaaca

SEQ ID NO: 244 - DNA, 19 bp, Artificial Sequence
  Description of Artificial Sequence: Synthetic oligonucleotide
acccccgccatggagacgt

SEQ ID NO: 245 - DNA, 18 bp, Artificial Sequence
  Description of Artificial Sequence: Synthetic oligonucleotide
acccccgccatggagacg

SEQ ID NO: 246 - DNA, 20 bp, Artificial Sequence
  Description of Artificial Sequence: Synthetic oligonucleotide
acccccgccatggagacgtt

SEQ ID NO: 247 - DNA, 27 bp, Artificial Sequence
  Description of Artificial Sequence: Synthetic oligonucleotide
accccgcggtccatcctcaggtccagc

SEQ ID NO: 248 - DNA, 19 bp, Artificial Sequence
  Description of Artificial Sequence: Synthetic oligonucleotide
accctgcctcagtgtctcg

SEQ ID NO: 249 - DNA, 18 bp, Artificial Sequence
  Description of Artificial Sequence: Synthetic oligonucleotide
acctgaggatggaccgcg

SEQ ID NO: 250 - DNA, 20 bp, Artificial Sequence
  Description of Artificial Sequence: Synthetic oligonucleotide
acctgaggatggaccgcggg

SEQ ID NO: 251 - DNA, 20 bp, Artificial Sequence
  Description of Artificial Sequence: Synthetic oligonucleotide
acgttgtcactcactcctcc

SEQ ID NO: 252 - DNA, 25 bp, Artificial Sequence
  Description of Artificial Sequence: Synthetic oligonucleotide
actgtagaaaggcatgaagcaggaa

SEQ ID NO: 253 - DNA, 18 bp, Artificial Sequence
  Description of Artificial Sequence: Synthetic oligonucleotide
actgtagaaaggcatgaa

SEQ ID NO: 254 - DNA, 20 bp, Artificial Sequence
  Description of Artificial Sequence: Synthetic oligonucleotide
actgtagaaaggcatgaagc

SEQ ID NO: 255 - DNA, 19 bp, Artificial Sequence
  Description of Artificial Sequence: Synthetic oligonucleotide
agaaaggcatgaagcagga

SEQ ID NO: 256 - DNA, 20 bp, Artificial Sequence
  Description of Artificial Sequence: Synthetic oligonucleotide
agaaaggcatgaagcaggaa

SEQ ID NO: 257 - DNA, 24 bp, Artificial Sequence
  Description of Artificial Sequence: Synthetic oligonucleotide
agaaaggcatgaagcaggaacata

SEQ ID NO: 258 - DNA, 17 bp, Artificial Sequence
  Description of Artificial Sequence: Synthetic oligonucleotide
agaaaggcatgaagcag

SEQ ID NO: 259 - DNA, 18 bp, Artificial Sequence
  Description of Artificial Sequence: Synthetic oligonucleotide
agaaaggcatgaagcagg

SEQ ID NO: 260 - DNA, 21 bp, Artificial Sequence
  Description of Artificial Sequence: Synthetic oligonucleotide
aaatgcctttctacagtggca

SEQ ID NO: 261 - DNA, 23 bp, Artificial Sequence
  Description of Artificial Sequence: Synthetic oligonucleotide
aatcatgcctttctacagtggca

SEQ ID NO: 262 - DNA, 20 bp, Artificial Sequence
  Description of Artificial Sequence: Synthetic oligonucleotide
acatgggccagcctaccccc

SEQ ID NO: 263 - DNA, 20 bp, Artificial Sequence
  Description of Artificial Sequence: Synthetic oligonucleotide
acctgtgaggtcacccactg

SEQ ID NO: 264 - DNA, 20 bp, Artificial Sequence
  Description of Artificial Sequence: Synthetic oligonucleotide
atcttgttacccccgccatg

SEQ ID NO: 265 - DNA, 19 bp, Artificial Sequence
  Description of Artificial Sequence: Synthetic oligonucleotide
atgcctttctacagtggca

SEQ ID NO: 266 - DNA, 22 bp, Artificial Sequence
  Description of Artificial Sequence: Synthetic oligonucleotide
gccactgtagaaaggcatgatt

SEQ ID NO: 267 - DNA, 20 bp, Artificial Sequence
  Description of Artificial Sequence: Synthetic oligonucleotide
gccactgtagaaaggcattt

SEQ ID NO: 268 - DNA, 23 bp, Artificial Sequence
  Description of Artificial Sequence: Synthetic oligonucleotide
tgccactgtagaaaggcatgatt

SEQ ID NO: 269 - DNA, 21 bp, Artificial Sequence
  Description of Artificial Sequence: Synthetic oligonucleotide
tcatgcctttctacagtggca

SEQ ID NO: 270 - DNA, 21 bp, Artificial Sequence
  Description of Artificial Sequence: Synthetic oligonucleotide
tgccactgtagaaaggcattt

SEQ ID NO: 271 - DNA, 20 bp, Artificial Sequence
  Description of Artificial Sequence: Synthetic oligonucleotide
agaggctgggatcctccacg

SEQ ID NO: 272 - DNA, 21 bp, Artificial Sequence
  Description of Artificial Sequence: Synthetic oligonucleotide
agccactgtagaaaggcatga

SEQ ID NO: 273 - DNA, 20 bp, Artificial Sequence
  Description of Artificial Sequence: Synthetic oligonucleotide
agcgagcctgggcgagaggg

SEQ ID NO: 274 - DNA, 20 bp, Artificial Sequence
  Description of Artificial Sequence: Synthetic oligonucleotide
agcgctctctaccctgcctc

SEQ ID NO: 275 - DNA, 20 bp, Artificial Sequence
  Description of Artificial Sequence: Synthetic oligonucleotide
agctggtggacattggccgg

SEQ ID NO: 276 - DNA, 18 bp, Artificial Sequence
  Description of Artificial Sequence: Synthetic oligonucleotide
aggcatgaagcaggaaca

SEQ ID NO: 277 - DNA, 20 bp, Artificial Sequence
  Description of Artificial Sequence: Synthetic oligonucleotide
aggcatgaagcaggaacata

SEQ ID NO: 278 - DNA, 25 bp, Artificial Sequence
  Description of Artificial Sequence: Synthetic oligonucleotide
aggccactgtagaaaggcatgaagc

SEQ ID NO: 279 - DNA, 18 bp, Artificial Sequence
  Description of Artificial Sequence: Synthetic oligonucleotide
aggccactgtagaaaggc

SEQ ID NO: 280 - DNA, 20 bp, Artificial Sequence
  Description of Artificial Sequence: Synthetic oligonucleotide
aggccactgtagaaaggcat

SEQ ID NO: 281 - DNA, 20 bp, Artificial Sequence
  Description of Artificial Sequence: Synthetic oligonucleotide
aggctgggatcctccacgtc

SEQ ID NO: 282 - DNA, 20 bp, Artificial Sequence
  Description of Artificial Sequence: Synthetic oligonucleotide
agggaccctctgcactgggc

SEQ ID NO: 283 - DNA, 20 bp, Artificial Sequence
  Description of Artificial Sequence: Synthetic oligonucleotide
ataaggccactgtagaaagg

SEQ ID NO: 284 - DNA, 18 bp, Artificial Sequence
  Description of Artificial Sequence: Synthetic oligonucleotide
ataaggccactgtagaaa

SEQ ID NO: 285 - DNA, 20 bp, Artificial Sequence
  Description of Artificial Sequence: Synthetic oligonucleotide
atcttgttacccccgccatg

SEQ ID NO: 286 - DNA, 27 bp, Artificial Sequence
  Description of Artificial Sequence: Synthetic oligonucleotide
atgacaccaggaagcccagtgcagagg

SEQ ID NO: 287 - DNA, 18 bp, Artificial Sequence
  Description of Artificial Sequence: Synthetic oligonucleotide
atgttccgactcctggcc

SEQ ID NO: 288 - DNA, 20 bp, Artificial Sequence
  Description of Artificial Sequence: Synthetic oligonucleotide
atttgggacctggaggcggg

SEQ ID NO: 289 - DNA, 20 bp, Artificial Sequence
  Description of Artificial Sequence: Synthetic oligonucleotide
cacatgggccagcctacccc

SEQ ID NO: 290 - DNA, 20 bp, Artificial Sequence
  Description of Artificial Sequence: Synthetic oligonucleotide
caccccttcccacagcatgg

SEQ ID NO: 291 - DNA, 25 bp, Artificial Sequence
  Description of Artificial Sequence: Synthetic oligonucleotide
cactgtagaaaggcatgaagcagga

SEQ ID NO: 292 - DNA, 18 bp, Artificial Sequence
  Description of Artificial Sequence: Synthetic oligonucleotide
cactgtagaaaggcatga

SEQ ID NO: 293 - DNA, 20 bp, Artificial Sequence
  Description of Artificial Sequence: Synthetic oligonucleotide
cactgtagaaaggcatgaag

SEQ ID NO: 294 - DNA, 18 bp, Artificial Sequence
  Description of Artificial Sequence: Synthetic oligonucleotide
catgaagcaggaacatac

SEQ ID NO: 295 - DNA, 20 bp, Artificial Sequence
  Description of Artificial Sequence: Synthetic oligonucleotide
catgaagcaggaacatacca

SEQ ID NO: 296 - DNA, 25 bp, Artificial Sequence
  Description of Artificial Sequence: Synthetic oligonucleotide
ccactgtagaaaggcatgaagcagg

SEQ ID NO: 297 - DNA, 18 bp, Artificial Sequence
  Description of Artificial Sequence: Synthetic oligonucleotide
ccactgtagaaaggcatg

SEQ ID NO: 298 - DNA, 20 bp, Artificial Sequence
  Description of Artificial Sequence: Synthetic oligonucleotide
ccactgtagaaaggcatgaa

SEQ ID NO: 299 - DNA, 20 bp, Artificial Sequence
  Description of Artificial Sequence: Synthetic oligonucleotide
ccagcaccttgagatccggg

SEQ ID NO: 300 - DNA, 20 bp, Artificial Sequence
  Description of Artificial Sequence: Synthetic oligonucleotide
cccagcaccttgagatccgg

SEQ ID NO: 301 - DNA, 27 bp, Artificial Sequence
  Description of Artificial Sequence: Synthetic oligonucleotide
cccccaggcaggagccaagcacagcag

SEQ ID NO: 302 - DNA, 18 bp, Artificial Sequence
  Description of Artificial Sequence: Synthetic oligonucleotide
cccccgccatggagacgt

SEQ ID NO: 303 - DNA, 20 bp, Artificial Sequence
  Description of Artificial Sequence: Synthetic oligonucleotide
cccccgccatggagacgttt

SEQ ID NO: 304 - DNA, 18 bp, Artificial Sequence
  Description of Artificial Sequence: Synthetic oligonucleotide
ccccgccatggagacgtt

SEQ ID NO: 305 - DNA, 20 bp, Artificial Sequence
  Description of Artificial Sequence: Synthetic oligonucleotide
ccctgcctcagtgtctcggc

SEQ ID NO: 306 - DNA, 20 bp, Artificial Sequence
  Description of Artificial Sequence: Synthetic oligonucleotide
ccgactcctggccttccgca

SEQ ID NO: 307 - DNA, 19 bp, Artificial Sequence
  Description of Artificial Sequence: Synthetic oligonucleotide
ccgactcctggccttccgc

SEQ ID NO: 308 - DNA, 20 bp, Artificial Sequence
  Description of Artificial Sequence: Synthetic oligonucleotide
cctcagtgtctcggccaggg

SEQ ID NO: 309 - DNA, 20 bp, Artificial Sequence
  Description of Artificial Sequence: Synthetic oligonucleotide
cctgaggatggaccgcgggg

SEQ ID NO: 310 - DNA, 20 bp, Artificial Sequence
  Description of Artificial Sequence: Synthetic oligonucleotide
cctgcctcagtgtctcggcc

SEQ ID NO: 311 - DNA, 19 bp, Artificial Sequence
  Description of Artificial Sequence: Synthetic oligonucleotide
cctgctgtgcttggctcct

SEQ ID NO: 312 - DNA, 20 bp, Artificial Sequence
  Description of Artificial Sequence: Synthetic oligonucleotide
cctgctgtgcttggctcctg

SEQ ID NO: 313 - DNA, 20 bp, Artificial Sequence
  Description of Artificial Sequence: Synthetic oligonucleotide
cctgggcgagagggtgtcca

SEQ ID NO: 314 - DNA, 20 bp, Artificial Sequence
  Description of Artificial Sequence: Synthetic oligonucleotide
cctgtgaggtcacccactgc

SEQ ID NO: 315 - DNA, 20 bp, Artificial Sequence
  Description of Artificial Sequence: Synthetic oligonucleotide
cctgttggctgctcactggc

SEQ ID NO: 316 - DNA, 20 bp, Artificial Sequence
  Description of Artificial Sequence: Synthetic oligonucleotide
cgaactgcaccccttcccac

SEQ ID NO: 317 - DNA, 20 bp, Artificial Sequence
  Description of Artificial Sequence: Synthetic oligonucleotide
cgacctcaggatccatccct

SEQ ID NO: 318 - DNA, 20 bp, Artificial Sequence
  Description of Artificial Sequence: Synthetic oligonucleotide
cgactcctggccttccgcac

SEQ ID NO: 319 - DNA, 21 bp, Artificial Sequence
  Description of Artificial Sequence: Synthetic oligonucleotide
cgccactgtagaaaggcatga

SEQ ID NO: 320 - DNA, 20 bp, Artificial Sequence
  Description of Artificial Sequence: Synthetic oligonucleotide
cggccagggcattcccagcg

SEQ ID NO: 321 - DNA, 20 bp, Artificial Sequence
  Description of Artificial Sequence: Synthetic oligonucleotide
ctcagaggctgggatcctcc

SEQ ID NO: 322 - DNA, 20 bp, Artificial Sequence
  Description of Artificial Sequence: Synthetic oligonucleotide
ctcaggcagcgggtcgcccc

SEQ ID NO: 323 - DNA, 20 bp, Artificial Sequence
  Description of Artificial Sequence: Synthetic oligonucleotide
ctcctgctgtgcttggctcc

SEQ ID NO: 324 - DNA, 19 bp, Artificial Sequence
  Description of Artificial Sequence: Synthetic oligonucleotide
ctcggccagggcattccca

SEQ ID NO: 325 - DNA, 20 bp, Artificial Sequence
  Description of Artificial Sequence: Synthetic oligonucleotide
ctctgctggacagcccttgg

SEQ ID NO: 326 - DNA, 18 bp, Artificial Sequence
  Description of Artificial Sequence: Synthetic oligonucleotide
ctgaggatggaccgcggg

SEQ ID NO: 327 - DNA, 19 bp, Artificial Sequence
  Description of Artificial Sequence: Synthetic oligonucleotide
ctgcactgggcttcctggt

SEQ ID NO: 328 - DNA, 20 bp, Artificial Sequence
  Description of Artificial Sequence: Synthetic oligonucleotide
ctgcactgggcttcctggtg

SEQ ID NO: 329 - DNA, 20 bp, Artificial Sequence
  Description of Artificial Sequence: Synthetic oligonucleotide
ctgcctcagtgtctcggcca

SEQ ID NO: 330 - DNA, 19 bp, Artificial Sequence
  Description of Artificial Sequence: Synthetic oligonucleotide
ctgctagactcgcctcctc

SEQ ID NO: 331 - DNA, 19 bp, Artificial Sequence
  Description of Artificial Sequence: Synthetic oligonucleotide
ctgctccagcgggataccg

SEQ ID NO: 332 - DNA, 20 bp, Artificial Sequence
  Description of Artificial Sequence: Synthetic oligonucleotide
ctgctccagcgggataccgg

SEQ ID NO: 333 - DNA, 19 bp, Artificial Sequence
  Description of Artificial Sequence: Synthetic oligonucleotide
ctgctggacagcccttggg

SEQ ID NO: 334 - DNA, 20 bp, Artificial Sequence
  Description of Artificial Sequence: Synthetic oligonucleotide
ctgctggacagcccttgggg

SEQ ID NO: 335 - DNA, 20 bp, Artificial Sequence
  Description of Artificial Sequence: Synthetic oligonucleotide
ctgctgtgcttggctcctgc

SEQ ID NO: 336 - DNA, 20 bp, Artificial Sequence
  Description of Artificial Sequence: Synthetic oligonucleotide
ctggacctgaggatggaccg

SEQ ID NO: 337 - DNA, 20 bp, Artificial Sequence
  Description of Artificial Sequence: Synthetic oligonucleotide
ctgggcatggcgacctcagg

SEQ ID NO: 338 - DNA, 20 bp, Artificial Sequence
  Description of Artificial Sequence: Synthetic oligonucleotide
ctggtggacattggccggga

SEQ ID NO: 339 - DNA, 20 bp, Artificial Sequence
  Description of Artificial Sequence: Synthetic oligonucleotide
ctgtagaaaggcatgaagca

SEQ ID NO: 340 - DNA, 25 bp, Artificial Sequence
  Description of Artificial Sequence: Synthetic oligonucleotide
ctgtagaaaggcatgaagcaggaac

SEQ ID NO: 341 - DNA, 18 bp, Artificial Sequence
  Description of Artificial Sequence: Synthetic oligonucleotide
ctgtagaaaggcatgaag

SEQ ID NO: 342 - DNA, 20 bp, Artificial Sequence
  Description of Artificial Sequence: Synthetic oligonucleotide
ctgtagaaaggcatgaagca

SEQ ID NO: 343 - DNA, 20 bp, Artificial Sequence
  Description of Artificial Sequence: Synthetic oligonucleotide
ctgttggctgctcactggca

SEQ ID NO: 344 - DNA, 19 bp, Artificial Sequence
  Description of Artificial Sequence: Synthetic oligonucleotide
cttgttacccccgccatgg

SEQ ID NO: 345 - DNA, 20 bp, Artificial Sequence
  Description of Artificial Sequence: Synthetic oligonucleotide
cttgttacccccgccatgga

SEQ ID NO: 346 - DNA, 18 bp, Artificial Sequence
  Description of Artificial Sequence: Synthetic oligonucleotide
gaaaggcatgaagcagga

SEQ ID NO: 347 - DNA, 20 bp, Artificial Sequence
  Description of Artificial Sequence: Synthetic oligonucleotide
gaaaggcatgaagcaggaac

SEQ ID NO: 348 - DNA, 27 bp, Artificial Sequence
  Description of Artificial Sequence: Synthetic oligonucleotide
gaagcccagtgcagagggtcccttact

SEQ ID NO: 349 - DNA, 20 bp, Artificial Sequence
  Description of Artificial Sequence: Synthetic oligonucleotide
gaagggcatgaagcaggaac

SEQ ID NO: 350 - DNA, 20 bp, Artificial Sequence
  Description of Artificial Sequence: Synthetic oligonucleotide
gaccctctgcactgggcttc

SEQ ID NO: 351 - DNA, 18 bp, Artificial Sequence
  Description of Artificial Sequence: Synthetic oligonucleotide
gaccctctgcactgggct

SEQ ID NO: 352 - DNA, 18 bp, Artificial Sequence
  Description of Artificial Sequence: Synthetic oligonucleotide
gacctgaggatggaccgc

SEQ ID NO: 353 - DNA, 20 bp, Artificial Sequence
  Description of Artificial Sequence: Synthetic oligonucleotide
gacctgaggatggaccgcgg

SEQ ID NO: 354 - DNA, 20 bp, Artificial Sequence
  Description of Artificial Sequence: Synthetic oligonucleotide
gacgaactgcaccccttccc

SEQ ID NO: 355 - DNA, 20 bp, Artificial Sequence
  Description of Artificial Sequence: Synthetic oligonucleotide
gactcctggccttccgcaca

SEQ ID NO: 356 - DNA, 20 bp, Artificial Sequence
  Description of Artificial Sequence: Synthetic oligonucleotide
gataaggccactgtagaaag

SEQ ID NO: 357 - DNA, 19 bp, Artificial Sequence
  Description of Artificial Sequence: Synthetic oligonucleotide
gcactgggcttcctggtgt

SEQ ID NO: 358 - DNA, 19 bp, Artificial Sequence
  Description of Artificial Sequence: Synthetic oligonucleotide
gcagagaccctgtcggagg

SEQ ID NO: 359 - DNA, 20 bp, Artificial Sequence
  Description of Artificial Sequence: Synthetic oligonucleotide
gcatgaagcaggaacatacc

SEQ ID NO: 360 - DNA, 18 bp, Artificial Sequence
  Description of Artificial Sequence: Synthetic oligonucleotide
gcatgaagcaggaacata

SEQ ID NO: 361 - DNA, 20 bp, Artificial Sequence
  Description of Artificial Sequence: Synthetic oligonucleotide
gccactgtagaaaggcatga

SEQ ID NO: 362 - DNA, 25 bp, Artificial Sequence
  Description of Artificial Sequence: Synthetic oligonucleotide
gccactgtagaaaggcatgaagcag

SEQ ID NO: 363 - DNA, 20 bp, Artificial Sequence
  Description of Artificial Sequence: Synthetic oligonucleotide
gccactgtagaaaggcatga

SEQ ID NO: 364 - DNA, 18 bp, Artificial Sequence
  Description of Artificial Sequence: Synthetic oligonucleotide
gccactgtagaaacgcat

SEQ ID NO: 365 - DNA, 18 bp, Artificial Sequence
  Description of Artificial Sequence: Synthetic oligonucleotide
gccactgtagaaagccat

SEQ ID NO: 366 - DNA, 20 bp, Artificial Sequence
  Description of Artificial Sequence: Synthetic oligonucleotide
gccactgtagaaagccatga

SEQ ID NO: 367 - DNA, 20 bp, Artificial Sequence
  Description of Artificial Sequence: Synthetic oligonucleotide
gccactgtagaaaggaatga

SEQ ID NO: 368 - DNA, 16 bp, Artificial Sequence
  Description of Artificial Sequence: Synthetic oligonucleotide
gccactgtagaaaggc

SEQ ID NO: 369 - DNA, 17 bp, Artificial Sequence
  Description of Artificial Sequence: Synthetic oligonucleotide
gccactgtagaaaggca

SEQ ID NO: 370 - DNA, 18 bp, Artificial Sequence
  Description of Artificial Sequence: Synthetic oligonucleotide
gccactgtagaaaggcaa

SEQ ID NO: 371 - DNA, 19 bp, Artificial Sequence
  Description of Artificial Sequence: Synthetic oligonucleotide
gccactgtagaaaggcagg

SEQ ID NO: 372 - DNA, 18 bp, Artificial Sequence
  Description of Artificial Sequence: Synthetic oligonucleotide
gccactgtagaaaggcat

SEQ ID NO: 373 - DNA, 20 bp, Artificial Sequence
  Description of Artificial Sequence: Synthetic oligonucleotide
gccactgtagaaaggcatga

SEQ ID NO: 374 - DNA, 20 bp, Artificial Sequence
  Description of Artificial Sequence: Synthetic oligonucleotide
gccactgtagaaaggcatca

SEQ ID NO: 375 - DNA, 19 bp, Artificial Sequence
  Description of Artificial Sequence: Synthetic oligonucleotide
gccactgtagaaaggcatg

SEQ ID NO: 376 - DNA, 20 bp, Artificial Sequence
  Description of Artificial Sequence: Synthetic oligonucleotide
gccactgtagaaaggcatga

SEQ ID NO: 377 - DNA, 21 bp, Artificial Sequence
  Description of Artificial Sequence: Synthetic oligonucleotide
gccactgtagaaaggcatgaa

SEQ ID NO: 378 - DNA, 22 bp, Artificial Sequence
  Description of Artificial Sequence: Synthetic oligonucleotide
gccactgtagaaaggcatgaag

SEQ ID NO: 379 - DNA, 20 bp, Artificial Sequence
  Description of Artificial Sequence: Synthetic oligonucleotide
gccactgtagaaaggcatgt

SEQ ID NO: 380 - DNA, 18 bp, Artificial Sequence
  Description of Artificial Sequence: Synthetic oligonucleotide
gccactgtagaaaggcgg

SEQ ID NO: 381 - DNA, 20 bp, Artificial Sequence
  Description of Artificial Sequence: Synthetic oligonucleotide
gccactgtagaaaggcgtga

SEQ ID NO: 382 - DNA, 18 bp, Artificial Sequence
  Description of Artificial Sequence: Synthetic oligonucleotide
gccactgtagaaaggctt

SEQ ID NO: 383 - DNA, 20 bp, Artificial Sequence
  Description of Artificial Sequence: Synthetic oligonucleotide
gccactgtagaaaggcttga

SEQ ID NO: 384 - DNA, 18 bp, Artificial Sequence
  Description of Artificial Sequence: Synthetic oligonucleotide
gccactgtagaaagggat

SEQ ID NO: 385 - DNA, 20 bp, Artificial Sequence
  Description of Artificial Sequence: Synthetic oligonucleotide
gccactgtagaaaggtatga

SEQ ID NO: 386 - DNA, 18 bp, Artificial Sequence
  Description of Artificial Sequence: Synthetic oligonucleotide
gccactgtagaatggcat

SEQ ID NO: 387 - DNA, 20 bp, Artificial Sequence
  Description of Artificial Sequence: Synthetic oligonucleotide
gccactgtagagaggcatga

SEQ ID NO: 388 - DNA, 20 bp, Artificial Sequence
  Description of Artificial Sequence: Synthetic oligonucleotide
gcctcagtgtctcggccagg

SEQ ID NO: 389 - DNA, 20 bp, Artificial Sequence
  Description of Artificial Sequence: Synthetic oligonucleotide
gcctgggcgagagggtgtcc

SEQ ID NO: 390 - DNA, 20 bp, Artificial Sequence
  Description of Artificial Sequence: Synthetic oligonucleotide
gcctgttggctgctcactgg

SEQ ID NO: 391 - DNA, 20 bp, Artificial Sequence
  Description of Artificial Sequence: Synthetic oligonucleotide
gcgctctctaccctgcctca

SEQ ID NO: 392 - DNA, 19 bp, Artificial Sequence
  Description of Artificial Sequence: Synthetic oligonucleotide
gctccagcgggataccgga

SEQ ID NO: 393 - DNA, 18 bp, Artificial Sequence
  Description of Artificial Sequence: Synthetic oligonucleotide
gctcggcctccagttcca

SEQ ID NO: 394 - DNA, 20 bp, Artificial Sequence
  Description of Artificial Sequence: Synthetic oligonucleotide
gctggtggacattggccggg

SEQ ID NO: 395 - DNA, 19 bp, Artificial Sequence
  Description of Artificial Sequence: Synthetic oligonucleotide
gctgtagcgagcctgggcg

SEQ ID NO: 396 - DNA, 19 bp, Artificial Sequence
  Description of Artificial Sequence: Synthetic oligonucleotide
gctgtgcttggctcctgcc

SEQ ID NO: 397 - DNA, 18 bp, Artificial Sequence
  Description of Artificial Sequence: Synthetic oligonucleotide
ggaccctctgcactgggc

SEQ ID NO: 398 - DNA, 20 bp, Artificial Sequence
  Description of Artificial Sequence: Synthetic oligonucleotide
ggaccctctgcactgggctt

SEQ ID NO: 399 - DNA, 19 bp, Artificial Sequence
  Description of Artificial Sequence: Synthetic oligonucleotide
ggacctgaggatggaccgc

SEQ ID NO: 400 - DNA, 20 bp, Artificial Sequence
  Description of Artificial Sequence: Synthetic oligonucleotide
ggacctgaggatggaccgcg

SEQ ID NO: 401 - DNA, 20 bp, Artificial Sequence
  Description of Artificial Sequence: Synthetic oligonucleotide
ggataaggccactgtagaaa

SEQ ID NO: 402 - DNA, 18 bp, Artificial Sequence
  Description of Artificial Sequence: Synthetic oligonucleotide
ggcatgaagcaggaacat

SEQ ID NO: 403 - DNA, 20 bp, Artificial Sequence
  Description of Artificial Sequence: Synthetic oligonucleotide
ggcatgaagcaggaacatac

SEQ ID NO: 404 - DNA, 25 bp, Artificial Sequence
  Description of Artificial Sequence: Synthetic oligonucleotide
ggccactgtagaaaggcatgaagca

SEQ ID NO: 405 - DNA, 20 bp, Artificial Sequence
  Description of Artificial Sequence: Synthetic oligonucleotide
ggccactgtagaaaggcatg

SEQ ID NO: 406 - DNA, 18 bp, Artificial Sequence
  Description of Artificial Sequence: Synthetic oligonucleotide
ggccactgtagaaaggca

SEQ ID NO: 407 - DNA, 21 bp, Artificial Sequence
  Description of Artificial Sequence: Synthetic oligonucleotide
ggccactgtagaaaggcatga

SEQ ID NO: 408 - DNA, 20 bp, Artificial Sequence
  Description of Artificial Sequence: Synthetic oligonucleotide
ggctgggatcctccacgtca

SEQ ID NO: 409 - DNA, 20 bp, Artificial Sequence
  Description of Artificial Sequence: Synthetic oligonucleotide
gggaccctctgcactgggct

SEQ ID NO: 410 - DNA, 20 bp, Artificial Sequence
  Description of Artificial Sequence: Synthetic oligonucleotide
gggaggcctgttggctgctc

SEQ ID NO: 411 - DNA, 19 bp, Artificial Sequence
  Description of Artificial Sequence: Synthetic oligonucleotide
gggatcctccacgtcacag

SEQ ID NO: 412 - DNA, 19 bp, Artificial Sequence
  Description of Artificial Sequence: Synthetic oligonucleotide
gggcgagagggtgtccagg

SEQ ID NO: 413 - DNA, 20 bp, Artificial Sequence
  Description of Artificial Sequence: Synthetic oligonucleotide
gggtggcctctgctttggtc

SEQ ID NO: 414 - DNA, 20 bp, Artificial Sequence
  Description of Artificial Sequence: Synthetic oligonucleotide
ggtctctgctggacagccct

SEQ ID NO: 415 - DNA, 19 bp, Artificial Sequence
  Description of Artificial Sequence: Synthetic oligonucleotide
ggtggacattggccgggag

SEQ ID NO: 416 - DNA, 20 bp, Artificial Sequence
  Description of Artificial Sequence: Synthetic oligonucleotide
ggtggcctctgctttggtct

SEQ ID NO: 417 - DNA, 19 bp, Artificial Sequence
  Description of Artificial Sequence: Synthetic oligonucleotide
gtagaaaggcatgaagcag

SEQ ID NO: 418 - DNA, 24 bp, Artificial Sequence
  Description of Artificial Sequence: Synthetic oligonucleotide
gtagaaaggcatgaagcaggaaca

SEQ ID NO: 419 - DNA, 25 bp, Artificial Sequence
  Description of Artificial Sequence: Synthetic oligonucleotide
gtagaaaggcatgaagcaggaacat

SEQ ID NO: 420 - DNA, 17 bp, Artificial Sequence
  Description of Artificial Sequence: Synthetic oligonucleotide
gtagaaaggcatgaagc

SEQ ID NO: 421 - DNA, 18 bp, Artificial Sequence
  Description of Artificial Sequence: Synthetic oligonucleotide
gtagaaaggcatgaagca

SEQ ID NO: 422 - DNA, 19 bp, Artificial Sequence
  Description of Artificial Sequence: Synthetic oligonucleotide
gtagaaaggcatgaagcag

SEQ ID NO: 423 - DNA, 20 bp, Artificial Sequence
  Description of Artificial Sequence: Synthetic oligonucleotide
gtagaaaggcatgaagcagg

SEQ ID NO: 424 - DNA, 20 bp, Artificial Sequence
  Description of Artificial Sequence: Synthetic oligonucleotide
gtcactgtagaaaggcatga

SEQ ID NO: 425 - DNA, 19 bp, Artificial Sequence
  Description of Artificial Sequence: Synthetic oligonucleotide
gtgcttggctcctgcctgg

SEQ ID NO: 426 - DNA, 20 bp, Artificial Sequence
  Description of Artificial Sequence: Synthetic oligonucleotide
gtgcttggctcctgcctggg

SEQ ID NO: 427 - DNA, 19 bp, Artificial Sequence
  Description of Artificial Sequence: Synthetic oligonucleotide
gttacccccgccatggaga

SEQ ID NO: 428 - DNA, 19 bp, Artificial Sequence
  Description of Artificial Sequence: Synthetic oligonucleotide
gttccgactcctggccttc

SEQ ID NO: 429 - DNA, 20 bp, Artificial Sequence
  Description of Artificial Sequence: Synthetic oligonucleotide
gttccgactcctggccttcc

SEQ ID NO: 430 - DNA, 19 bp, Artificial Sequence
  Description of Artificial Sequence: Synthetic oligonucleotide
tacccccgccatggagacg

SEQ ID NO: 431 - DNA, 19 bp, Artificial Sequence
  Description of Artificial Sequence: Synthetic oligonucleotide
tccgactcctggccttccg

SEQ ID NO: 432 - DNA, 17 bp, Artificial Sequence
  Description of Artificial Sequence: Synthetic oligonucleotide
tgttacccccgccatgg

SEQ ID NO: 433 - DNA, 19 bp, Artificial Sequence
  Description of Artificial Sequence: Synthetic oligonucleotide
tgttacccccgccatggag

SEQ ID NO: 434 - RNA, 21 nt, Artificial Sequence
  Description of Artificial Sequence: Synthetic oligonucleotide
gggacacccgcuccuccacuu

SEQ ID NO: 435 - RNA, 21 nt, Artificial Sequence
  Description of Artificial Sequence: Synthetic oligonucleotide
agggacacccgcuccuccauu

SEQ ID NO: 436 - RNA, 21 nt, Artificial Sequence
  Description of Artificial Sequence: Synthetic oligonucleotide
aucagggacacccgcuccuuu

SEQ ID NO: 437 - RNA, 21 nt, Artificial Sequence
  Description of Artificial Sequence: Synthetic oligonucleotide
ucuugugcaccaccaccucuu

SEQ ID NO: 438 - RNA, 21 nt, Artificial Sequence
  Description of Artificial Sequence: Synthetic oligonucleotide
ccuggagguuucccuggcuuu

SEQ ID NO: 439 - RNA, 21 nt, Artificial Sequence
  Description of Artificial Sequence: Synthetic oligonucleotide
cuggagguuucccuggcucuu

SEQ ID NO: 440 - RNA, 21 nt, Artificial Sequence
  Description of Artificial Sequence: Synthetic oligonucleotide
ccguggguguccccuggaguu

SEQ ID NO: 441 - RNA, 21 nt, Artificial Sequence
  Description of Artificial Sequence: Synthetic oligonucleotide
ggacacccgcuccuccacauu

SEQ ID NO: 442 - RNA, 21 nt, Artificial Sequence
  Description of Artificial Sequence: Synthetic oligonucleotide
guccguggguguccccugguu

SEQ ID NO: 443 - RNA, 21 nt, Artificial Sequence
  Description of Artificial Sequence: Synthetic oligonucleotide
cccagcacuccucgaugguuu

SEQ ID NO: 444 - RNA, 21 nt, Artificial Sequence
  Description of Artificial Sequence: Synthetic oligonucleotide
cccccgagccuugaucuccuu

SEQ ID NO: 445 - RNA, 21 nt, Artificial Sequence
  Description of Artificial Sequence: Synthetic oligonucleotide
gcugggccaggcccggguguu

SEQ ID NO: 446 - RNA, 21 nt, Artificial Sequence
  Description of Artificial Sequence: Synthetic oligonucleotide
gacacccgcuccuccacacuu

SEQ ID NO: 447 - RNA, 21 nt, Artificial Sequence
  Description of Artificial Sequence: Synthetic oligonucleotide
ugcgcuccagcucccaguuuu

SEQ ID NO: 448 - RNA, 21 nt, Artificial Sequence
  Description of Artificial Sequence: Synthetic oligonucleotide
cacucccgugucucagccuuu

SEQ ID NO: 449 - RNA, 21 nt, Artificial Sequence
  Description of Artificial Sequence: Synthetic oligonucleotide
uggugggccucaucuucuuuu

SEQ ID NO: 450 - RNA, 21 nt, Artificial Sequence
  Description of Artificial Sequence: Synthetic oligonucleotide
agggaaaggcccccgaugguu

SEQ ID NO: 451 - RNA, 21 nt, Artificial Sequence
  Description of Artificial Sequence: Synthetic oligonucleotide
acugcuuguccuggagugguu

SEQ ID NO: 452 - RNA, 21 nt, Artificial Sequence
  Description of Artificial Sequence: Synthetic oligonucleotide
gcuccaggccgcucugguuuu

SEQ ID NO: 453 - RNA, 21 nt, Artificial Sequence
  Description of Artificial Sequence: Synthetic oligonucleotide
gggauggugguggaggcccuu

SEQ ID NO: 454 - RNA, 21 nt, Artificial Sequence
  Description of Artificial Sequence: Synthetic oligonucleotide
agggaaaggcccccgaugguu

SEQ ID NO: 455 - RNA, 21 nt, Artificial Sequence
  Description of Artificial Sequence: Synthetic oligonucleotide
acugcuuguccuggagugguu

SEQ ID NO: 456 - RNA, 21 nt, Artificial Sequence
  Description of Artificial Sequence: Synthetic oligonucleotide
gcuccaggccgcucugguuuu

SEQ ID NO: 457 - RNA, 21 nt, Artificial Sequence
  Description of Artificial Sequence: Synthetic oligonucleotide
gggauggugguggaggcccuu

SEQ ID NO: 458 - DNA, 21 bp, Artificial Sequence
  Description of Artificial Sequence: Synthetic oligonucleotide
  Description of Combined DNA/RNA Molecule: Synthetic oligonucleotide
tggugcgcuccagcucccatu

SEQ ID NO: 459 - DNA, 21 bp, Artificial Sequence
  Description of Artificial Sequence: Synthetic oligonucleotide
  Description of Combined DNA/RNA Molecule: Synthetic oligonucleotide
tuggugcgcuccagcuccctu

SEQ ID NO: 460 - DNA, 21 bp, Artificial Sequence
  Description of Artificial Sequence: Synthetic oligonucleotide
  Description of Combined DNA/RNA Molecule: Synthetic oligonucleotide
tuuggugcgcuccagcucctu

SEQ ID NO: 461 - DNA, 21 bp, Artificial Sequence
  Description of Artificial Sequence: Synthetic oligonucleotide
  Description of Combined DNA/RNA Molecule: Synthetic oligonucleotide
tcccgagccuugaucuccatu

SEQ ID NO: 462 - DNA, 21 bp, Artificial Sequence
  Description of Artificial Sequence: Synthetic oligonucleotide
  Description of Combined DNA/RNA Molecule: Synthetic oligonucleotide
tcugggccaggcccgggugtu

SEQ ID NO: 463 - DNA, 21 bp, Artificial Sequence
  Description of Artificial Sequence: Synthetic oligonucleotide
  Description of Combined DNA/RNA Molecule: Synthetic oligonucleotide
tccccgagccuugaucucctu

SEQ ID NO: 464 - DNA, 21 bp, Artificial Sequence
  Description of Artificial Sequence: Synthetic oligonucleotide
  Description of Combined DNA/RNA Molecule: Synthetic oligonucleotide
tggagguuucccuggcucatu

SEQ ID NO: 465 - DNA, 21 bp, Artificial Sequence
  Description of Artificial Sequence: Synthetic oligonucleotide
  Description of Combined DNA/RNA Molecule: Synthetic oligonucleotide
tggagguuucccuggcucatu

SEQ ID NO: 466 - DNA, 21 bp, Artificial Sequence
  Description of Artificial Sequence: Synthetic oligonucleotide
  Description of Combined DNA/RNA Molecule: Synthetic oligonucleotide
tuggagguuucccuggcuctu

SEQ ID NO: 467 - DNA, 21 bp, Artificial Sequence
  Description of Artificial Sequence: Synthetic oligonucleotide
  Description of Combined DNA/RNA Molecule: Synthetic oligonucleotide
tuggagguuucccuggcuctu

SEQ ID NO: 468 - DNA, 21 bp, Artificial Sequence
  Description of Artificial Sequence: Synthetic oligonucleotide
  Description of Combined DNA/RNA Molecule: Synthetic oligonucleotide
tgacacccgcuccuccacatu

SEQ ID NO: 469 - DNA, 21 bp, Artificial Sequence
  Description of Artificial Sequence: Synthetic oligonucleotide
  Description of Combined DNA/RNA Molecule: Synthetic oligonucleotide
tgacacccgcuccuccacatu

SEQ ID NO: 470 - DNA, 21 bp, Artificial Sequence
  Description of Artificial Sequence: Synthetic oligonucleotide
  Description of Combined DNA/RNA Molecule: Synthetic oligonucleotide
tggacacccgcuccuccactu

SEQ ID NO: 471 - DNA, 21 bp, Artificial Sequence
  Description of Artificial Sequence: Synthetic oligonucleotide
  Description of Combined DNA/RNA Molecule: Synthetic oligonucleotide
tggacacccgcuccuccactu

SEQ ID NO: 472 - DNA, 23 bp, Artificial Sequence
  Description of Artificial Sequence: Synthetic oligonucleotide
  Description of Combined DNA/RNA Molecule: Synthetic oligonucleotide
taggaggcuucccuggcucaatu

SEQ ID NO: 473 - DNA, 23 bp, Artificial Sequence
  Description of Artificial Sequence: Synthetic oligonucleotide
  Description of Combined DNA/RNA Molecule: Synthetic oligonucleotide
tggaggcuucccuggcucaaatu

SEQ ID NO: 474 - DNA, 23 bp, Artificial Sequence
  Description of Artificial Sequence: Synthetic oligonucleotide
  Description of Combined DNA/RNA Molecule: Synthetic oligonucleotide
tuggagguuucccuggcucaatu

SEQ ID NO: 475 - DNA, 23 bp, Artificial Sequence
  Description of Artificial Sequence: Synthetic oligonucleotide
  Description of Combined DNA/RNA Molecule: Synthetic oligonucleotide
tggagguuucccuggcucaaatu

SEQ ID NO: 476 - DNA, 23 bp, Artificial Sequence
  Description of Artificial Sequence: Synthetic oligonucleotide
  Description of Combined DNA/RNA Molecule: Synthetic oligonucleotide
tuggagguuucccuggcucaatu

SEQ ID NO: 477 - DNA, 23 bp, Artificial Sequence
  Description of Artificial Sequence: Synthetic oligonucleotide
  Description of Combined DNA/RNA Molecule: Synthetic oligonucleotide
tggagguuucccuggcucaaatu

SEQ ID NO: 478 - RNA, 21 nt, Artificial Sequence
  Description of Artificial Sequence: Synthetic oligonucleotide
gccucagucugcuucgcacuu

SEQ ID NO: 479 - DNA, 25 bp, Artificial Sequence
  Description of Artificial Sequence: Synthetic oligonucleotide
  Description of Combined DNA/RNA Molecule: Synthetic oligonucleotide
gccucagucugcuucgcaccttcuu

SEQ ID NO: 480 - DNA, 21 bp, Artificial Sequence
  Description of Artificial Sequence: Synthetic oligonucleotide
  Description of Combined DNA/RNA Molecule: Synthetic oligonucleotide
gccucagucugcuucgcactu

SEQ ID NO: 481 - DNA, 21 bp, Artificial Sequence
  Description of Artificial Sequence: Synthetic oligonucleotide
  Description of Combined DNA/RNA Molecule: Synthetic oligonucleotide
gccucagucugcuucgcatuu

SEQ ID NO: 482 - DNA, 25 bp, Artificial Sequence
  Description of Artificial Sequence: Synthetic oligonucleotide
  Description of Combined DNA/RNA Molecule: Synthetic oligonucleotide
gccucagucugcuucgcaccttctu

SEQ ID NO: 483 - DNA, 25 bp, Artificial Sequence
  Description of Artificial Sequence: Synthetic oligonucleotide
  Description of Combined DNA/RNA Molecule: Synthetic oligonucleotide
gccucagucugcuucgcacctttuu

SEQ ID NO: 484 - RNA, 21 nt, Artificial Sequence
  Description of Artificial Sequence: Synthetic oligonucleotide
gccucagucugcuucgcacuu

SEQ ID NO: 485 - DNA, 25 bp, Artificial Sequence
  Description of Artificial Sequence: Synthetic oligonucleotide
  Description of Combined DNA/RNA Molecule: Synthetic oligonucleotide
gccucagucugcuucgcaccttcuu

SEQ ID NO: 486 - RNA, 21 nt, Artificial Sequence
  Description of Artificial Sequence: Synthetic oligonucleotide
ugguaauccacuuucagaguu

SEQ ID NO: 487 - DNA, 25 bp, Artificial Sequence
  Description of Artificial Sequence: Synthetic oligonucleotide
  Description of Combined DNA/RNA Molecule: Synthetic oligonucleotide
ugguaauccacuuucagaggtttuu

SEQ ID NO: 488 - DNA, 21 bp, Artificial Sequence
  Description of Artificial Sequence: Synthetic oligonucleotide
  Description of Combined DNA/RNA Molecule: Synthetic oligonucleotide
ugguaauccacuuucagagtu

SEQ ID NO: 489 - DNA, 21 bp, Artificial Sequence
  Description of Artificial Sequence: Synthetic oligonucleotide
  Description of Combined DNA/RNA Molecule: Synthetic oligonucleotide
ugguaauccacuuucagatuu

SEQ ID NO: 490 - DNA, 25 bp, Artificial Sequence
  Description of Artificial Sequence: Synthetic oligonucleotide
  Description of Combined DNA/RNA Molecule: Synthetic oligonucleotide
ugguaauccacuuucagaggttttu

SEQ ID NO: 491 - DNA, 20 bp, Artificial Sequence
  Description of Artificial Sequence: Synthetic oligonucleotide
tggtaatccactttcagagg

SEQ ID NO: 492 - DNA, 20 bp, Artificial Sequence
  Description of Artificial Sequence: Synthetic oligonucleotide
tggtaatccactttcagagg

SEQ ID NO: 493 - DNA, 20 bp, Artificial Sequence
  Description of Artificial Sequence: Synthetic oligonucleotide
tggtaatccactttcagagg

SEQ ID NO: 494 - DNA, 20 bp, Artificial Sequence
  Description of Artificial Sequence: Synthetic oligonucleotide
tggtaatccactttcagagg

SEQ ID NO: 495 - DNA, 20 bp, Artificial Sequence
  Description of Artificial Sequence: Synthetic oligonucleotide
tggtaatccactttcagagg

SEQ ID NO: 496 - DNA, 20 bp, Artificial Sequence
  Description of Artificial Sequence: Synthetic oligonucleotide
tggtaatccactttcagagg

SEQ ID NO: 497 - DNA, 20 bp, Artificial Sequence
  Description of Artificial Sequence: Synthetic oligonucleotide
  Description of Combined DNA/RNA Molecule: Synthetic oligonucleotide
ugguaatccactttcagagg

SEQ ID NO: 498 - RNA, 20 nt, Artificial Sequence
  Description of Artificial Sequence: Synthetic oligonucleotide
ccucugaaaguggauuacca

SEQ ID NO: 499 - DNA, 20 bp, Artificial Sequence
  Description of Artificial Sequence: Synthetic oligonucleotide
  Description of Combined DNA/RNA Molecule: Synthetic oligonucleotide
ugguaatccactttcagagg

SEQ ID NO: 500 - DNA, 20 bp, Artificial Sequence
  Description of Artificial Sequence: Synthetic oligonucleotide
  Description of Combined DNA/RNA Molecule: Synthetic oligonucleotide
ugguaatccactttcagagg

SEQ ID NO: 501 - DNA, 20 bp, Artificial Sequence
  Description of Artificial Sequence: Synthetic oligonucleotide
  Description of Combined DNA/RNA Molecule: Synthetic oligonucleotide
ugguaatccactttcagagg

SEQ ID NO: 502 - DNA, 20 bp, Artificial Sequence
  Description of Artificial Sequence: Synthetic oligonucleotide
  Description of Combined DNA/RNA Molecule: Synthetic oligonucleotide
ugguaatccactttcagagg

SEQ ID NO: 503 - DNA, 20 bp, Artificial Sequence
  Description of Artificial Sequence: Synthetic oligonucleotide
tggtaatccactttcagagg

SEQ ID NO: 504 - DNA, 20 bp, Artificial Sequence
  Description of Artificial Sequence: Synthetic oligonucleotide
tggtaatccactttcagagg

SEQ ID NO: 505 - DNA, 20 bp, Artificial Sequence
  Description of Artificial Sequence: Synthetic oligonucleotide
tggtaatccactttcagagg

SEQ ID NO: 506 - DNA, 20 bp, Artificial Sequence
  Description of Artificial Sequence: Synthetic oligonucleotide
tggtaatccactttcagagg

SEQ ID NO: 507 - DNA, 20 bp, Artificial Sequence
  Description of Artificial Sequence: Synthetic oligonucleotide
tggtaatccactttcagagg

SEQ ID NO: 508 - DNA, 20 bp, Artificial Sequence
  Description of Artificial Sequence: Synthetic oligonucleotide
tggtaatccactttcagagg

SEQ ID NO: 509 - DNA, 21 bp, Artificial Sequence
  Description of Artificial Sequence: Synthetic oligonucleotide
  Description of Combined DNA/RNA Molecule: Synthetic oligonucleotide
tauaggcucccccagaggatu

SEQ ID NO: 510 - DNA, 21 bp, Artificial Sequence
  Description of Artificial Sequence: Synthetic oligonucleotide
  Description of Combined DNA/RNA Molecule: Synthetic oligonucleotide
tcauaggcucccccagaggtu

SEQ ID NO: 511 - DNA, 21 bp, Artificial Sequence
  Description of Artificial Sequence: Synthetic oligonucleotide
  Description of Combined DNA/RNA Molecule: Synthetic oligonucleotide
tccauaggcucccccagagtu

SEQ ID NO: 512 - DNA, 21 bp, Artificial Sequence
  Description of Artificial Sequence: Synthetic oligonucleotide
  Description of Combined DNA/RNA Molecule: Synthetic oligonucleotide
tcccauaggcucccccagatu

SEQ ID NO: 513 - DNA, 21 bp, Artificial Sequence
  Description of Artificial Sequence: Synthetic oligonucleotide
  Description of Combined DNA/RNA Molecule: Synthetic oligonucleotide
tacccauaggcucccccagtu

SEQ ID NO: 514 - DNA, 21 bp, Artificial Sequence
  Description of Artificial Sequence: Synthetic oligonucleotide
  Description of Combined DNA/RNA Molecule: Synthetic oligonucleotide
taacccauaggcucccccatu

SEQ ID NO: 515 - DNA, 21 bp, Artificial Sequence
  Description of Artificial Sequence: Synthetic oligonucleotide
  Description of Combined DNA/RNA Molecule: Synthetic oligonucleotide
tcaacccauaggcuccccctu

SEQ ID NO: 516 - DNA, 21 bp, Artificial Sequence
  Description of Artificial Sequence: Synthetic oligonucleotide
  Description of Combined DNA/RNA Molecule: Synthetic oligonucleotide
tccaacccauaggcucccctu

SEQ ID NO: 517 - DNA, 21 bp, Artificial Sequence
  Description of Artificial Sequence: Synthetic oligonucleotide
  Description of Combined DNA/RNA Molecule: Synthetic oligonucleotide
tcccaacccauaggcuccctu

SEQ ID NO: 518 - DNA, 21 bp, Artificial Sequence
  Description of Artificial Sequence: Synthetic oligonucleotide
  Description of Combined DNA/RNA Molecule: Synthetic oligonucleotide
tccccaacccauaggcucctu

SEQ ID NO: 519 - DNA, 21 bp, Artificial Sequence
  Description of Artificial Sequence: Synthetic oligonucleotide
  Description of Combined DNA/RNA Molecule: Synthetic oligonucleotide
tcccccaacccauaggcuctu

SEQ ID NO: 520 - DNA, 21 bp, Artificial Sequence
  Description of Artificial Sequence: Synthetic oligonucleotide
  Description of Combined DNA/RNA Molecule: Synthetic oligonucleotide
tccccccaacccauaggcutu

SEQ ID NO: 521 - DNA, 21 bp, Artificial Sequence
  Description of Artificial Sequence: Synthetic oligonucleotide
  Description of Combined DNA/RNA Molecule: Synthetic oligonucleotide
tgccccccaacccauaggctu

SEQ ID NO: 522 - DNA, 21 bp, Artificial Sequence
  Description of Artificial Sequence: Synthetic oligonucleotide
  Description of Combined DNA/RNA Molecule: Synthetic oligonucleotide
tcgccccccaacccauaggtu

SEQ ID NO: 523 - DNA, 21 bp, Artificial Sequence
  Description of Artificial Sequence: Synthetic oligonucleotide
  Description of Combined DNA/RNA Molecule: Synthetic oligonucleotide
tccgccccccaacccauagtu

SEQ ID NO: 524 - DNA, 21 bp, Artificial Sequence
  Description of Artificial Sequence: Synthetic oligonucleotide
  Description of Combined DNA/RNA Molecule: Synthetic oligonucleotide
tgccgccccccaacccauatu

SEQ ID NO: 525 - DNA, 21 bp, Artificial Sequence
  Description of Artificial Sequence: Synthetic oligonucleotide
  Description of Combined DNA/RNA Molecule: Synthetic oligonucleotide
tagccgccccccaacccautu

SEQ ID NO: 526 - DNA, 21 bp, Artificial Sequence
  Description of Artificial Sequence: Synthetic oligonucleotide
  Description of Combined DNA/RNA Molecule: Synthetic oligonucleotide
tuagccgccccccaacccatu

SEQ ID NO: 527 - DNA, 21 bp, Artificial Sequence
  Description of Artificial Sequence: Synthetic oligonucleotide
  Description of Combined DNA/RNA Molecule: Synthetic oligonucleotide
tauagccgccccccaaccctu

SEQ ID NO: 528 - DNA, 21 bp, Artificial Sequence
  Description of Artificial Sequence: Synthetic oligonucleotide
  Description of Combined DNA/RNA Molecule: Synthetic oligonucleotide
tcauagccgccccccaacctu

SEQ ID NO: 529 - DNA, 21 bp, Artificial Sequence
  Description of Artificial Sequence: Synthetic oligonucleotide
  Description of Combined DNA/RNA Molecule: Synthetic oligonucleotide
tccauagccgccccccaactu

SEQ ID NO: 530 - DNA, 21 bp, Artificial Sequence
  Description of Artificial Sequence: Synthetic oligonucleotide
  Description of Combined DNA/RNA Molecule: Synthetic oligonucleotide
tgccauagccgccccccaatu

SEQ ID NO: 531 - DNA, 23 bp, Artificial Sequence
  Description of Artificial Sequence: Synthetic oligonucleotide
  Description of Combined DNA/RNA Molecule: Synthetic oligonucleotide
tauaggcucccccagaggagatu

SEQ ID NO: 532 - DNA, 23 bp, Artificial Sequence
  Description of Artificial Sequence: Synthetic oligonucleotide
  Description of Combined DNA/RNA Molecule: Synthetic oligonucleotide
tcauaggcucccccagaggagtu

SEQ ID NO: 533 - DNA, 23 bp, Artificial Sequence
  Description of Artificial Sequence: Synthetic oligonucleotide
  Description of Combined DNA/RNA Molecule: Synthetic oligonucleotide
tccauaggcucccccagaggatu

SEQ ID NO: 534 - DNA, 23 bp, Artificial Sequence
  Description of Artificial Sequence: Synthetic oligonucleotide
  Description of Combined DNA/RNA Molecule: Synthetic oligonucleotide
tcccauaggcucccccagaggtu

SEQ ID NO: 535 - DNA, 23 bp, Artificial Sequence
  Description of Artificial Sequence: Synthetic oligonucleotide
  Description of Combined DNA/RNA Molecule: Synthetic oligonucleotide
tacccauaggcucccccagagtu

SEQ ID NO: 536 - DNA, 23 bp, Artificial Sequence
  Description of Artificial Sequence: Synthetic oligonucleotide
  Description of Combined DNA/RNA Molecule: Synthetic oligonucleotide
taacccauaggcucccccagatu

SEQ ID NO: 537 - DNA, 23 bp, Artificial Sequence
  Description of Artificial Sequence: Synthetic oligonucleotide
  Description of Combined DNA/RNA Molecule: Synthetic oligonucleotide
tcaacccauaggcucccccagtu

SEQ ID NO: 538 - DNA, 23 bp, Artificial Sequence
  Description of Artificial Sequence: Synthetic oligonucleotide
  Description of Combined DNA/RNA Molecule: Synthetic oligonucleotide
tccaacccauaggcucccccatu

SEQ ID NO: 539 - DNA, 23 bp, Artificial Sequence
  Description of Artificial Sequence: Synthetic oligonucleotide
  Description of Combined DNA/RNA Molecule: Synthetic oligonucleotide
tcccaacccauaggcuccccctu

SEQ ID NO: 540 - DNA, 23 bp, Artificial Sequence
  Description of Artificial Sequence: Synthetic oligonucleotide
  Description of Combined DNA/RNA Molecule: Synthetic oligonucleotide
tccccaacccauaggcucccctu

SEQ ID NO: 541 - DNA, 23 bp, Artificial Sequence
  Description of Artificial Sequence: Synthetic oligonucleotide
  Description of Combined DNA/RNA Molecule: Synthetic oligonucleotide
tcccccaacccauaggcuccctu

SEQ ID NO: 542 - DNA, 23 bp, Artificial Sequence
  Description of Artificial Sequence: Synthetic oligonucleotide
  Description of Combined DNA/RNA Molecule: Synthetic oligonucleotide
tccccccaacccauaggcucctu

SEQ ID NO: 543 - DNA, 23 bp, Artificial Sequence
  Description of Artificial Sequence: Synthetic oligonucleotide
  Description of Combined DNA/RNA Molecule: Synthetic oligonucleotide
tgccccccaacccauaggcuctu

SEQ ID NO: 544 - DNA, 23 bp, Artificial Sequence
  Description of Artificial Sequence: Synthetic oligonucleotide
  Description of Combined DNA/RNA Molecule: Synthetic oligonucleotide
tcgccccccaacccauaggcutu

SEQ ID NO: 545 - DNA, 23 bp, Artificial Sequence
  Description of Artificial Sequence: Synthetic oligonucleotide
  Description of Combined DNA/RNA Molecule: Synthetic oligonucleotide
tccgccccccaacccauaggctu

SEQ ID NO: 546 - DNA, 23 bp, Artificial Sequence
  Description of Artificial Sequence: Synthetic oligonucleotide
  Description of Combined DNA/RNA Molecule: Synthetic oligonucleotide
tgccgccccccaacccauaggtu

SEQ ID NO: 547 - DNA, 23 bp, Artificial Sequence
  Description of Artificial Sequence: Synthetic oligonucleotide
  Description of Combined DNA/RNA Molecule: Synthetic oligonucleotide
tagccgccccccaacccauagtu

SEQ ID NO: 548 - DNA, 23 bp, Artificial Sequence
  Description of Artificial Sequence: Synthetic oligonucleotide
  Description of Combined DNA/RNA Molecule: Synthetic oligonucleotide
tuagccgccccccaacccauatu

SEQ ID NO: 549 - DNA, 23 bp, Artificial Sequence
  Description of Artificial Sequence: Synthetic oligonucleotide
  Description of Combined DNA/RNA Molecule: Synthetic oligonucleotide
tauagccgccccccaacccautu

SEQ ID NO: 550 - DNA, 23 bp, Artificial Sequence
  Description of Artificial Sequence: Synthetic oligonucleotide
  Description of Combined DNA/RNA Molecule: Synthetic oligonucleotide
tcauagccgccccccaacccatu

SEQ ID NO: 551 - DNA, 23 bp, Artificial Sequence
  Description of Artificial Sequence: Synthetic oligonucleotide
  Description of Combined DNA/RNA Molecule: Synthetic oligonucleotide
tccauagccgccccccaaccctu

SEQ ID NO: 552 - DNA, 23 bp, Artificial Sequence
  Description of Artificial Sequence: Synthetic oligonucleotide
  Description of Combined DNA/RNA Molecule: Synthetic oligonucleotide
tgccauagccgccccccaacctu

SEQ ID NO: 553 - DNA, 23 bp, Artificial Sequence
  Description of Artificial Sequence: Synthetic oligonucleotide
  Description of Combined DNA/RNA Molecule: Synthetic oligonucleotide
tcgccauagccgccccccaactu

SEQ ID NO: 554 - DNA, 23 bp, Artificial Sequence
  Description of Artificial Sequence: Synthetic oligonucleotide
  Description of Combined DNA/RNA Molecule: Synthetic oligonucleotide
tccgccauagccgccccccaatu

SEQ ID NO: 555 - RNA, 21 nt, Artificial Sequence
  Description of Artificial Sequence: Synthetic oligonucleotide
agccgccccccaacccauauu

SEQ ID NO: 556 - RNA, 21 nt, Artificial Sequence
  Description of Artificial Sequence: Synthetic oligonucleotide
agguagucauggugcagaguu

SEQ ID NO: 557 - RNA, 21 nt, Artificial Sequence
  Description of Artificial Sequence: Synthetic oligonucleotide
caacccauaggcucccccauu

SEQ ID NO: 558 - RNA, 21 nt, Artificial Sequence
  Description of Artificial Sequence: Synthetic oligonucleotide
cagguagucauggugcagauu

SEQ ID NO: 559 - RNA, 21 nt, Artificial Sequence
  Description of Artificial Sequence: Synthetic oligonucleotide
ccaacccauaggcucccccuu

SEQ ID NO: 560 - RNA, 21 nt, Artificial Sequence
  Description of Artificial Sequence: Synthetic oligonucleotide
cccaacccauaggcuccccuu

SEQ ID NO: 561 - RNA, 21 nt, Artificial Sequence
  Description of Artificial Sequence: Synthetic oligonucleotide
ccccaacccauaggcucccuu

SEQ ID NO: 562 - RNA, 21 nt, Artificial Sequence
  Description of Artificial Sequence: Synthetic oligonucleotide
cccccaacccauaggcuccuu

SEQ ID NO: 563 - RNA, 21 nt, Artificial Sequence
  Description of Artificial Sequence: Synthetic oligonucleotide
ccccccaacccauaggcucuu

SEQ ID NO: 564 - RNA, 21 nt, Artificial Sequence
  Description of Artificial Sequence: Synthetic oligonucleotide
ccgccccccaacccauagguu

SEQ ID NO: 565 - RNA, 21 nt, Artificial Sequence
  Description of Artificial Sequence: Synthetic oligonucleotide
cgccccccaacccauaggcuu

SEQ ID NO: 566 - RNA, 21 nt, Artificial Sequence
  Description of Artificial Sequence: Synthetic oligonucleotide
cugcagguagucauggugcuu

SEQ ID NO: 567 - RNA, 21 nt, Artificial Sequence
  Description of Artificial Sequence: Synthetic oligonucleotide
gcagguagucauggugcaguu

SEQ ID NO: 568 - RNA, 21 nt, Artificial Sequence
  Description of Artificial Sequence: Synthetic oligonucleotide
gccccccaacccauaggcuuu

SEQ ID NO: 569 - RNA, 21 nt, Artificial Sequence
  Description of Artificial Sequence: Synthetic oligonucleotide
gccgccccccaacccauaguu

SEQ ID NO: 570 - RNA, 21 nt, Artificial Sequence
  Description of Artificial Sequence: Synthetic oligonucleotide
gcugcagguagucaugguguu

SEQ ID NO: 571 - RNA, 21 nt, Artificial Sequence
  Description of Artificial Sequence: Synthetic oligonucleotide
gguagucauggugcagagguu

SEQ ID NO: 572 - RNA, 21 nt, Artificial Sequence
  Description of Artificial Sequence: Synthetic oligonucleotide
guagucauggugcagaggauu

SEQ ID NO: 573 - RNA, 21 nt, Artificial Sequence
  Description of Artificial Sequence: Synthetic oligonucleotide
ugcagguagucauggugcauu

SEQ ID NO: 574 - RNA, 21 nt, Artificial Sequence
  Description of Artificial Sequence: Synthetic oligonucleotide
gggacacccgcuccuccacuu

SEQ ID NO: 575 - RNA, 21 nt, Artificial Sequence
  Description of Artificial Sequence: Synthetic oligonucleotide
agggacacccgcuccuccauu

SEQ ID NO: 576 - RNA, 21 nt, Artificial Sequence
  Description of Artificial Sequence: Synthetic oligonucleotide
aucagggacacccgcuccuuu

SEQ ID NO: 577 - RNA, 21 nt, Artificial Sequence
  Description of Artificial Sequence: Synthetic oligonucleotide
ucuugugcaccaccaccucuu

SEQ ID NO: 578 - RNA, 21 nt, Artificial Sequence
  Description of Artificial Sequence: Synthetic oligonucleotide
ccuggagguuucccuggcuuu

SEQ ID NO: 579 - RNA, 21 nt, Artificial Sequence
  Description of Artificial Sequence: Synthetic oligonucleotide
cuggagguuucccuggcucuu

SEQ ID NO: 580 - RNA, 21 nt, Artificial Sequence
  Description of Artificial Sequence: Synthetic oligonucleotide
ccguggguguccccuggaguu

SEQ ID NO: 581 - RNA, 21 nt, Artificial Sequence
  Description of Artificial Sequence: Synthetic oligonucleotide
ggacacccgcuccuccacauu

SEQ ID NO: 582 - RNA, 21 nt, Artificial Sequence
  Description of Artificial Sequence: Synthetic oligonucleotide
agccgccccccaacccauauu

SEQ ID NO: 583 - RNA, 21 nt, Artificial Sequence
  Description of Artificial Sequence: Synthetic oligonucleotide
agguagucauggugcagaguu

SEQ ID NO: 584 - RNA, 21 nt, Artificial Sequence
  Description of Artificial Sequence: Synthetic oligonucleotide
caacccauaggcucccccauu

SEQ ID NO: 585 - RNA, 21 nt, Artificial Sequence
  Description of Artificial Sequence: Synthetic oligonucleotide
cagguagucauggugcagauu

SEQ ID NO: 586 - RNA, 21 nt, Artificial Sequence
  Description of Artificial Sequence: Synthetic oligonucleotide
ccaacccauaggcucccccuu

SEQ ID NO: 587 - RNA, 21 nt, Artificial Sequence
  Description of Artificial Sequence: Synthetic oligonucleotide
cccaacccauaggcuccccuu

SEQ ID NO: 588 - RNA, 21 nt, Artificial Sequence
  Description of Artificial Sequence: Synthetic oligonucleotide
ccccaacccauaggcucccuu

SEQ ID NO: 589 - RNA, 21 nt, Artificial Sequence
  Description of Artificial Sequence: Synthetic oligonucleotide
cccccaacccauaggcuccuu

SEQ ID NO: 590 - RNA, 21 nt, Artificial Sequence
  Description of Artificial Sequence: Synthetic oligonucleotide
ccccccaacccauaggcucuu

SEQ ID NO: 591 - RNA, 21 nt, Artificial Sequence
  Description of Artificial Sequence: Synthetic oligonucleotide
ccgccccccaacccauagguu

SEQ ID NO: 592 - RNA, 21 nt, Artificial Sequence
  Description of Artificial Sequence: Synthetic oligonucleotide
cgccccccaacccauaggcuu

SEQ ID NO: 593 - RNA, 21 nt, Artificial Sequence
  Description of Artificial Sequence: Synthetic oligonucleotide
cugcagguagucauggugcuu

SEQ ID NO: 594 - RNA, 21 nt, Artificial Sequence
  Description of Artificial Sequence: Synthetic oligonucleotide
gcagguagucauggugcaguu

SEQ ID NO: 595 - RNA, 21 nt, Artificial Sequence
  Description of Artificial Sequence: Synthetic oligonucleotide
gccccccaacccauaggcuuu

SEQ ID NO: 596 - RNA, 21 nt, Artificial Sequence
  Description of Artificial Sequence: Synthetic oligonucleotide
gccgccccccaacccauaguu

SEQ ID NO: 597 - RNA, 21 nt, Artificial Sequence
  Description of Artificial Sequence: Synthetic oligonucleotide
gcugcagguagucaugguguu

SEQ ID NO: 598 - RNA, 21 nt, Artificial Sequence
  Description of Artificial Sequence: Synthetic oligonucleotide
gguagucauggugcagagguu

SEQ ID NO: 599 - RNA, 21 nt, Artificial Sequence
  Description of Artificial Sequence: Synthetic oligonucleotide
guagucauggugcagaggauu

SEQ ID NO: 600 - RNA, 21 nt, Artificial Sequence
  Description of Artificial Sequence: Synthetic oligonucleotide
ugcagguagucauggugcauu

SEQ ID NO: 601 - DNA, 21 bp, Artificial Sequence
  Description of Artificial Sequence: Synthetic oligonucleotide
  Description of Combined DNA/RNA Molecule: Synthetic oligonucleotide
tagucauggugcagaggagtu

SEQ ID NO: 602 - DNA, 21 bp, Artificial Sequence
  Description of Artificial Sequence: Synthetic oligonucleotide
  Description of Combined DNA/RNA Molecule: Synthetic oligonucleotide
tuagucauggugcagaggatu

SEQ ID NO: 603 - DNA, 21 bp, Artificial Sequence
  Description of Artificial Sequence: Synthetic oligonucleotide
  Description of Combined DNA/RNA Molecule: Synthetic oligonucleotide
tguagucauggugcagaggtu

SEQ ID NO: 604 - DNA, 21 bp, Artificial Sequence
  Description of Artificial Sequence: Synthetic oligonucleotide
  Description of Combined DNA/RNA Molecule: Synthetic oligonucleotide
tgguagucauggugcagagtu

SEQ ID NO: 605 - DNA, 21 bp, Artificial Sequence
  Description of Artificial Sequence: Synthetic oligonucleotide
  Description of Combined DNA/RNA Molecule: Synthetic oligonucleotide
tagguagucauggugcagatu

SEQ ID NO: 606 - DNA, 21 bp, Artificial Sequence
  Description of Artificial Sequence: Synthetic oligonucleotide
  Description of Combined DNA/RNA Molecule: Synthetic oligonucleotide
tcagguagucauggugcagtu

SEQ ID NO: 607 - DNA, 21 bp, Artificial Sequence
  Description of Artificial Sequence: Synthetic oligonucleotide
  Description of Combined DNA/RNA Molecule: Synthetic oligonucleotide
tgcagguagucauggugcatu

SEQ ID NO: 608 - DNA, 21 bp, Artificial Sequence
  Description of Artificial Sequence: Synthetic oligonucleotide
  Description of Combined DNA/RNA Molecule: Synthetic oligonucleotide
tugcagguagucauggugctu

SEQ ID NO: 609 - DNA, 21 bp, Artificial Sequence
  Description of Artificial Sequence: Synthetic oligonucleotide
  Description of Combined DNA/RNA Molecule: Synthetic oligonucleotide
tcugcagguagucauggugtu

SEQ ID NO: 610 - DNA, 21 bp, Artificial Sequence
  Description of Artificial Sequence: Synthetic oligonucleotide
  Description of Combined DNA/RNA Molecule: Synthetic oligonucleotide
tgcugcagguagucauggutu

SEQ ID NO: 611 - DNA, 21 bp, Artificial Sequence
  Description of Artificial Sequence: Synthetic oligonucleotide
  Description of Combined DNA/RNA Molecule: Synthetic oligonucleotide
tggcugcagguagucauggtu

SEQ ID NO: 612 - DNA, 21 bp, Artificial Sequence
  Description of Artificial Sequence: Synthetic oligonucleotide
  Description of Combined DNA/RNA Molecule: Synthetic oligonucleotide
tcggcugcagguagucaugtu

SEQ ID NO: 613 - DNA, 21 bp, Artificial Sequence
  Description of Artificial Sequence: Synthetic oligonucleotide
  Description of Combined DNA/RNA Molecule: Synthetic oligonucleotide
tgcggcugcagguagucautu

SEQ ID NO: 614 - DNA, 21 bp, Artificial Sequence
  Description of Artificial Sequence: Synthetic oligonucleotide
  Description of Combined DNA/RNA Molecule: Synthetic oligonucleotide
tggcggcugcagguagucatu

SEQ ID NO: 615 - DNA, 21 bp, Artificial Sequence
  Description of Artificial Sequence: Synthetic oligonucleotide
  Description of Combined DNA/RNA Molecule: Synthetic oligonucleotide
tuggcggcugcagguaguctu

SEQ ID NO: 616 - DNA, 21 bp, Artificial Sequence
  Description of Artificial Sequence: Synthetic oligonucleotide
  Description of Combined DNA/RNA Molecule: Synthetic oligonucleotide
tcuggcggcugcagguagutu

SEQ ID NO: 617 - DNA, 21 bp, Artificial Sequence
  Description of Artificial Sequence: Synthetic oligonucleotide
  Description of Combined DNA/RNA Molecule: Synthetic oligonucleotide
tacuggcggcugcagguagtu

SEQ ID NO: 618 - DNA, 21 bp, Artificial Sequence
  Description of Artificial Sequence: Synthetic oligonucleotide
  Description of Combined DNA/RNA Molecule: Synthetic oligonucleotide
taacuggcggcugcagguatu

SEQ ID NO: 619 - DNA, 23 bp, Artificial Sequence
  Description of Artificial Sequence: Synthetic oligonucleotide
  Description of Combined DNA/RNA Molecule: Synthetic oligonucleotide
tagucauggugcagaggagggtu

SEQ ID NO: 620 - DNA, 23 bp, Artificial Sequence
  Description of Artificial Sequence: Synthetic oligonucleotide
  Description of Combined DNA/RNA Molecule: Synthetic oligonucleotide
tuagucauggugcagaggaggtu

SEQ ID NO: 621 - DNA, 23 bp, Artificial Sequence
  Description of Artificial Sequence: Synthetic oligonucleotide
  Description of Combined DNA/RNA Molecule: Synthetic oligonucleotide
tguagucauggugcagaggagtu

SEQ ID NO: 622 - DNA, 23 bp, Artificial Sequence
  Description of Artificial Sequence: Synthetic oligonucleotide
  Description of Combined DNA/RNA Molecule: Synthetic oligonucleotide
tgguagucauggugcagaggatu

SEQ ID NO: 623 - DNA, 23 bp, Artificial Sequence
  Description of Artificial Sequence: Synthetic oligonucleotide
  Description of Combined DNA/RNA Molecule: Synthetic oligonucleotide
tagguagucauggugcagaggtu

SEQ ID NO: 624 - DNA, 23 bp, Artificial Sequence
  Description of Artificial Sequence: Synthetic oligonucleotide
  Description of Combined DNA/RNA Molecule: Synthetic oligonucleotide
tcagguagucauggugcagagtu

SEQ ID NO: 625 - DNA, 23 bp, Artificial Sequence
  Description of Artificial Sequence: Synthetic oligonucleotide
  Description of Combined DNA/RNA Molecule: Synthetic oligonucleotide
tgcagguagucauggugcagatu

SEQ ID NO: 626 - DNA, 23 bp, Artificial Sequence
  Description of Artificial Sequence: Synthetic oligonucleotide
  Description of Combined DNA/RNA Molecule: Synthetic oligonucleotide
tugcagguagucauggugcagtu

SEQ ID NO: 627 - DNA, 23 bp, Artificial Sequence
  Description of Artificial Sequence: Synthetic oligonucleotide
  Description of Combined DNA/RNA Molecule: Synthetic oligonucleotide
tcugcagguagucauggugcatu

SEQ ID NO: 628 - DNA, 23 bp, Artificial Sequence
  Description of Artificial Sequence: Synthetic oligonucleotide
  Description of Combined DNA/RNA Molecule: Synthetic oligonucleotide
tgcugcagguagucauggugctu

SEQ ID NO: 629 - DNA, 23 bp, Artificial Sequence
  Description of Artificial Sequence: Synthetic oligonucleotide
  Description of Combined DNA/RNA Molecule: Synthetic oligonucleotide
tggcugcagguagucauggugtu

SEQ ID NO: 630 - DNA, 23 bp, Artificial Sequence
  Description of Artificial Sequence: Synthetic oligonucleotide
  Description of Combined DNA/RNA Molecule: Synthetic oligonucleotide
tcggcugcagguagucauggutu

SEQ ID NO: 631 - DNA, 23 bp, Artificial Sequence
  Description of Artificial Sequence: Synthetic oligonucleotide
  Description of Combined DNA/RNA Molecule: Synthetic oligonucleotide
tgcggcugcagguagucauggtu

SEQ ID NO: 632 - DNA, 23 bp, Artificial Sequence
  Description of Artificial Sequence: Synthetic oligonucleotide
  Description of Combined DNA/RNA Molecule: Synthetic oligonucleotide
tggcggcugcagguagucaugtu

SEQ ID NO: 633 - DNA, 23 bp, Artificial Sequence
  Description of Artificial Sequence: Synthetic oligonucleotide
  Description of Combined DNA/RNA Molecule: Synthetic oligonucleotide
tuggcggcugcagguagucautu

SEQ ID NO: 634 - DNA, 23 bp, Artificial Sequence
  Description of Artificial Sequence: Synthetic oligonucleotide
  Description of Combined DNA/RNA Molecule: Synthetic oligonucleotide
tcuggcggcugcagguagucatu

SEQ ID NO: 635 - DNA, 23 bp, Artificial Sequence
  Description of Artificial Sequence: Synthetic oligonucleotide
  Description of Combined DNA/RNA Molecule: Synthetic oligonucleotide
tacuggcggcugcagguaguctu

SEQ ID NO: 636 - DNA, 23 bp, Artificial Sequence
  Description of Artificial Sequence: Synthetic oligonucleotide
  Description of Combined DNA/RNA Molecule: Synthetic oligonucleotide
taacuggcggcugcagguagutu

SEQ ID NO: 637 - DNA, 23 bp, Artificial Sequence
  Description of Artificial Sequence: Synthetic oligonucleotide
  Description of Combined DNA/RNA Molecule: Synthetic oligonucleotide
tgaacuggcggcugcagguagtu

SEQ ID NO: 638 - DNA, 23 bp, Artificial Sequence
  Description of Artificial Sequence: Synthetic oligonucleotide
  Description of Combined DNA/RNA Molecule: Synthetic oligonucleotide
tugaacuggcggcugcagguatu

SEQ ID NO: 639 - RNA, 21 nt, Artificial Sequence
  Description of Artificial Sequence: Synthetic oligonucleotide
aggagucucgacgggucucuu

SEQ ID NO: 640 - RNA, 21 nt, Artificial Sequence
  Description of Artificial Sequence: Synthetic oligonucleotide
gggccugcugaaccucugguu

SEQ ID NO: 641 - RNA, 21 nt, Artificial Sequence
  Description of Artificial Sequence: Synthetic oligonucleotide
ucauuuccucgccgauguuuu

SEQ ID NO: 642 - RNA, 21 nt, Artificial Sequence
  Description of Artificial Sequence: Synthetic oligonucleotide
agggccugcugaaccucuguu

SEQ ID NO: 643 - RNA, 21 nt, Artificial Sequence
  Description of Artificial Sequence: Synthetic oligonucleotide
cggucuacuaccaucgcuguu

SEQ ID NO: 644 - RNA, 21 nt, Artificial Sequence
  Description of Artificial Sequence: Synthetic oligonucleotide
cgcuuucauuuccucgccguu

SEQ ID NO: 645 - RNA, 21 nt, Artificial Sequence
  Description of Artificial Sequence: Synthetic oligonucleotide
ucgcuuucauuuccucgccuu

SEQ ID NO: 646 - RNA, 21 nt, Artificial Sequence
  Description of Artificial Sequence: Synthetic oligonucleotide
cuuucauuuccucgccgauuu

SEQ ID NO: 647 - RNA, 21 nt, Artificial Sequence
  Description of Artificial Sequence: Synthetic oligonucleotide
guccguggguguccccugguu

SEQ ID NO: 648 - RNA, 21 nt, Artificial Sequence
  Description of Artificial Sequence: Synthetic oligonucleotide
cccagcacuccucgaugguuu

SEQ ID NO: 649 - RNA, 21 nt, Artificial Sequence
  Description of Artificial Sequence: Synthetic oligonucleotide
cccccgagccuugaucuccuu

SEQ ID NO: 650 - RNA, 21 nt, Artificial Sequence
  Description of Artificial Sequence: Synthetic oligonucleotide
gcugggccaggcccggguguu

SEQ ID NO: 651 - RNA, 21 nt, Artificial Sequence
  Description of Artificial Sequence: Synthetic oligonucleotide
gacacccgcuccuccacacuu

SEQ ID NO: 652 - RNA, 21 nt, Artificial Sequence
  Description of Artificial Sequence: Synthetic oligonucleotide
ugcgcuccagcucccaguuuu

SEQ ID NO: 653 - RNA, 21 nt, Artificial Sequence
  Description of Artificial Sequence: Synthetic oligonucleotide
cacucccgugucucagccuuu

SEQ ID NO: 654 - RNA, 21 nt, Artificial Sequence
  Description of Artificial Sequence: Synthetic oligonucleotide
uggugggccucaucuucuuuu

SEQ ID NO: 655 - RNA, 21 nt, Artificial Sequence
  Description of Artificial Sequence: Synthetic oligonucleotide
aggagucucgacgggucucuu

SEQ ID NO: 656 - RNA, 21 nt, Artificial Sequence
  Description of Artificial Sequence: Synthetic oligonucleotide
gggccugcugaaccucugguu

SEQ ID NO: 657 - RNA, 21 nt, Artificial Sequence
  Description of Artificial Sequence: Synthetic oligonucleotide
ucauuuccucgccgauguuuu

SEQ ID NO: 658 - RNA, 21 nt, Artificial Sequence
  Description of Artificial Sequence: Synthetic oligonucleotide
agggccugcugaaccucuguu

SEQ ID NO: 659 - RNA, 21 nt, Artificial Sequence
  Description of Artificial Sequence: Synthetic oligonucleotide
cggucuacuaccaucgcuguu

SEQ ID NO: 660 - RNA, 21 nt, Artificial Sequence
  Description of Artificial Sequence: Synthetic oligonucleotide
cgcuuucauuuccucgccguu

SEQ ID NO: 661 - RNA, 21 nt, Artificial Sequence
  Description of Artificial Sequence: Synthetic oligonucleotide
ucgcuuucauuuccucgccuu

SEQ ID NO: 662 - RNA, 21 nt, Artificial Sequence
  Description of Artificial Sequence: Synthetic oligonucleotide
cuuucauuuccucgccgauuu

SEQ ID NO: 663 - DNA, 21 bp, Artificial Sequence
  Description of Artificial Sequence: Synthetic oligonucleotide
  Description of Combined DNA/RNA Molecule: Synthetic oligonucleotide
tggugcgcuccagcucccatu

SEQ ID NO: 664 - DNA, 21 bp, Artificial Sequence
  Description of Artificial Sequence: Synthetic oligonucleotide
  Description of Combined DNA/RNA Molecule: Synthetic oligonucleotide
tggugcgcuccagcucccatu

SEQ ID NO: 665 - DNA, 21 bp, Artificial Sequence
  Description of Artificial Sequence: Synthetic oligonucleotide
  Description of Combined DNA/RNA Molecule: Synthetic oligonucleotide
tuggugcgcuccagcuccctu

SEQ ID NO: 666 - DNA, 21 bp, Artificial Sequence
  Description of Artificial Sequence: Synthetic oligonucleotide
  Description of Combined DNA/RNA Molecule: Synthetic oligonucleotide
tuggugcgcuccagcuccctu

SEQ ID NO: 667 - DNA, 21 bp, Artificial Sequence
  Description of Artificial Sequence: Synthetic oligonucleotide
  Description of Combined DNA/RNA Molecule: Synthetic oligonucleotide
tuuggugcgcuccagcucctu

SEQ ID NO: 668 - DNA, 21 bp, Artificial Sequence
  Description of Artificial Sequence: Synthetic oligonucleotide
  Description of Combined DNA/RNA Molecule: Synthetic oligonucleotide
tuuggugcgcuccagcucctu

SEQ ID NO: 669 - DNA, 21 bp, Artificial Sequence
  Description of Artificial Sequence: Synthetic oligonucleotide
  Description of Combined DNA/RNA Molecule: Synthetic oligonucleotide
tcccgagccuugaucuccatu

SEQ ID NO: 670 - DNA, 21 bp, Artificial Sequence
  Description of Artificial Sequence: Synthetic oligonucleotide
  Description of Combined DNA/RNA Molecule: Synthetic oligonucleotide
tcccgagccuugaucuccatu

SEQ ID NO: 671 - DNA, 21 bp, Artificial Sequence
  Description of Artificial Sequence: Synthetic oligonucleotide
  Description of Combined DNA/RNA Molecule: Synthetic oligonucleotide
tcugggccaggcccgggugtu

SEQ ID NO: 672 - DNA, 21 bp, Artificial Sequence
  Description of Artificial Sequence: Synthetic oligonucleotide
  Description of Combined DNA/RNA Molecule: Synthetic oligonucleotide
tcugggccaggcccgggugtu

SEQ ID NO: 673 - DNA, 21 bp, Artificial Sequence
  Description of Artificial Sequence: Synthetic oligonucleotide
  Description of Combined DNA/RNA Molecule: Synthetic oligonucleotide
tggugcgcuccagcucccatu

SEQ ID NO: 674 - DNA, 21 bp, Artificial Sequence
  Description of Artificial Sequence: Synthetic oligonucleotide
  Description of Combined DNA/RNA Molecule: Synthetic oligonucleotide
tuggugcgcuccagcuccctu

SEQ ID NO: 675 - DNA, 21 bp, Artificial Sequence
  Description of Artificial Sequence: Synthetic oligonucleotide
  Description of Combined DNA/RNA Molecule: Synthetic oligonucleotide
tuuggugcgcuccagcucctu

SEQ ID NO: 676 - DNA, 21 bp, Artificial Sequence
  Description of Artificial Sequence: Synthetic oligonucleotide
  Description of Combined DNA/RNA Molecule: Synthetic oligonucleotide
tcccgagccuugaucuccatu

SEQ ID NO: 677 - DNA, 21 bp, Artificial Sequence
  Description of Artificial Sequence: Synthetic oligonucleotide
  Description of Combined DNA/RNA Molecule: Synthetic oligonucleotide
tcugggccaggcccgggugtu

SEQ ID NO: 678 - DNA, 21 bp, Artificial Sequence
  Description of Artificial Sequence: Synthetic oligonucleotide
  Description of Combined DNA/RNA Molecule: Synthetic oligonucleotide
tccccgagccuugaucucctu

SEQ ID NO: 679 - DNA, 21 bp, Artificial Sequence
  Description of Artificial Sequence: Synthetic oligonucleotide
  Description of Combined DNA/RNA Molecule: Synthetic oligonucleotide
tccccgagccuugaucucctu

SEQ ID NO: 680 - DNA, 21 bp, Artificial Sequence
  Description of Artificial Sequence: Synthetic oligonucleotide
  Description of Combined DNA/RNA Molecule: Synthetic oligonucleotide
tccccgagccuugaucucctu

SEQ ID NO: 681 - DNA, 21 bp, Artificial Sequence
  Description of Artificial Sequence: Synthetic oligonucleotide
  Description of Combined DNA/RNA Molecule: Synthetic oligonucleotide
tggagguuucccuggcucatu

SEQ ID NO: 682 - DNA, 21 bp, Artificial Sequence
  Description of Artificial Sequence: Synthetic oligonucleotide
  Description of Combined DNA/RNA Molecule: Synthetic oligonucleotide
tggagguuucccuggcucatu

SEQ ID NO: 683 - DNA, 21 bp, Artificial Sequence
  Description of Artificial Sequence: Synthetic oligonucleotide
  Description of Combined DNA/RNA Molecule: Synthetic oligonucleotide
tuggagguuucccuggcuctu

SEQ ID NO: 684 - DNA, 21 bp, Artificial Sequence
  Description of Artificial Sequence: Synthetic oligonucleotide
  Description of Combined DNA/RNA Molecule: Synthetic oligonucleotide
tuggagguuucccuggcuctu

SEQ ID NO: 685 - DNA, 21 bp, Artificial Sequence
  Description of Artificial Sequence: Synthetic oligonucleotide
  Description of Combined DNA/RNA Molecule: Synthetic oligonucleotide
tgacacccgcuccuccacatu

SEQ ID NO: 686 - DNA, 21 bp, Artificial Sequence
  Description of Artificial Sequence: Synthetic oligonucleotide
  Description of Combined DNA/RNA Molecule: Synthetic oligonucleotide
tgacacccgcuccuccacatu

SEQ ID NO: 687 - DNA, 21 bp, Artificial Sequence
  Description of Artificial Sequence: Synthetic oligonucleotide
  Description of Combined DNA/RNA Molecule: Synthetic oligonucleotide
tggacacccgcuccuccactu

SEQ ID NO: 688 - DNA, 21 bp, Artificial Sequence
  Description of Artificial Sequence: Synthetic oligonucleotide
  Description of Combined DNA/RNA Molecule: Synthetic oligonucleotide
tggacacccgcuccuccactu

SEQ ID NO: 689 - DNA, 21 bp, Artificial Sequence
  Description of Artificial Sequence: Synthetic oligonucleotide
  Description of Combined DNA/RNA Molecule: Synthetic oligonucleotide
tccagcuccucguagucgctu

SEQ ID NO: 690 - DNA, 21 bp, Artificial Sequence
  Description of Artificial Sequence: Synthetic oligonucleotide
  Description of Combined DNA/RNA Molecule: Synthetic oligonucleotide
tcggccaggccguccuccutu

SEQ ID NO: 691 - DNA, 21 bp, Artificial Sequence
  Description of Artificial Sequence: Synthetic oligonucleotide
  Description of Combined DNA/RNA Molecule: Synthetic oligonucleotide
tcuccuccuucagcaccactu

SEQ ID NO: 692 - DNA, 21 bp, Artificial Sequence
  Description of Artificial Sequence: Synthetic oligonucleotide
  Description of Combined DNA/RNA Molecule: Synthetic oligonucleotide
tgugggucuccuccuucagtu

SEQ ID NO: 693 - DNA, 21 bp, Artificial Sequence
  Description of Artificial Sequence: Synthetic oligonucleotide
  Description of Combined DNA/RNA Molecule: Synthetic oligonucleotide
tgcgggcagugcgcucugatu

SEQ ID NO: 694 - DNA, 21 bp, Artificial Sequence
  Description of Artificial Sequence: Synthetic oligonucleotide
  Description of Combined DNA/RNA Molecule: Synthetic oligonucleotide
tgguauccccggcgggcagtu

SEQ ID NO: 695 - DNA, 21 bp, Artificial Sequence
  Description of Artificial Sequence: Synthetic oligonucleotide
  Description of Combined DNA/RNA Molecule: Synthetic oligonucleotide
tcuccagcaggucgccacutu

SEQ ID NO: 696 - DNA, 21 bp, Artificial Sequence
  Description of Artificial Sequence: Synthetic oligonucleotide
  Description of Combined DNA/RNA Molecule: Synthetic oligonucleotide
tgccagcuccagcaggucgtu

SEQ ID NO: 697 - DNA, 21 bp, Artificial Sequence
  Description of Artificial Sequence: Synthetic oligonucleotide
  Description of Combined DNA/RNA Molecule: Synthetic oligonucleotide
tcccguccuccucgggcactu

SEQ ID NO: 698 - DNA, 21 bp, Artificial Sequence
  Description of Artificial Sequence: Synthetic oligonucleotide
  Description of Combined DNA/RNA Molecule: Synthetic oligonucleotide
tccaccccugccaggugggtu

SEQ ID NO: 699 - DNA, 21 bp, Artificial Sequence
  Description of Artificial Sequence: Synthetic oligonucleotide
  Description of Combined DNA/RNA Molecule: Synthetic oligonucleotide
tggccgcugaccaccccugtu

SEQ ID NO: 700 - DNA, 21 bp, Artificial Sequence
  Description of Artificial Sequence: Synthetic oligonucleotide
  Description of Combined DNA/RNA Molecule: Synthetic oligonucleotide
tccggccgcugaccacccctu

SEQ ID NO: 701 - DNA, 21 bp, Artificial Sequence
  Description of Artificial Sequence: Synthetic oligonucleotide
  Description of Combined DNA/RNA Molecule: Synthetic oligonucleotide
tcaucccggccgcugaccatu

SEQ ID NO: 702 - DNA, 21 bp, Artificial Sequence
  Description of Artificial Sequence: Synthetic oligonucleotide
  Description of Combined DNA/RNA Molecule: Synthetic oligonucleotide
tuuggccacgccggcaucctu

SEQ ID NO: 703 - DNA, 21 bp, Artificial Sequence
  Description of Artificial Sequence: Synthetic oligonucleotide
  Description of Combined DNA/RNA Molecule: Synthetic oligonucleotide
tcccuucccuuggcaguugtu

SEQ ID NO: 704 - DNA, 21 bp, Artificial Sequence
  Description of Artificial Sequence: Synthetic oligonucleotide
  Description of Combined DNA/RNA Molecule: Synthetic oligonucleotide
tugcccuucccuuggcagutu

SEQ ID NO: 705 - DNA, 21 bp, Artificial Sequence
  Description of Artificial Sequence: Synthetic oligonucleotide
  Description of Combined DNA/RNA Molecule: Synthetic oligonucleotide
tcccagcccucgccaggcgtu

SEQ ID NO: 706 - DNA, 21 bp, Artificial Sequence
  Description of Artificial Sequence: Synthetic oligonucleotide
  Description of Combined DNA/RNA Molecule: Synthetic oligonucleotide
tgaccccagcccucgccagtu

SEQ ID NO: 707 - DNA, 21 bp, Artificial Sequence
  Description of Artificial Sequence: Synthetic oligonucleotide
  Description of Combined DNA/RNA Molecule: Synthetic oligonucleotide
tccggcagcggugaccagctu

SEQ ID NO: 708 - DNA, 21 bp, Artificial Sequence
  Description of Artificial Sequence: Synthetic oligonucleotide
  Description of Combined DNA/RNA Molecule: Synthetic oligonucleotide
tagcagcucagcagcuccutu

SEQ ID NO: 709 - DNA, 21 bp, Artificial Sequence
  Description of Artificial Sequence: Synthetic oligonucleotide
  Description of Combined DNA/RNA Molecule: Synthetic oligonucleotide
tagacacccucacccccaatu

SEQ ID NO: 710 - DNA, 21 bp, Artificial Sequence
  Description of Artificial Sequence: Synthetic oligonucleotide
  Description of Combined DNA/RNA Molecule: Synthetic oligonucleotide
tcguagacacccucacccctu

SEQ ID NO: 711 - DNA, 21 bp, Artificial Sequence
  Description of Artificial Sequence: Synthetic oligonucleotide
  Description of Combined DNA/RNA Molecule: Synthetic oligonucleotide
tgguagcaggcagcaccugtu

SEQ ID NO: 712 - DNA, 21 bp, Artificial Sequence
  Description of Artificial Sequence: Synthetic oligonucleotide
  Description of Combined DNA/RNA Molecule: Synthetic oligonucleotide
tgcaguggacacggguccctu

SEQ ID NO: 713 - DNA, 21 bp, Artificial Sequence
  Description of Artificial Sequence: Synthetic oligonucleotide
  Description of Combined DNA/RNA Molecule: Synthetic oligonucleotide
tggugccaagguccuccactu

SEQ ID NO: 714 - DNA, 21 bp, Artificial Sequence
  Description of Artificial Sequence: Synthetic oligonucleotide
  Description of Combined DNA/RNA Molecule: Synthetic oligonucleotide
taggcggcuugugggugcctu

SEQ ID NO: 715 - DNA, 21 bp, Artificial Sequence
  Description of Artificial Sequence: Synthetic oligonucleotide
  Description of Combined DNA/RNA Molecule: Synthetic oligonucleotide
tugcugacgucccggcucctu

SEQ ID NO: 716 - DNA, 21 bp, Artificial Sequence
  Description of Artificial Sequence: Synthetic oligonucleotide
  Description of Combined DNA/RNA Molecule: Synthetic oligonucleotide
tgcuccggcagcagauggctu

SEQ ID NO: 717 - DNA, 21 bp, Artificial Sequence
  Description of Artificial Sequence: Synthetic oligonucleotide
  Description of Combined DNA/RNA Molecule: Synthetic oligonucleotide
tcccacucaagggccaggctu

SEQ ID NO: 718 - DNA, 21 bp, Artificial Sequence
  Description of Artificial Sequence: Synthetic oligonucleotide
  Description of Combined DNA/RNA Molecule: Synthetic oligonucleotide
tggucuguguuccccuucctu

SEQ ID NO: 719 - DNA, 21 bp, Artificial Sequence
  Description of Artificial Sequence: Synthetic oligonucleotide
  Description of Combined DNA/RNA Molecule: Synthetic oligonucleotide
tuccucguccuccugcgcatu

SEQ ID NO: 720 - DNA, 21 bp, Artificial Sequence
  Description of Artificial Sequence: Synthetic oligonucleotide
  Description of Combined DNA/RNA Molecule: Synthetic oligonucleotide
tgcuagcaccagcuccucgtu

SEQ ID NO: 721 - DNA, 21 bp, Artificial Sequence
  Description of Artificial Sequence: Synthetic oligonucleotide
  Description of Combined DNA/RNA Molecule: Synthetic oligonucleotide
tgugagguauccccggcggtu

SEQ ID NO: 722 - DNA, 21 bp, Artificial Sequence
  Description of Artificial Sequence: Synthetic oligonucleotide
  Description of Combined DNA/RNA Molecule: Synthetic oligonucleotide
tcccucgauuucccgguggtu

SEQ ID NO: 723 - DNA, 21 bp, Artificial Sequence
  Description of Artificial Sequence: Synthetic oligonucleotide
  Description of Combined DNA/RNA Molecule: Synthetic oligonucleotide
tuggaagcgggucccgucctu

SEQ ID NO: 724 - DNA, 21 bp, Artificial Sequence
  Description of Artificial Sequence: Synthetic oligonucleotide
  Description of Combined DNA/RNA Molecule: Synthetic oligonucleotide
taccccugccaggugggugtu

SEQ ID NO: 725 - DNA, 21 bp, Artificial Sequence
  Description of Artificial Sequence: Synthetic oligonucleotide
  Description of Combined DNA/RNA Molecule: Synthetic oligonucleotide
tcuccggcucggcagacagtu

SEQ ID NO: 726 - DNA, 21 bp, Artificial Sequence
  Description of Artificial Sequence: Synthetic oligonucleotide
  Description of Combined DNA/RNA Molecule: Synthetic oligonucleotide
tggucaguacccgcugguctu

SEQ ID NO: 727 - DNA, 21 bp, Artificial Sequence
  Description of Artificial Sequence: Synthetic oligonucleotide
  Description of Combined DNA/RNA Molecule: Synthetic oligonucleotide
tccgcuucccacuccuggatu

SEQ ID NO: 728 - DNA, 21 bp, Artificial Sequence
  Description of Artificial Sequence: Synthetic oligonucleotide
  Description of Combined DNA/RNA Molecule: Synthetic oligonucleotide
tcguugugggcccggcagatu

SEQ ID NO: 729 - DNA, 21 bp, Artificial Sequence
  Description of Artificial Sequence: Synthetic oligonucleotide
  Description of Combined DNA/RNA Molecule: Synthetic oligonucleotide
tacggguccccaugcuggctu

SEQ ID NO: 730 - DNA, 21 bp, Artificial Sequence
  Description of Artificial Sequence: Synthetic oligonucleotide
  Description of Combined DNA/RNA Molecule: Synthetic oligonucleotide
tggccucagcacaggcggctu

SEQ ID NO: 731 - DNA, 21 bp, Artificial Sequence
  Description of Artificial Sequence: Synthetic oligonucleotide
  Description of Combined DNA/RNA Molecule: Synthetic oligonucleotide
tggccgggauuccaugcuctu

SEQ ID NO: 732 - DNA, 21 bp, Artificial Sequence
  Description of Artificial Sequence: Synthetic oligonucleotide
  Description of Combined DNA/RNA Molecule: Synthetic oligonucleotide
tcugacgucccggcuccugtu

SEQ ID NO: 733 - DNA, 21 bp, Artificial Sequence
  Description of Artificial Sequence: Synthetic oligonucleotide
  Description of Combined DNA/RNA Molecule: Synthetic oligonucleotide
tgggagcagcuggcagcactu

SEQ ID NO: 734 - DNA, 21 bp, Artificial Sequence
  Description of Artificial Sequence: Synthetic oligonucleotide
  Description of Combined DNA/RNA Molecule: Synthetic oligonucleotide
tucuguguuccccuucccatu

SEQ ID NO: 735 - DNA, 21 bp, Artificial Sequence
  Description of Artificial Sequence: Synthetic oligonucleotide
  Description of Combined DNA/RNA Molecule: Synthetic oligonucleotide
tccaccagagccccaucggtu

SEQ ID NO: 736 - DNA, 21 bp, Artificial Sequence
  Description of Artificial Sequence: Synthetic oligonucleotide
  Description of Combined DNA/RNA Molecule: Synthetic oligonucleotide
taccuccaccaggcugccutu

SEQ ID NO: 737 - DNA, 21 bp, Artificial Sequence
  Description of Artificial Sequence: Synthetic oligonucleotide
  Description of Combined DNA/RNA Molecule: Synthetic oligonucleotide
tagcgggucccguccuccutu

SEQ ID NO: 738 - DNA, 21 bp, Artificial Sequence
  Description of Artificial Sequence: Synthetic oligonucleotide
  Description of Combined DNA/RNA Molecule: Synthetic oligonucleotide
tcugaccaccccugccaggtu

SEQ ID NO: 739 - DNA, 21 bp, Artificial Sequence
  Description of Artificial Sequence: Synthetic oligonucleotide
  Description of Combined DNA/RNA Molecule: Synthetic oligonucleotide
tcgcugaccaccccugccatu

SEQ ID NO: 740 - DNA, 21 bp, Artificial Sequence
  Description of Artificial Sequence: Synthetic oligonucleotide
  Description of Combined DNA/RNA Molecule: Synthetic oligonucleotide
tucccggccgcugaccacctu

SEQ ID NO: 741 - DNA, 21 bp, Artificial Sequence
  Description of Artificial Sequence: Synthetic oligonucleotide
  Description of Combined DNA/RNA Molecule: Synthetic oligonucleotide
tggccuaugagggugccgctu

SEQ ID NO: 742 - DNA, 21 bp, Artificial Sequence
  Description of Artificial Sequence: Synthetic oligonucleotide
  Description of Combined DNA/RNA Molecule: Synthetic oligonucleotide
tcaggccuaugagggugcctu

SEQ ID NO: 743 - DNA, 21 bp, Artificial Sequence
  Description of Artificial Sequence: Synthetic oligonucleotide
  Description of Combined DNA/RNA Molecule: Synthetic oligonucleotide
tuccaggccuaugagggugtu

SEQ ID NO: 744 - DNA, 21 bp, Artificial Sequence
  Description of Artificial Sequence: Synthetic oligonucleotide
  Description of Combined DNA/RNA Molecule: Synthetic oligonucleotide
tagcccucgccaggcgcugtu

SEQ ID NO: 745 - DNA, 21 bp, Artificial Sequence
  Description of Artificial Sequence: Synthetic oligonucleotide
  Description of Combined DNA/RNA Molecule: Synthetic oligonucleotide
tcacgaccccagcccucgctu

SEQ ID NO: 746 - DNA, 21 bp, Artificial Sequence
  Description of Artificial Sequence: Synthetic oligonucleotide
  Description of Combined DNA/RNA Molecule: Synthetic oligonucleotide
tccagcacgaccccagccctu

SEQ ID NO: 747 - DNA, 21 bp, Artificial Sequence
  Description of Artificial Sequence: Synthetic oligonucleotide
  Description of Combined DNA/RNA Molecule: Synthetic oligonucleotide
tccagggucaccggcuggutu

SEQ ID NO: 748 - DNA, 21 bp, Artificial Sequence
  Description of Artificial Sequence: Synthetic oligonucleotide
  Description of Combined DNA/RNA Molecule: Synthetic oligonucleotide
tccccagggucaccggcugtu

SEQ ID NO: 749 - DNA, 21 bp, Artificial Sequence
  Description of Artificial Sequence: Synthetic oligonucleotide
  Description of Combined DNA/RNA Molecule: Synthetic oligonucleotide
tguccccagggucaccggctu

SEQ ID NO: 750 - DNA, 21 bp, Artificial Sequence
  Description of Artificial Sequence: Synthetic oligonucleotide
  Description of Combined DNA/RNA Molecule: Synthetic oligonucleotide
tgggcggccaccagguuggtu

SEQ ID NO: 751 - DNA, 21 bp, Artificial Sequence
  Description of Artificial Sequence: Synthetic oligonucleotide
  Description of Combined DNA/RNA Molecule: Synthetic oligonucleotide
tgcagggcggccaccaggutu

SEQ ID NO: 752 - DNA, 21 bp, Artificial Sequence
  Description of Artificial Sequence: Synthetic oligonucleotide
  Description of Combined DNA/RNA Molecule: Synthetic oligonucleotide
tuggagcagcucagcagcutu

SEQ ID NO: 753 - DNA, 21 bp, Artificial Sequence
  Description of Artificial Sequence: Synthetic oligonucleotide
  Description of Combined DNA/RNA Molecule: Synthetic oligonucleotide
tccgccgcuucccacuccutu

SEQ ID NO: 754 - DNA, 21 bp, Artificial Sequence
  Description of Artificial Sequence: Synthetic oligonucleotide
  Description of Combined DNA/RNA Molecule: Synthetic oligonucleotide
tccccgccgcuucccacuctu

SEQ ID NO: 755 - DNA, 21 bp, Artificial Sequence
  Description of Artificial Sequence: Synthetic oligonucleotide
  Description of Combined DNA/RNA Molecule: Synthetic oligonucleotide
tccugugaggacguggccctu

SEQ ID NO: 756 - DNA, 21 bp, Artificial Sequence
  Description of Artificial Sequence: Synthetic oligonucleotide
  Description of Combined DNA/RNA Molecule: Synthetic oligonucleotide
tagguccuccaccucccagtu

SEQ ID NO: 757 - DNA, 21 bp, Artificial Sequence
  Description of Artificial Sequence: Synthetic oligonucleotide
  Description of Combined DNA/RNA Molecule: Synthetic oligonucleotide
tccaagguccuccaccucctu

SEQ ID NO: 758 - DNA, 21 bp, Artificial Sequence
  Description of Artificial Sequence: Synthetic oligonucleotide
  Description of Combined DNA/RNA Molecule: Synthetic oligonucleotide
tgugggugccaagguccuctu

SEQ ID NO: 759 - DNA, 21 bp, Artificial Sequence
  Description of Artificial Sequence: Synthetic oligonucleotide
  Description of Combined DNA/RNA Molecule: Synthetic oligonucleotide
tcugaccucguggccucagtu

SEQ ID NO: 760 - DNA, 21 bp, Artificial Sequence
  Description of Artificial Sequence: Synthetic oligonucleotide
  Description of Combined DNA/RNA Molecule: Synthetic oligonucleotide
tggcugaccucguggccuctu

SEQ ID NO: 761 - DNA, 21 bp, Artificial Sequence
  Description of Artificial Sequence: Synthetic oligonucleotide
  Description of Combined DNA/RNA Molecule: Synthetic oligonucleotide
tuugggcugaccucguggctu

SEQ ID NO: 762 - DNA, 21 bp, Artificial Sequence
  Description of Artificial Sequence: Synthetic oligonucleotide
  Description of Combined DNA/RNA Molecule: Synthetic oligonucleotide
tgcuggccucccuguggcctu

SEQ ID NO: 763 - DNA, 21 bp, Artificial Sequence
  Description of Artificial Sequence: Synthetic oligonucleotide
  Description of Combined DNA/RNA Molecule: Synthetic oligonucleotide
taugcuggccucccuguggtu

SEQ ID NO: 764 - DNA, 21 bp, Artificial Sequence
  Description of Artificial Sequence: Synthetic oligonucleotide
  Description of Combined DNA/RNA Molecule: Synthetic oligonucleotide
tuggaugcuggccucccugtu

SEQ ID NO: 765 - DNA, 21 bp, Artificial Sequence
  Description of Artificial Sequence: Synthetic oligonucleotide
  Description of Combined DNA/RNA Molecule: Synthetic oligonucleotide
tgcguggaugcuggccucctu

SEQ ID NO: 766 - DNA, 21 bp, Artificial Sequence
  Description of Artificial Sequence: Synthetic oligonucleotide
  Description of Combined DNA/RNA Molecule: Synthetic oligonucleotide
tgccgggauuccaugcucctu

SEQ ID NO: 767 - DNA, 21 bp, Artificial Sequence
  Description of Artificial Sequence: Synthetic oligonucleotide
  Description of Combined DNA/RNA Molecule: Synthetic oligonucleotide
taggucccagggagggcactu

SEQ ID NO: 768 - DNA, 21 bp, Artificial Sequence
  Description of Artificial Sequence: Synthetic oligonucleotide
  Description of Combined DNA/RNA Molecule: Synthetic oligonucleotide
tggaggucccagggagggctu

SEQ ID NO: 769 - DNA, 21 bp, Artificial Sequence
  Description of Artificial Sequence: Synthetic oligonucleotide
  Description of Combined DNA/RNA Molecule: Synthetic oligonucleotide
tcggcuccggcagcagaugtu

SEQ ID NO: 770 - DNA, 21 bp, Artificial Sequence
  Description of Artificial Sequence: Synthetic oligonucleotide
  Description of Combined DNA/RNA Molecule: Synthetic oligonucleotide
tcaagggccaggccagcagtu

SEQ ID NO: 771 - DNA, 21 bp, Artificial Sequence
  Description of Artificial Sequence: Synthetic oligonucleotide
  Description of Combined DNA/RNA Molecule: Synthetic oligonucleotide
tagggagcuuccuggcacctu

SEQ ID NO: 772 - DNA, 21 bp, Artificial Sequence
  Description of Artificial Sequence: Synthetic oligonucleotide
  Description of Combined DNA/RNA Molecule: Synthetic oligonucleotide
tccuucccagccucacugutu

SEQ ID NO: 773 - DNA, 21 bp, Artificial Sequence
  Description of Artificial Sequence: Synthetic oligonucleotide
  Description of Combined DNA/RNA Molecule: Synthetic oligonucleotide
tcuggucuguguuccccuutu

SEQ ID NO: 774 - DNA, 21 bp, Artificial Sequence
  Description of Artificial Sequence: Synthetic oligonucleotide
  Description of Combined DNA/RNA Molecule: Synthetic oligonucleotide
tcuuccuggucuguguucctu

SEQ ID NO: 775 - DNA, 23 bp, Artificial Sequence
  Description of Artificial Sequence: Synthetic oligonucleotide
  Description of Combined DNA/RNA Molecule: Synthetic oligonucleotide
tccagcuccucguagucgccgtu

SEQ ID NO: 776 - DNA, 23 bp, Artificial Sequence
  Description of Artificial Sequence: Synthetic oligonucleotide
  Description of Combined DNA/RNA Molecule: Synthetic oligonucleotide
tcggccaggccguccuccucgtu

SEQ ID NO: 777 - DNA, 23 bp, Artificial Sequence
  Description of Artificial Sequence: Synthetic oligonucleotide
  Description of Combined DNA/RNA Molecule: Synthetic oligonucleotide
tcuccuccuucagcaccaccatu

SEQ ID NO: 778 - DNA, 23 bp, Artificial Sequence
  Description of Artificial Sequence: Synthetic oligonucleotide
  Description of Combined DNA/RNA Molecule: Synthetic oligonucleotide
tgugggucuccuccuucagcatu

SEQ ID NO: 779 - DNA, 23 bp, Artificial Sequence
  Description of Artificial Sequence: Synthetic oligonucleotide
  Description of Combined DNA/RNA Molecule: Synthetic oligonucleotide
tgcgggcagugcgcucugacutu

SEQ ID NO: 780 - DNA, 23 bp, Artificial Sequence
  Description of Artificial Sequence: Synthetic oligonucleotide
  Description of Combined DNA/RNA Molecule: Synthetic oligonucleotide
tgguauccccggcgggcagcctu

SEQ ID NO: 781 - DNA, 23 bp, Artificial Sequence
  Description of Artificial Sequence: Synthetic oligonucleotide
  Description of Combined DNA/RNA Molecule: Synthetic oligonucleotide
tcuccagcaggucgccacucatu

SEQ ID NO: 782 - DNA, 23 bp, Artificial Sequence
  Description of Artificial Sequence: Synthetic oligonucleotide
  Description of Combined DNA/RNA Molecule: Synthetic oligonucleotide
tgccagcuccagcaggucgcctu

SEQ ID NO: 783 - DNA, 23 bp, Artificial Sequence
  Description of Artificial Sequence: Synthetic oligonucleotide
  Description of Combined DNA/RNA Molecule: Synthetic oligonucleotide
tcccguccuccucgggcacautu

SEQ ID NO: 784 - DNA, 23 bp, Artificial Sequence
  Description of Artificial Sequence: Synthetic oligonucleotide
  Description of Combined DNA/RNA Molecule: Synthetic oligonucleotide
tccaccccugccaggugggugtu

SEQ ID NO: 785 - DNA, 23 bp, Artificial Sequence
  Description of Artificial Sequence: Synthetic oligonucleotide
  Description of Combined DNA/RNA Molecule: Synthetic oligonucleotide
tggccgcugaccaccccugcctu

SEQ ID NO: 786 - DNA, 23 bp, Artificial Sequence
  Description of Artificial Sequence: Synthetic oligonucleotide
  Description of Combined DNA/RNA Molecule: Synthetic oligonucleotide
tccggccgcugaccaccccugtu

SEQ ID NO: 787 - DNA, 23 bp, Artificial Sequence
  Description of Artificial Sequence: Synthetic oligonucleotide
  Description of Combined DNA/RNA Molecule: Synthetic oligonucleotide
tcaucccggccgcugaccacctu

SEQ ID NO: 788 - DNA, 23 bp, Artificial Sequence
  Description of Artificial Sequence: Synthetic oligonucleotide
  Description of Combined DNA/RNA Molecule: Synthetic oligonucleotide
tuuggccacgccggcaucccgtu

SEQ ID NO: 789 - DNA, 23 bp, Artificial Sequence
  Description of Artificial Sequence: Synthetic oligonucleotide
  Description of Combined DNA/RNA Molecule: Synthetic oligonucleotide
tcccuucccuuggcaguugagtu

SEQ ID NO: 790 - DNA, 23 bp, Artificial Sequence
  Description of Artificial Sequence: Synthetic oligonucleotide
  Description of Combined DNA/RNA Molecule: Synthetic oligonucleotide
tugcccuucccuuggcaguugtu

SEQ ID NO: 791 - DNA, 23 bp, Artificial Sequence
  Description of Artificial Sequence: Synthetic oligonucleotide
  Description of Combined DNA/RNA Molecule: Synthetic oligonucleotide
tcccagcccucgccaggcgcutu

SEQ ID NO: 792 - DNA, 23 bp, Artificial Sequence
  Description of Artificial Sequence: Synthetic oligonucleotide
  Description of Combined DNA/RNA Molecule: Synthetic oligonucleotide
tgaccccagcccucgccaggctu

SEQ ID NO: 793 - DNA, 23 bp, Artificial Sequence
  Description of Artificial Sequence: Synthetic oligonucleotide
  Description of Combined DNA/RNA Molecule: Synthetic oligonucleotide
tccggcagcggugaccagcactu

SEQ ID NO: 794 - DNA, 23 bp, Artificial Sequence
  Description of Artificial Sequence: Synthetic oligonucleotide
  Description of Combined DNA/RNA Molecule: Synthetic oligonucleotide
tagcagcucagcagcuccucatu

SEQ ID NO: 795 - DNA, 23 bp, Artificial Sequence
  Description of Artificial Sequence: Synthetic oligonucleotide
  Description of Combined DNA/RNA Molecule: Synthetic oligonucleotide
tagacacccucacccccaaaatu

SEQ ID NO: 796 - DNA, 23 bp, Artificial Sequence
  Description of Artificial Sequence: Synthetic oligonucleotide
  Description of Combined DNA/RNA Molecule: Synthetic oligonucleotide
tcguagacacccucacccccatu

SEQ ID NO: 797 - DNA, 23 bp, Artificial Sequence
  Description of Artificial Sequence: Synthetic oligonucleotide
  Description of Combined DNA/RNA Molecule: Synthetic oligonucleotide
tgguagcaggcagcaccuggctu

SEQ ID NO: 798 - DNA, 23 bp, Artificial Sequence
  Description of Artificial Sequence: Synthetic oligonucleotide
  Description of Combined DNA/RNA Molecule: Synthetic oligonucleotide
tgcaguggacacggguccccatu

SEQ ID NO: 799 - DNA, 23 bp, Artificial Sequence
  Description of Artificial Sequence: Synthetic oligonucleotide
  Description of Combined DNA/RNA Molecule: Synthetic oligonucleotide
tggugccaagguccuccaccutu

SEQ ID NO: 800 - DNA, 23 bp, Artificial Sequence
  Description of Artificial Sequence: Synthetic oligonucleotide
  Description of Combined DNA/RNA Molecule: Synthetic oligonucleotide
taggcggcuugugggugccaatu

SEQ ID NO: 801 - DNA, 23 bp, Artificial Sequence
  Description of Artificial Sequence: Synthetic oligonucleotide
  Description of Combined DNA/RNA Molecule: Synthetic oligonucleotide
tugcugacgucccggcuccugtu

SEQ ID NO: 802 - DNA, 23 bp, Artificial Sequence
  Description of Artificial Sequence: Synthetic oligonucleotide
  Description of Combined DNA/RNA Molecule: Synthetic oligonucleotide
tgcuccggcagcagauggcaatu

SEQ ID NO: 803 - DNA, 23 bp, Artificial Sequence
  Description of Artificial Sequence: Synthetic oligonucleotide
  Description of Combined DNA/RNA Molecule: Synthetic oligonucleotide
tcccacucaagggccaggccatu

SEQ ID NO: 804 - DNA, 23 bp, Artificial Sequence
  Description of Artificial Sequence: Synthetic oligonucleotide
  Description of Combined DNA/RNA Molecule: Synthetic oligonucleotide
tggucuguguuccccuucccatu

SEQ ID NO: 805 - DNA, 23 bp, Artificial Sequence
  Description of Artificial Sequence: Synthetic oligonucleotide
  Description of Combined DNA/RNA Molecule: Synthetic oligonucleotide
tuccucguccuccugcgcacgtu

SEQ ID NO: 806 - DNA, 23 bp, Artificial Sequence
  Description of Artificial Sequence: Synthetic oligonucleotide
  Description of Combined DNA/RNA Molecule: Synthetic oligonucleotide
tgcuagcaccagcuccucguatu

SEQ ID NO: 807 - DNA, 23 bp, Artificial Sequence
  Description of Artificial Sequence: Synthetic oligonucleotide
  Description of Combined DNA/RNA Molecule: Synthetic oligonucleotide
tgugagguauccccggcgggctu

SEQ ID NO: 808 - DNA, 23 bp, Artificial Sequence
  Description of Artificial Sequence: Synthetic oligonucleotide
  Description of Combined DNA/RNA Molecule: Synthetic oligonucleotide
tcccucgauuucccggugguctu

SEQ ID NO: 809 - DNA, 23 bp, Artificial Sequence
  Description of Artificial Sequence: Synthetic oligonucleotide
  Description of Combined DNA/RNA Molecule: Synthetic oligonucleotide
tuggaagcgggucccguccuctu

SEQ ID NO: 810 - DNA, 23 bp, Artificial Sequence
  Description of Artificial Sequence: Synthetic oligonucleotide
  Description of Combined DNA/RNA Molecule: Synthetic oligonucleotide
taccccugccaggugggugcctu

SEQ ID NO: 811 - DNA, 23 bp, Artificial Sequence
  Description of Artificial Sequence: Synthetic oligonucleotide
  Description of Combined DNA/RNA Molecule: Synthetic oligonucleotide
tcuccggcucggcagacagcatu

SEQ ID NO: 812 - DNA, 23 bp, Artificial Sequence
  Description of Artificial Sequence: Synthetic oligonucleotide
  Description of Combined DNA/RNA Molecule: Synthetic oligonucleotide
tggucaguacccgcugguccutu

SEQ ID NO: 813 - DNA, 23 bp, Artificial Sequence
  Description of Artificial Sequence: Synthetic oligonucleotide
  Description of Combined DNA/RNA Molecule: Synthetic oligonucleotide
tccgcuucccacuccuggagatu

SEQ ID NO: 814 - DNA, 23 bp, Artificial Sequence
  Description of Artificial Sequence: Synthetic oligonucleotide
  Description of Combined DNA/RNA Molecule: Synthetic oligonucleotide
tcguugugggcccggcagacctu

SEQ ID NO: 815 - DNA, 23 bp, Artificial Sequence
  Description of Artificial Sequence: Synthetic oligonucleotide
  Description of Combined DNA/RNA Molecule: Synthetic oligonucleotide
tacggguccccaugcuggccutu

SEQ ID NO: 816 - DNA, 23 bp, Artificial Sequence
  Description of Artificial Sequence: Synthetic oligonucleotide
  Description of Combined DNA/RNA Molecule: Synthetic oligonucleotide
tggccucagcacaggcggcuutu

SEQ ID NO: 817 - DNA, 23 bp, Artificial Sequence
  Description of Artificial Sequence: Synthetic oligonucleotide
  Description of Combined DNA/RNA Molecule: Synthetic oligonucleotide
tggccgggauuccaugcuccutu

SEQ ID NO: 818 - DNA, 23 bp, Artificial Sequence
  Description of Artificial Sequence: Synthetic oligonucleotide
  Description of Combined DNA/RNA Molecule: Synthetic oligonucleotide
tcugacgucccggcuccugactu

SEQ ID NO: 819 - DNA, 23 bp, Artificial Sequence
  Description of Artificial Sequence: Synthetic oligonucleotide
  Description of Combined DNA/RNA Molecule: Synthetic oligonucleotide
tgggagcagcuggcagcaccctu

SEQ ID NO: 820 - DNA, 23 bp, Artificial Sequence
  Description of Artificial Sequence: Synthetic oligonucleotide
  Description of Combined DNA/RNA Molecule: Synthetic oligonucleotide
tucuguguuccccuucccagctu

SEQ ID NO: 821 - DNA, 23 bp, Artificial Sequence
  Description of Artificial Sequence: Synthetic oligonucleotide
  Description of Combined DNA/RNA Molecule: Synthetic oligonucleotide
tccaccagagccccaucggactu

SEQ ID NO: 822 - DNA, 23 bp, Artificial Sequence
  Description of Artificial Sequence: Synthetic oligonucleotide
  Description of Combined DNA/RNA Molecule: Synthetic oligonucleotide
taccuccaccaggcugccucctu

SEQ ID NO: 823 - DNA, 23 bp, Artificial Sequence
  Description of Artificial Sequence: Synthetic oligonucleotide
  Description of Combined DNA/RNA Molecule: Synthetic oligonucleotide
tagcgggucccguccuccucgtu

SEQ ID NO: 824 - DNA, 23 bp, Artificial Sequence
  Description of Artificial Sequence: Synthetic oligonucleotide
  Description of Combined DNA/RNA Molecule: Synthetic oligonucleotide
tcugaccaccccugccaggugtu

SEQ ID NO: 825 - DNA, 23 bp, Artificial Sequence
  Description of Artificial Sequence: Synthetic oligonucleotide
  Description of Combined DNA/RNA Molecule: Synthetic oligonucleotide
tcgcugaccaccccugccaggtu

SEQ ID NO: 826 - DNA, 23 bp, Artificial Sequence
  Description of Artificial Sequence: Synthetic oligonucleotide
  Description of Combined DNA/RNA Molecule: Synthetic oligonucleotide
tucccggccgcugaccacccctu

SEQ ID NO: 827 - DNA, 23 bp, Artificial Sequence
  Description of Artificial Sequence: Synthetic oligonucleotide
  Description of Combined DNA/RNA Molecule: Synthetic oligonucleotide
tggccuaugagggugccgcuatu

SEQ ID NO: 828 - DNA, 23 bp, Artificial Sequence
  Description of Artificial Sequence: Synthetic oligonucleotide
  Description of Combined DNA/RNA Molecule: Synthetic oligonucleotide
tcaggccuaugagggugccgctu

SEQ ID NO: 829 - DNA, 23 bp, Artificial Sequence
  Description of Artificial Sequence: Synthetic oligonucleotide
  Description of Combined DNA/RNA Molecule: Synthetic oligonucleotide
tuccaggccuaugagggugcctu

SEQ ID NO: 830 - DNA, 23 bp, Artificial Sequence
  Description of Artificial Sequence: Synthetic oligonucleotide
  Description of Combined DNA/RNA Molecule: Synthetic oligonucleotide
tagcccucgccaggcgcuggctu

SEQ ID NO: 831 - DNA, 23 bp, Artificial Sequence
  Description of Artificial Sequence: Synthetic oligonucleotide
  Description of Combined DNA/RNA Molecule: Synthetic oligonucleotide
tcacgaccccagcccucgccatu

SEQ ID NO: 832 - DNA, 23 bp, Artificial Sequence
  Description of Artificial Sequence: Synthetic oligonucleotide
  Description of Combined DNA/RNA Molecule: Synthetic oligonucleotide
tccagcacgaccccagcccuctu

SEQ ID NO: 833 - DNA, 23 bp, Artificial Sequence
  Description of Artificial Sequence: Synthetic oligonucleotide
  Description of Combined DNA/RNA Molecule: Synthetic oligonucleotide
tccagggucaccggcuggucutu

SEQ ID NO: 834 - DNA, 23 bp, Artificial Sequence
  Description of Artificial Sequence: Synthetic oligonucleotide
  Description of Combined DNA/RNA Molecule: Synthetic oligonucleotide
tccccagggucaccggcuggutu

SEQ ID NO: 835 - DNA, 23 bp, Artificial Sequence
  Description of Artificial Sequence: Synthetic oligonucleotide
  Description of Combined DNA/RNA Molecule: Synthetic oligonucleotide
tguccccagggucaccggcugtu

SEQ ID NO: 836 - DNA, 23 bp, Artificial Sequence
  Description of Artificial Sequence: Synthetic oligonucleotide
  Description of Combined DNA/RNA Molecule: Synthetic oligonucleotide
tgggcggccaccagguuggggtu

SEQ ID NO: 837 - DNA, 23 bp, Artificial Sequence
  Description of Artificial Sequence: Synthetic oligonucleotide
  Description of Combined DNA/RNA Molecule: Synthetic oligonucleotide
tgcagggcggccaccagguugtu

SEQ ID NO: 838 - DNA, 23 bp, Artificial Sequence
  Description of Artificial Sequence: Synthetic oligonucleotide
  Description of Combined DNA/RNA Molecule: Synthetic oligonucleotide
tuggagcagcucagcagcucctu

SEQ ID NO: 839 - DNA, 23 bp, Artificial Sequence
  Description of Artificial Sequence: Synthetic oligonucleotide
  Description of Combined DNA/RNA Molecule: Synthetic oligonucleotide
tccgccgcuucccacuccuggtu

SEQ ID NO: 840 - DNA, 23 bp, Artificial Sequence
  Description of Artificial Sequence: Synthetic oligonucleotide
  Description of Combined DNA/RNA Molecule: Synthetic oligonucleotide
tccccgccgcuucccacuccutu

SEQ ID NO: 841 - DNA, 23 bp, Artificial Sequence
  Description of Artificial Sequence: Synthetic oligonucleotide
  Description of Combined DNA/RNA Molecule: Synthetic oligonucleotide
tccugugaggacguggcccugtu

SEQ ID NO: 842 - DNA, 23 bp, Artificial Sequence
  Description of Artificial Sequence: Synthetic oligonucleotide
  Description of Combined DNA/RNA Molecule: Synthetic oligonucleotide
tagguccuccaccucccagugtu

SEQ ID NO: 843 - DNA, 23 bp, Artificial Sequence
  Description of Artificial Sequence: Synthetic oligonucleotide
  Description of Combined DNA/RNA Molecule: Synthetic oligonucleotide
tccaagguccuccaccucccatu

SEQ ID NO: 844 - DNA, 23 bp, Artificial Sequence
  Description of Artificial Sequence: Synthetic oligonucleotide
  Description of Combined DNA/RNA Molecule: Synthetic oligonucleotide
tgugggugccaagguccuccatu

SEQ ID NO: 845 - DNA, 23 bp, Artificial Sequence
  Description of Artificial Sequence: Synthetic oligonucleotide
  Description of Combined DNA/RNA Molecule: Synthetic oligonucleotide
tcugaccucguggccucagcatu

SEQ ID NO: 846 - DNA, 23 bp, Artificial Sequence
  Description of Artificial Sequence: Synthetic oligonucleotide
  Description of Combined DNA/RNA Molecule: Synthetic oligonucleotide
tggcugaccucguggccucagtu

SEQ ID NO: 847 - DNA, 23 bp, Artificial Sequence
  Description of Artificial Sequence: Synthetic oligonucleotide
  Description of Combined DNA/RNA Molecule: Synthetic oligonucleotide
tuugggcugaccucguggccutu

SEQ ID NO: 848 - DNA, 23 bp, Artificial Sequence
  Description of Artificial Sequence: Synthetic oligonucleotide
  Description of Combined DNA/RNA Molecule: Synthetic oligonucleotide
tgcuggccucccuguggcccatu

SEQ ID NO: 849 - DNA, 23 bp, Artificial Sequence
  Description of Artificial Sequence: Synthetic oligonucleotide
  Description of Combined DNA/RNA Molecule: Synthetic oligonucleotide
taugcuggccucccuguggcctu

SEQ ID NO: 850 - DNA, 23 bp, Artificial Sequence
  Description of Artificial Sequence: Synthetic oligonucleotide
  Description of Combined DNA/RNA Molecule: Synthetic oligonucleotide
tuggaugcuggccucccugugtu

SEQ ID NO: 851 - DNA, 23 bp, Artificial Sequence
  Description of Artificial Sequence: Synthetic oligonucleotide
  Description of Combined DNA/RNA Molecule: Synthetic oligonucleotide
tgcguggaugcuggccucccutu

SEQ ID NO: 852 - DNA, 23 bp, Artificial Sequence
  Description of Artificial Sequence: Synthetic oligonucleotide
  Description of Combined DNA/RNA Molecule: Synthetic oligonucleotide
tgccgggauuccaugcuccuutu

SEQ ID NO: 853 - DNA, 23 bp, Artificial Sequence
  Description of Artificial Sequence: Synthetic oligonucleotide
  Description of Combined DNA/RNA Molecule: Synthetic oligonucleotide
taggucccagggagggcacugtu

SEQ ID NO: 854 - DNA, 23 bp, Artificial Sequence
  Description of Artificial Sequence: Synthetic oligonucleotide
  Description of Combined DNA/RNA Molecule: Synthetic oligonucleotide
tggaggucccagggagggcactu

SEQ ID NO: 855 - DNA, 23 bp, Artificial Sequence
  Description of Artificial Sequence: Synthetic oligonucleotide
  Description of Combined DNA/RNA Molecule: Synthetic oligonucleotide
tcggcuccggcagcagauggctu

SEQ ID NO: 856 - DNA, 23 bp, Artificial Sequence
  Description of Artificial Sequence: Synthetic oligonucleotide
  Description of Combined DNA/RNA Molecule: Synthetic oligonucleotide
tcaagggccaggccagcagcctu

SEQ ID NO: 857 - DNA, 23 bp, Artificial Sequence
  Description of Artificial Sequence: Synthetic oligonucleotide
  Description of Combined DNA/RNA Molecule: Synthetic oligonucleotide
tagggagcuuccuggcaccuctu

SEQ ID NO: 858 - DNA, 23 bp, Artificial Sequence
  Description of Artificial Sequence: Synthetic oligonucleotide
  Description of Combined DNA/RNA Molecule: Synthetic oligonucleotide
tccuucccagccucacuguuatu

SEQ ID NO: 859 - DNA, 23 bp, Artificial Sequence
  Description of Artificial Sequence: Synthetic oligonucleotide
  Description of Combined DNA/RNA Molecule: Synthetic oligonucleotide
tcuggucuguguuccccuucctu

SEQ ID NO: 860 - DNA, 23 bp, Artificial Sequence
  Description of Artificial Sequence: Synthetic oligonucleotide
  Description of Combined DNA/RNA Molecule: Synthetic oligonucleotide
tcuuccuggucuguguucccctu

SEQ ID NO: 861 - RNA, 21 nt, Artificial Sequence
  Description of Artificial Sequence: Synthetic oligonucleotide
aauacugucccuuuuaagcuu

SEQ ID NO: 862 - RNA, 21 nt, Artificial Sequence
  Description of Artificial Sequence: Synthetic oligonucleotide
aauacugucccuuuuaagcuu

SEQ ID NO: 863 - RNA, 21 nt, Artificial Sequence
  Description of Artificial Sequence: Synthetic oligonucleotide
aauacugucccuuuuaagcuu

SEQ ID NO: 864 - RNA, 21 nt, Artificial Sequence
  Description of Artificial Sequence: Synthetic oligonucleotide
aauacugucccuuuuaagcuu

SEQ ID NO: 865 - RNA, 21 nt, Artificial Sequence
  Description of Artificial Sequence: Synthetic oligonucleotide
aauacugucccuuuuaagcuu

SEQ ID NO: 866 - RNA, 21 nt, Artificial Sequence
  Description of Artificial Sequence: Synthetic oligonucleotide
aauacugucccuuuuaagcuu

SEQ ID NO: 867 - RNA, 21 nt, Artificial Sequence
  Description of Artificial Sequence: Synthetic oligonucleotide
aauacugucccuuuuaagcuu

SEQ ID NO: 868 - RNA, 21 nt, Artificial Sequence
  Description of Artificial Sequence: Synthetic oligonucleotide
aauacugucccuuuuaagcuu

SEQ ID NO: 869 - RNA, 21 nt, Artificial Sequence
  Description of Artificial Sequence: Synthetic oligonucleotide
aauacugucccuuuuaagcuu

SEQ ID NO: 870 - RNA, 21 nt, Artificial Sequence
  Description of Artificial Sequence: Synthetic oligonucleotide
aauacugucccuuuuaagcuu

SEQ ID NO: 871 - RNA, 21 nt, Artificial Sequence
  Description of Artificial Sequence: Synthetic oligonucleotide
aauacugucccuuuuaagcuu

SEQ ID NO: 872 - RNA, 21 nt, Artificial Sequence
  Description of Artificial Sequence: Synthetic oligonucleotide
aauacugucccuuuuaagcuu

SEQ ID NO: 873 - RNA, 21 nt, Artificial Sequence
  Description of Artificial Sequence: Synthetic oligonucleotide
aauacugucccuuuuaagcuu

SEQ ID NO: 874 - RNA, 21 nt, Artificial Sequence
  Description of Artificial Sequence: Synthetic oligonucleotide
aauacugucccuuuuaagcuu

SEQ ID NO: 875 - RNA, 21 nt, Artificial Sequence
  Description of Artificial Sequence: Synthetic oligonucleotide
aauacugucccuuuuaagcuu

SEQ ID NO: 876 - RNA, 21 nt, Artificial Sequence
  Description of Artificial Sequence: Synthetic oligonucleotide
aauacugucccuuuuaagcuu

SEQ ID NO: 877 - RNA, 21 nt, Artificial Sequence
  Description of Artificial Sequence: Synthetic oligonucleotide
aauacugucccuuuuaagcuu

SEQ ID NO: 878 - RNA, 21 nt, Artificial Sequence
  Description of Artificial Sequence: Synthetic oligonucleotide
aauacugucccuuuuaagcuu

SEQ ID NO: 879 - RNA, 21 nt, Artificial Sequence
  Description of Artificial Sequence: Synthetic oligonucleotide
aauacugucccuuuuaagcuu

SEQ ID NO: 880 - RNA, 21 nt, Artificial Sequence
  Description of Artificial Sequence: Synthetic oligonucleotide
aauacugucccuuuuaagcuu

SEQ ID NO: 881 - RNA, 21 nt, Artificial Sequence
  Description of Artificial Sequence: Synthetic oligonucleotide
aauacugucccuuuuaagcuu

SEQ ID NO: 882 - RNA, 21 nt, Artificial Sequence
  Description of Artificial Sequence: Synthetic oligonucleotide
gcuuaaaagggacaguauuuu

SEQ ID NO: 883 - RNA, 21 nt, Artificial Sequence
  Description of Artificial Sequence: Synthetic oligonucleotide
gugcauccuuggcggucuuuu

SEQ ID NO: 884 - RNA, 21 nt, Artificial Sequence
  Description of Artificial Sequence: Synthetic oligonucleotide
gugcauccuuggcggucuuuu

SEQ ID NO: 885 - RNA, 21 nt, Artificial Sequence
  Description of Artificial Sequence: Synthetic oligonucleotide
gugcauccuuggcggucuuuu

SEQ ID NO: 886 - RNA, 21 nt, Artificial Sequence
  Description of Artificial Sequence: Synthetic oligonucleotide
gugcauccuuggcggucuuuu

SEQ ID NO: 887 - RNA, 21 nt, Artificial Sequence
  Description of Artificial Sequence: Synthetic oligonucleotide
gucccagguggcccagcaguu

SEQ ID NO: 888 - RNA, 21 nt, Artificial Sequence
  Description of Artificial Sequence: Synthetic oligonucleotide
cugcugggccaccugggacuu

SEQ ID NO: 889 - RNA, 21 nt, Artificial Sequence
  Description of Artificial Sequence: Synthetic oligonucleotide
cugcugggccaccugggacuu

SEQ ID NO: 890 - RNA, 21 nt, Artificial Sequence
  Description of Artificial Sequence: Synthetic oligonucleotide
cugcugggccaccugggacuu

SEQ ID NO: 891 - RNA, 21 nt, Artificial Sequence
  Description of Artificial Sequence: Synthetic oligonucleotide
cugcugggccaccugggacuu

SEQ ID NO: 892 - RNA, 21 nt, Artificial Sequence
  Description of Artificial Sequence: Synthetic oligonucleotide
gacccugaggucagaccaauu

SEQ ID NO: 893 - RNA, 21 nt, Artificial Sequence
  Description of Artificial Sequence: Synthetic oligonucleotide
uuggucugaccucagggucuu

SEQ ID NO: 894 - RNA, 21 nt, Artificial Sequence
  Description of Artificial Sequence: Synthetic oligonucleotide
uuggucugaccucagggucuu

SEQ ID NO: 895 - RNA, 21 nt, Artificial Sequence
  Description of Artificial Sequence: Synthetic oligonucleotide
uuggucugaccucagggucuu

SEQ ID NO: 896 - RNA, 21 nt, Artificial Sequence
  Description of Artificial Sequence: Synthetic oligonucleotide
uuggucugaccucagggucuu

SEQ ID NO: 897 - RNA, 21 nt, Artificial Sequence
  Description of Artificial Sequence: Synthetic oligonucleotide
uuggucugaccucagggucuu

SEQ ID NO: 898 - RNA, 21 nt, Artificial Sequence
  Description of Artificial Sequence: Synthetic oligonucleotide
uuggucugaccucagggucuu

SEQ ID NO: 899 - RNA, 21 nt, Artificial Sequence
  Description of Artificial Sequence: Synthetic oligonucleotide
ccuccaggcaugcuggccuuu

SEQ ID NO: 900 - RNA, 21 nt, Artificial Sequence
  Description of Artificial Sequence: Synthetic oligonucleotide
aggccagcaugccuggagguu

SEQ ID NO: 901 - RNA, 21 nt, Artificial Sequence
  Description of Artificial Sequence: Synthetic oligonucleotide
aggccagcaugccuggagguu

SEQ ID NO: 902 - RNA, 21 nt, Artificial Sequence
  Description of Artificial Sequence: Synthetic oligonucleotide
aggccagcaugccuggagguu

SEQ ID NO: 903 - RNA, 21 nt, Artificial Sequence
  Description of Artificial Sequence: Synthetic oligonucleotide
aggccagcaugccuggagguu

SEQ ID NO: 904 - RNA, 21 nt, Artificial Sequence
  Description of Artificial Sequence: Synthetic oligonucleotide
gugcaggagucccaggugguu

SEQ ID NO: 905 - RNA, 21 nt, Artificial Sequence
  Description of Artificial Sequence: Synthetic oligonucleotide
ccaccugggacuccugcacuu

SEQ ID NO: 906 - RNA, 21 nt, Artificial Sequence
  Description of Artificial Sequence: Synthetic oligonucleotide
ccaccugggacuccugcacuu

SEQ ID NO: 907 - RNA, 21 nt, Artificial Sequence
  Description of Artificial Sequence: Synthetic oligonucleotide
ccaccugggacuccugcacuu

SEQ ID NO: 908 - RNA, 21 nt, Artificial Sequence
  Description of Artificial Sequence: Synthetic oligonucleotide
ccaccugggacuccugcacuu

SEQ ID NO: 909 - RNA, 21 nt, Artificial Sequence
  Description of Artificial Sequence: Synthetic oligonucleotide
gggcugggugaccgauggcuu

SEQ ID NO: 910 - RNA, 21 nt, Artificial Sequence
  Description of Artificial Sequence: Synthetic oligonucleotide
gccaucggucacccagcccuu

SEQ ID NO: 911 - RNA, 21 nt, Artificial Sequence
  Description of Artificial Sequence: Synthetic oligonucleotide
gccaucggucacccagcccuu

SEQ ID NO: 912 - RNA, 21 nt, Artificial Sequence
  Description of Artificial Sequence: Synthetic oligonucleotide
gccaucggucacccagcccuu

SEQ ID NO: 913 - RNA, 21 nt, Artificial Sequence
  Description of Artificial Sequence: Synthetic oligonucleotide
gccaucggucacccagcccuu

SEQ ID NO: 914 - RNA, 21 nt, Artificial Sequence
  Description of Artificial Sequence: Synthetic oligonucleotide
gccucccaauaaagcuggauu

SEQ ID NO: 915 - RNA, 21 nt, Artificial Sequence
  Description of Artificial Sequence: Synthetic oligonucleotide
uccagcuuuauugggaggcuu

SEQ ID NO: 916 - RNA, 21 nt, Artificial Sequence
  Description of Artificial Sequence: Synthetic oligonucleotide
uccagcuuuauugggaggcuu

SEQ ID NO: 917 - RNA, 21 nt, Artificial Sequence
  Description of Artificial Sequence: Synthetic oligonucleotide
uccagcuuuauugggaggcuu

SEQ ID NO: 918 - RNA, 21 nt, Artificial Sequence
  Description of Artificial Sequence: Synthetic oligonucleotide
uccagcuuuauugggaggcuu

SEQ ID NO: 919 - RNA, 21 nt, Artificial Sequence
  Description of Artificial Sequence: Synthetic oligonucleotide
ccguggcugccugagaccuuu

SEQ ID NO: 920 - RNA, 21 nt, Artificial Sequence
  Description of Artificial Sequence: Synthetic oligonucleotide
aggucucaggcagccacgguu

SEQ ID NO: 921 - RNA, 21 nt, Artificial Sequence
  Description of Artificial Sequence: Synthetic oligonucleotide
aggucucaggcagccacgguu

SEQ ID NO: 922 - RNA, 21 nt, Artificial Sequence
  Description of Artificial Sequence: Synthetic oligonucleotide
aggucucaggcagccacgguu

SEQ ID NO: 923 - RNA, 21 nt, Artificial Sequence
  Description of Artificial Sequence: Synthetic oligonucleotide
aggucucaggcagccacgguu

SEQ ID NO: 924 - RNA, 21 nt, Artificial Sequence
  Description of Artificial Sequence: Synthetic oligonucleotide
gcuuaaaagggacaguauuuu

SEQ ID NO: 925 - RNA, 21 nt, Artificial Sequence
  Description of Artificial Sequence: Synthetic oligonucleotide
aauacugucccuuuuaagcuu

SEQ ID NO: 926 - RNA, 21 nt, Artificial Sequence
  Description of Artificial Sequence: Synthetic oligonucleotide
aauacugucccuuuuaagcuu

SEQ ID NO: 927 - RNA, 21 nt, Artificial Sequence
  Description of Artificial Sequence: Synthetic oligonucleotide
aauacugucccuuuuaagcuu

SEQ ID NO: 928 - RNA, 21 nt, Artificial Sequence
  Description of Artificial Sequence: Synthetic oligonucleotide
aauacugucccuuuuaagcuu

SEQ ID NO: 929 - RNA, 21 nt, Artificial Sequence
  Description of Artificial Sequence: Synthetic oligonucleotide
aauacugucccuuuuaagcuu

SEQ ID NO: 930 - RNA, 21 nt, Artificial Sequence
  Description of Artificial Sequence: Synthetic oligonucleotide
aauacugucccuuuuaagcuu

SEQ ID NO: 931 - DNA, 21 bp, Artificial Sequence
  Description of Artificial Sequence: Synthetic oligonucleotide
  Description of Combined DNA/RNA Molecule: Synthetic oligonucleotide
gggacagtattctcagtgauu

SEQ ID NO: 932 - RNA, 21 nt, Artificial Sequence
  Description of Artificial Sequence: Synthetic oligonucleotide
ucacugagaauacugucccuu

SEQ ID NO: 933 - RNA, 21 nt, Artificial Sequence
  Description of Artificial Sequence: Synthetic oligonucleotide
ucacugagaauacugucccuu

SEQ ID NO: 934 - RNA, 21 nt, Artificial Sequence
  Description of Artificial Sequence: Synthetic oligonucleotide
ucacugagaauacugucccuu

SEQ ID NO: 935 - RNA, 21 nt, Artificial Sequence
  Description of Artificial Sequence: Synthetic oligonucleotide
ucacugagaauacugucccuu

SEQ ID NO: 936 - RNA, 21 nt, Artificial Sequence
  Description of Artificial Sequence: Synthetic oligonucleotide
ucacugagaauacugucccuu

SEQ ID NO: 937 - RNA, 21 nt, Artificial Sequence
  Description of Artificial Sequence: Synthetic oligonucleotide
ucacugagaauacugucccuu

SEQ ID NO: 938 - RNA, 21 nt, Artificial Sequence
  Description of Artificial Sequence: Synthetic oligonucleotide
ucacugagaauacugucccuu

SEQ ID NO: 939 - RNA, 21 nt, Artificial Sequence
  Description of Artificial Sequence: Synthetic oligonucleotide
ucacugagaauacugucccuu

SEQ ID NO: 940 - RNA, 21 nt, Artificial Sequence
  Description of Artificial Sequence: Synthetic oligonucleotide
ucacugagaauacugucccuu

SEQ ID NO: 941 - RNA, 21 nt, Artificial Sequence
  Description of Artificial Sequence: Synthetic oligonucleotide
ucacugagaauacugucccuu

SEQ ID NO: 942 - RNA, 21 nt, Artificial Sequence
  Description of Artificial Sequence: Synthetic oligonucleotide
ucacugagaauacugucccuu

SEQ ID NO: 943 - RNA, 21 nt, Artificial Sequence
  Description of Artificial Sequence: Synthetic oligonucleotide
aaagcuggacaagaagcuauu

SEQ ID NO: 944 - RNA, 21 nt, Artificial Sequence
  Description of Artificial Sequence: Synthetic oligonucleotide
uagcuucuuguccagcuuuuu

SEQ ID NO: 945 - RNA, 21 nt, Artificial Sequence
  Description of Artificial Sequence: Synthetic oligonucleotide
uagcuucuuguccagcuuuuu

SEQ ID NO: 946 - RNA, 21 nt, Artificial Sequence
  Description of Artificial Sequence: Synthetic oligonucleotide
uagcuucuuguccagcuuuuu

SEQ ID NO: 947 - RNA, 21 nt, Artificial Sequence
  Description of Artificial Sequence: Synthetic oligonucleotide
uagcuucuuguccagcuuuuu

SEQ ID NO: 948 - RNA, 21 nt, Artificial Sequence
  Description of Artificial Sequence: Synthetic oligonucleotide
uagcuucuuguccagcuuuuu

SEQ ID NO: 949 - RNA, 21 nt, Artificial Sequence
  Description of Artificial Sequence: Synthetic oligonucleotide
uagcuucuuguccagcuuuuu

SEQ ID NO: 950 - RNA, 21 nt, Artificial Sequence
  Description of Artificial Sequence: Synthetic oligonucleotide
uagcuucuuguccagcuuuuu

SEQ ID NO: 951 - RNA, 21 nt, Artificial Sequence
  Description of Artificial Sequence: Synthetic oligonucleotide
uagcuucuuguccagcuuuuu

SEQ ID NO: 952 - RNA, 21 nt, Artificial Sequence
  Description of Artificial Sequence: Synthetic oligonucleotide
uagcuucuuguccagcuuuuu

SEQ ID NO: 953 - RNA, 21 nt, Artificial Sequence
  Description of Artificial Sequence: Synthetic oligonucleotide
uagcuucuuguccagcuuuuu

SEQ ID NO: 954 - RNA, 21 nt, Artificial Sequence
  Description of Artificial Sequence: Synthetic oligonucleotide
uagcuucuuguccagcuuuuu

SEQ ID NO: 955 - RNA, 21 nt, Artificial Sequence
  Description of Artificial Sequence: Synthetic oligonucleotide
gcuucagaggccgaggauguu

SEQ ID NO: 956 - RNA, 21 nt, Artificial Sequence
  Description of Artificial Sequence: Synthetic oligonucleotide
cauccucggccucugaagcuu

SEQ ID NO: 957 - RNA, 21 nt, Artificial Sequence
  Description of Artificial Sequence: Synthetic oligonucleotide
cauccucggccucugaagcuu

SEQ ID NO: 958 - RNA, 21 nt, Artificial Sequence
  Description of Artificial Sequence: Synthetic oligonucleotide
cauccucggccucugaagcuu

SEQ ID NO: 959 - RNA, 21 nt, Artificial Sequence
  Description of Artificial Sequence: Synthetic oligonucleotide
cauccucggccucugaagcuu

SEQ ID NO: 960 - RNA, 21 nt, Artificial Sequence
  Description of Artificial Sequence: Synthetic oligonucleotide
augaagcacgccaccaagauu

SEQ ID NO: 961 - RNA, 21 nt, Artificial Sequence
  Description of Artificial Sequence: Synthetic oligonucleotide
ucuugguggcgugcuucauuu

SEQ ID NO: 962 - RNA, 21 nt, Artificial Sequence
  Description of Artificial Sequence: Synthetic oligonucleotide
ucuugguggcgugcuucauuu

SEQ ID NO: 963 - RNA, 21 nt, Artificial Sequence
  Description of Artificial Sequence: Synthetic oligonucleotide
ucuugguggcgugcuucauuu

SEQ ID NO: 964 - RNA, 21 nt, Artificial Sequence
  Description of Artificial Sequence: Synthetic oligonucleotide
ucuugguggcgugcuucauuu

SEQ ID NO: 965 - RNA, 21 nt, Artificial Sequence
  Description of Artificial Sequence: Synthetic oligonucleotide
ugaggucagaccaacuucauu

SEQ ID NO: 966 - RNA, 21 nt, Artificial Sequence
  Description of Artificial Sequence: Synthetic oligonucleotide
ugaaguuggucugaccucauu

SEQ ID NO: 967 - RNA, 21 nt, Artificial Sequence
  Description of Artificial Sequence: Synthetic oligonucleotide
ugaaguuggucugaccucauu

SEQ ID NO: 968 - RNA, 21 nt, Artificial Sequence
  Description of Artificial Sequence: Synthetic oligonucleotide
ugaaguuggucugaccucauu

SEQ ID NO: 969 - RNA, 21 nt, Artificial Sequence
  Description of Artificial Sequence: Synthetic oligonucleotide
ugaaguuggucugaccucauu

SEQ ID NO: 970 - RNA, 21 nt, Artificial Sequence
  Description of Artificial Sequence: Synthetic oligonucleotide
ugaaguuggucugaccucauu

SEQ ID NO: 971 - RNA, 21 nt, Artificial Sequence
  Description of Artificial Sequence: Synthetic oligonucleotide
ugaaguuggucugaccucauu

SEQ ID NO: 972 - RNA, 21 nt, Artificial Sequence
  Description of Artificial Sequence: Synthetic oligonucleotide
aggguuacaugaagcacgcuu

SEQ ID NO: 973 - RNA, 21 nt, Artificial Sequence
  Description of Artificial Sequence: Synthetic oligonucleotide
gcgugcuucauguaacccuuu

SEQ ID NO: 974 - RNA, 21 nt, Artificial Sequence
  Description of Artificial Sequence: Synthetic oligonucleotide
gcgugcuucauguaacccuuu

SEQ ID NO: 975 - RNA, 21 nt, Artificial Sequence
  Description of Artificial Sequence: Synthetic oligonucleotide
gcgugcuucauguaacccuuu

SEQ ID NO: 976 - RNA, 21 nt, Artificial Sequence
  Description of Artificial Sequence: Synthetic oligonucleotide
gcgugcuucauguaacccuuu

SEQ ID NO: 977 - RNA, 21 nt, Artificial Sequence
  Description of Artificial Sequence: Synthetic oligonucleotide
aauacugucccuuuuaagcuu

SEQ ID NO: 978 - RNA, 21 nt, Artificial Sequence
  Description of Artificial Sequence: Synthetic oligonucleotide
aauacugucccuuuuaagcuu

SEQ ID NO: 979 - RNA, 21 nt, Artificial Sequence
  Description of Artificial Sequence: Synthetic oligonucleotide
aauacugucccuuuuaagcuu

SEQ ID NO: 980 - RNA, 21 nt, Artificial Sequence
  Description of Artificial Sequence: Synthetic oligonucleotide
aauacugucccuuuuaagcuu

SEQ ID NO: 981 - RNA, 21 nt, Artificial Sequence
  Description of Artificial Sequence: Synthetic oligonucleotide
aauacugucccuuuuaagcuu

SEQ ID NO: 982 - RNA, 21 nt, Artificial Sequence
  Description of Artificial Sequence: Synthetic oligonucleotide
aauacugucccuuuuaagcuu

SEQ ID NO: 983 - RNA, 21 nt, Artificial Sequence
  Description of Artificial Sequence: Synthetic oligonucleotide
aauacugucccuuuuaagcuu

SEQ ID NO: 984 - RNA, 21 nt, Artificial Sequence
  Description of Artificial Sequence: Synthetic oligonucleotide
aauacugucccuuuuaagcuu

SEQ ID NO: 985 - RNA, 21 nt, Artificial Sequence
  Description of Artificial Sequence: Synthetic oligonucleotide
aauacugucccuuuuaagcuu

SEQ ID NO: 986 - RNA, 21 nt, Artificial Sequence
  Description of Artificial Sequence: Synthetic oligonucleotide
aauacugucccuuuuaagcuu

SEQ ID NO: 987 - RNA, 21 nt, Artificial Sequence
  Description of Artificial Sequence: Synthetic oligonucleotide
aauacugucccuuuuaagcuu

SEQ ID NO: 988 - RNA, 21 nt, Artificial Sequence
  Description of Artificial Sequence: Synthetic oligonucleotide
aauacugucccuuuuaagcuu

SEQ ID NO: 989 - RNA, 21 nt, Artificial Sequence
  Description of Artificial Sequence: Synthetic oligonucleotide
aauacugucccuuuuaagcuu

SEQ ID NO: 990 - RNA, 21 nt, Artificial Sequence
  Description of Artificial Sequence: Synthetic oligonucleotide
aauacugucccuuuuaagcuu

SEQ ID NO: 991 - RNA, 21 nt, Artificial Sequence
  Description of Artificial Sequence: Synthetic oligonucleotide
aauacugucccuuuuaagcuu

SEQ ID NO: 992 - RNA, 21 nt, Artificial Sequence
  Description of Artificial Sequence: Synthetic oligonucleotide
aauacugucccuuuuaagcuu

SEQ ID NO: 993 - RNA, 21 nt, Artificial Sequence
  Description of Artificial Sequence: Synthetic oligonucleotide
aauacugucccuuuuaagcuu

SEQ ID NO: 994 - RNA, 21 nt, Artificial Sequence
  Description of Artificial Sequence: Synthetic oligonucleotide
aauacugucccuuuuaagcuu

SEQ ID NO: 995 - RNA, 21 nt, Artificial Sequence
  Description of Artificial Sequence: Synthetic oligonucleotide
aauacugucccuuuuaagcuu

SEQ ID NO: 996 - RNA, 21 nt, Artificial Sequence
  Description of Artificial Sequence: Synthetic oligonucleotide
aauacugucccuuuuaagcuu

SEQ ID NO: 997 - RNA, 21 nt, Artificial Sequence
  Description of Artificial Sequence: Synthetic oligonucleotide
aauacugucccuuuuaagcuu

SEQ ID NO: 998 - RNA, 21 nt, Artificial Sequence
  Description of Artificial Sequence: Synthetic oligonucleotide
aauacugucccuuuuaagcuu

SEQ ID NO: 999 - RNA, 21 nt, Artificial Sequence
  Description of Artificial Sequence: Synthetic oligonucleotide
aauacugucccuuuuaagcuu

SEQ ID NO: 1000 - RNA, 21 nt, Artificial Sequence
  Description of Artificial Sequence: Synthetic oligonucleotide
aauacugucccuuuuaagcuu

SEQ ID NO: 1001 - RNA, 21 nt, Artificial Sequence
  Description of Artificial Sequence: Synthetic oligonucleotide
aauacugucccuuuuaagcuu

SEQ ID NO: 1002 - RNA, 21 nt, Artificial Sequence
  Description of Artificial Sequence: Synthetic oligonucleotide
aauacugucccuuuuaagcuu

SEQ ID NO: 1003 - RNA, 21 nt, Artificial Sequence
  Description of Artificial Sequence: Synthetic oligonucleotide
aauacugucccuuuuaagcuu

SEQ ID NO: 1004 - RNA, 21 nt, Artificial Sequence
  Description of Artificial Sequence: Synthetic oligonucleotide
aauacugucccuuuuaagcuu

SEQ ID NO: 1005 - RNA, 21 nt, Artificial Sequence
  Description of Artificial Sequence: Synthetic oligonucleotide
aauacugucccuuuuaagcuu

SEQ ID NO: 1006 - RNA, 21 nt, Artificial Sequence
  Description of Artificial Sequence: Synthetic oligonucleotide
aauacugucccuuuuaagcuu

SEQ ID NO: 1007 - RNA, 21 nt, Artificial Sequence
  Description of Artificial Sequence: Synthetic oligonucleotide
aauacugucccuuuuaagcuu

SEQ ID NO: 1008 - RNA, 21 nt, Artificial Sequence
  Description of Artificial Sequence: Synthetic oligonucleotide
aauacugucccuuuuaagcuu

SEQ ID NO: 1009 - RNA, 21 nt, Artificial Sequence
  Description of Artificial Sequence: Synthetic oligonucleotide
aauacugucccuuuuaagcuu

SEQ ID NO: 1010 - RNA, 21 nt, Artificial Sequence
  Description of Artificial Sequence: Synthetic oligonucleotide
aauacugucccuuuuaagcuu

SEQ ID NO: 1011 - RNA, 21 nt, Artificial Sequence
  Description of Artificial Sequence: Synthetic oligonucleotide
aauacugucccuuuuaagcuu

SEQ ID NO: 1012 - RNA, 21 nt, Artificial Sequence
  Description of Artificial Sequence: Synthetic oligonucleotide
aauacugucccuuuuaagcuu

SEQ ID NO: 1013 - RNA, 21 nt, Artificial Sequence
  Description of Artificial Sequence: Synthetic oligonucleotide
aauacugucccuuuuaagcuu

SEQ ID NO: 1014 - RNA, 21 nt, Artificial Sequence
  Description of Artificial Sequence: Synthetic oligonucleotide
aauacugucccuuuuaagcuu

SEQ ID NO: 1015 - RNA, 21 nt, Artificial Sequence
  Description of Artificial Sequence: Synthetic oligonucleotide
aauacugucccuuuuaagcuu

SEQ ID NO: 1016 - RNA, 21 nt, Artificial Sequence
  Description of Artificial Sequence: Synthetic oligonucleotide
aauacugucccuuuuaagcuu

SEQ ID NO: 1017 - RNA, 21 nt, Artificial Sequence
  Description of Artificial Sequence: Synthetic oligonucleotide
uccagcuuuauugggaggcuu

SEQ ID NO: 1018 - RNA, 21 nt, Artificial Sequence
  Description of Artificial Sequence: Synthetic oligonucleotide
aggucucaggcagccacgguu

SEQ ID NO: 1019 - RNA, 21 nt, Artificial Sequence
  Description of Artificial Sequence: Synthetic oligonucleotide
aggccagcaugccuggagguu

SEQ ID NO: 1020 - RNA, 21 nt, Artificial Sequence
  Description of Artificial Sequence: Synthetic oligonucleotide
ccaccugggacuccugcacuu

SEQ ID NO: 1021 - RNA, 21 nt, Artificial Sequence
  Description of Artificial Sequence: Synthetic oligonucleotide
gccaucggucacccagcccuu

SEQ ID NO: 1022 - RNA, 21 nt, Artificial Sequence
  Description of Artificial Sequence: Synthetic oligonucleotide
gugcauccuuggcggucuuuu

SEQ ID NO: 1023 - RNA, 21 nt, Artificial Sequence
  Description of Artificial Sequence: Synthetic oligonucleotide
cugcugggccaccugggacuu

SEQ ID NO: 1024 - RNA, 21 nt, Artificial Sequence
  Description of Artificial Sequence: Synthetic oligonucleotide
cauccucggccucugaagcuu

SEQ ID NO: 1025 - RNA, 21 nt, Artificial Sequence
  Description of Artificial Sequence: Synthetic oligonucleotide
ucuugguggcgugcuucauuu

SEQ ID NO: 1026 - RNA, 21 nt, Artificial Sequence
  Description of Artificial Sequence: Synthetic oligonucleotide
gcgugcuucauguaacccuuu

SEQ ID NO: 1027 - RNA, 21 nt, Artificial Sequence
  Description of Artificial Sequence: Synthetic oligonucleotide
aauacugucccuuuuaagcuu

SEQ ID NO: 1028 - RNA, 19 nt, Artificial Sequence
  Description of Artificial Sequence: Synthetic oligonucleotide
gcuuaaaagggacaguauu

SEQ ID NO: 1029 - RNA, 25 nt, Artificial Sequence
  Description of Artificial Sequence: Synthetic oligonucleotide
guugcuuaaaagggacaguauucuc

SEQ ID NO: 1030 - DNA, 21 bp, Artificial Sequence
  Description of Artificial Sequence: Synthetic oligonucleotide
tcactgagaatactgtcccaa

SEQ ID NO: 1031 - RNA, 21 nt, Artificial Sequence
  Description of Artificial Sequence: Synthetic oligonucleotide
ucacugagaauacugucccaa

SEQ ID NO: 1032 - RNA, 21 nt, Artificial Sequence
  Description of Artificial Sequence: Synthetic oligonucleotide
uagcuucuuguccagcuuuuu

SEQ ID NO: 1033 - RNA, 21 nt, Artificial Sequence
  Description of Artificial Sequence: Synthetic oligonucleotide
uagcuucuuguccagcuuuuu

SEQ ID NO: 1034 - RNA, 21 nt, Artificial Sequence
  Description of Artificial Sequence: Synthetic oligonucleotide
uagcuucuuguccagcuuuuu

SEQ ID NO: 1035 - RNA, 21 nt, Artificial Sequence
  Description of Artificial Sequence: Synthetic oligonucleotide
uagcuucuuguccagcuuuuu

SEQ ID NO: 1036 - RNA, 21 nt, Artificial Sequence
  Description of Artificial Sequence: Synthetic oligonucleotide
uagcuucuuguccagcuuuuu

SEQ ID NO: 1037 - RNA, 21 nt, Artificial Sequence
  Description of Artificial Sequence: Synthetic oligonucleotide
uagcuucuuguccagcuuuuu

SEQ ID NO: 1038 - RNA, 21 nt, Artificial Sequence
  Description of Artificial Sequence: Synthetic oligonucleotide
ucacugagaauacugucccuu

SEQ ID NO: 1039 - RNA, 21 nt, Artificial Sequence
  Description of Artificial Sequence: Synthetic oligonucleotide
ucacugagaauacugucccuu

SEQ ID NO: 1040 - RNA, 21 nt, Artificial Sequence
  Description of Artificial Sequence: Synthetic oligonucleotide
gugcauccuuggcggucuuuu

SEQ ID NO: 1041 - RNA, 21 nt, Artificial Sequence
  Description of Artificial Sequence: Synthetic oligonucleotide
gugcauccuuggcggucuuuu

SEQ ID NO: 1042 - RNA, 21 nt, Artificial Sequence
  Description of Artificial Sequence: Synthetic oligonucleotide
gugcauccuuggcggucuuuu

SEQ ID NO: 1043 - RNA, 21 nt, Artificial Sequence
  Description of Artificial Sequence: Synthetic oligonucleotide
gugcauccuuggcggucuuuu

SEQ ID NO: 1044 - RNA, 21 nt, Artificial Sequence
  Description of Artificial Sequence: Synthetic oligonucleotide
cugcugggccaccugggacuu

SEQ ID NO: 1045 - RNA, 21 nt, Artificial Sequence
  Description of Artificial Sequence: Synthetic oligonucleotide
cugcugggccaccugggacuu

SEQ ID NO: 1046 - RNA, 21 nt, Artificial Sequence
  Description of Artificial Sequence: Synthetic oligonucleotide
cugcugggccaccugggacuu

SEQ ID NO: 1047 - RNA, 21 nt, Artificial Sequence
  Description of Artificial Sequence: Synthetic oligonucleotide
cugcugggccaccugggacuu

SEQ ID NO: 1048 - RNA, 21 nt, Artificial Sequence
  Description of Artificial Sequence: Synthetic oligonucleotide
uuggucugaccucagggucuu

SEQ ID NO: 1049 - RNA, 21 nt, Artificial Sequence
  Description of Artificial Sequence: Synthetic oligonucleotide
uuggucugaccucagggucuu

SEQ ID NO: 1050 - RNA, 21 nt, Artificial Sequence
  Description of Artificial Sequence: Synthetic oligonucleotide
uuggucugaccucagggucuu

SEQ ID NO: 1051 - RNA, 21 nt, Artificial Sequence
  Description of Artificial Sequence: Synthetic oligonucleotide
uuggucugaccucagggucuu

SEQ ID NO: 1052 - RNA, 21 nt, Artificial Sequence
  Description of Artificial Sequence: Synthetic oligonucleotide
aggccagcaugccuggagguu

SEQ ID NO: 1053 - RNA, 21 nt, Artificial Sequence
  Description of Artificial Sequence: Synthetic oligonucleotide
aggccagcaugccuggagguu

SEQ ID NO: 1054 - RNA, 21 nt, Artificial Sequence
  Description of Artificial Sequence: Synthetic oligonucleotide
aggccagcaugccuggagguu

SEQ ID NO: 1055 - RNA, 21 nt, Artificial Sequence
  Description of Artificial Sequence: Synthetic oligonucleotide
aggccagcaugccuggagguu

SEQ ID NO: 1056 - RNA, 21 nt, Artificial Sequence
  Description of Artificial Sequence: Synthetic oligonucleotide
ccaccugggacuccugcacuu

SEQ ID NO: 1057 - RNA, 21 nt, Artificial Sequence
  Description of Artificial Sequence: Synthetic oligonucleotide
ccaccugggacuccugcacuu

SEQ ID NO: 1058 - RNA, 21 nt, Artificial Sequence
  Description of Artificial Sequence: Synthetic oligonucleotide
ccaccugggacuccugcacuu

SEQ ID NO: 1059 - RNA, 21 nt, Artificial Sequence
  Description of Artificial Sequence: Synthetic oligonucleotide
ccaccugggacuccugcacuu

SEQ ID NO: 1060 - RNA, 21 nt, Artificial Sequence
  Description of Artificial Sequence: Synthetic oligonucleotide
gccaucggucacccagcccuu

SEQ ID NO: 1061 - RNA, 21 nt, Artificial Sequence
  Description of Artificial Sequence: Synthetic oligonucleotide
gccaucggucacccagcccuu

SEQ ID NO: 1062 - RNA, 21 nt, Artificial Sequence
  Description of Artificial Sequence: Synthetic oligonucleotide
gccaucggucacccagcccuu

SEQ ID NO: 1063 - RNA, 21 nt, Artificial Sequence
  Description of Artificial Sequence: Synthetic oligonucleotide
gccaucggucacccagcccuu

SEQ ID NO: 1064 - RNA, 21 nt, Artificial Sequence
  Description of Artificial Sequence: Synthetic oligonucleotide
uccagcuuuauugggaggcuu

SEQ ID NO: 1065 - RNA, 21 nt, Artificial Sequence
  Description of Artificial Sequence: Synthetic oligonucleotide
uccagcuuuauugggaggcuu

SEQ ID NO: 1066 - RNA, 21 nt, Artificial Sequence
  Description of Artificial Sequence: Synthetic oligonucleotide
uccagcuuuauugggaggcuu

SEQ ID NO: 1067 - RNA, 21 nt, Artificial Sequence
  Description of Artificial Sequence: Synthetic oligonucleotide
uccagcuuuauugggaggcuu

SEQ ID NO: 1068 - RNA, 21 nt, Artificial Sequence
  Description of Artificial Sequence: Synthetic oligonucleotide
aggucucaggcagccacgguu

SEQ ID NO: 1069 - RNA, 21 nt, Artificial Sequence
  Description of Artificial Sequence: Synthetic oligonucleotide
aggucucaggcagccacgguu

SEQ ID NO: 1070 - RNA, 21 nt, Artificial Sequence
  Description of Artificial Sequence: Synthetic oligonucleotide
aggucucaggcagccacgguu

SEQ ID NO: 1071 - RNA, 21 nt, Artificial Sequence
  Description of Artificial Sequence: Synthetic oligonucleotide
aggucucaggcagccacgguu

SEQ ID NO: 1072 - RNA, 21 nt, Artificial Sequence
  Description of Artificial Sequence: Synthetic oligonucleotide
uguccagcuuuauugggaguu

SEQ ID NO: 1073 - RNA, 25 nt, Artificial Sequence
  Description of Artificial Sequence: Synthetic oligonucleotide
uguccagcuuuauugggaggccauu

SEQ ID NO: 1074 - DNA, 25 bp, Artificial Sequence
  Description of Artificial Sequence: Synthetic oligonucleotide
  Description of Combined DNA/RNA Molecule: Synthetic oligonucleotide
uagcuucuuguccagctttattguu

SEQ ID NO: 1075 - DNA, 21 bp, Artificial Sequence
  Description of Artificial Sequence: Synthetic oligonucleotide
  Description of Combined DNA/RNA Molecule: Synthetic oligonucleotide
uagcuucuuguccagcuuutu

SEQ ID NO: 1076 - DNA, 21 bp, Artificial Sequence
  Description of Artificial Sequence: Synthetic oligonucleotide
  Description of Combined DNA/RNA Molecule: Synthetic oligonucleotide
uagcuucuuguccagcuutuu

SEQ ID NO: 1077 - DNA, 25 bp, Artificial Sequence
  Description of Artificial Sequence: Synthetic oligonucleotide
  Description of Combined DNA/RNA Molecule: Synthetic oligonucleotide
uagcuucuuguccagctttattgtu

SEQ ID NO: 1078 - DNA, 25 bp, Artificial Sequence
  Description of Artificial Sequence: Synthetic oligonucleotide
  Description of Combined DNA/RNA Molecule: Synthetic oligonucleotide
uagcuucuuguccagctttatttuu

SEQ ID NO: 1079 - DNA, 21 bp, Artificial Sequence
  Description of Artificial Sequence: Synthetic oligonucleotide
  Description of Combined DNA/RNA Molecule: Synthetic oligonucleotide
uguccagcuuuauugggagtu

SEQ ID NO: 1080 - DNA, 21 bp, Artificial Sequence
  Description of Artificial Sequence: Synthetic oligonucleotide
  Description of Combined DNA/RNA Molecule: Synthetic oligonucleotide
uguccagcuuuauugggatuu

SEQ ID NO: 1081 - DNA, 25 bp, Artificial Sequence
  Description of Artificial Sequence: Synthetic oligonucleotide
  Description of Combined DNA/RNA Molecule: Synthetic oligonucleotide
uguccagcuuuauugggaggccatu

SEQ ID NO: 1082 - DNA, 25 bp, Artificial Sequence
  Description of Artificial Sequence: Synthetic oligonucleotide
  Description of Combined DNA/RNA Molecule: Synthetic oligonucleotide
uguccagcuuuauugggaggcctuu

SEQ ID NO: 1083 - RNA, 21 nt, Artificial Sequence
  Description of Artificial Sequence: Synthetic oligonucleotide
cauagcagcuucuuguccauu

SEQ ID NO: 1084 - RNA, 21 nt, Artificial Sequence
  Description of Artificial Sequence: Synthetic oligonucleotide
auagcagcuucuuguccaguu

SEQ ID NO: 1085 - RNA, 21 nt, Artificial Sequence
  Description of Artificial Sequence: Synthetic oligonucleotide
uagcagcuucuuguccagcuu

SEQ ID NO: 1086 - RNA, 21 nt, Artificial Sequence
  Description of Artificial Sequence: Synthetic oligonucleotide
agcagcuucuuguccagcuuu

SEQ ID NO: 1087 - RNA, 21 nt, Artificial Sequence
  Description of Artificial Sequence: Synthetic oligonucleotide
gcagcuucuuguccagcuuuu

SEQ ID NO: 1088 - RNA, 21 nt, Artificial Sequence
  Description of Artificial Sequence: Synthetic oligonucleotide
cagcuucuuguccagcuuuuu

SEQ ID NO: 1089 - RNA, 21 nt, Artificial Sequence
  Description of Artificial Sequence: Synthetic oligonucleotide
agcuucuuguccagcuuuauu

SEQ ID NO: 1090 - RNA, 21 nt, Artificial Sequence
  Description of Artificial Sequence: Synthetic oligonucleotide
gcuucuuguccagcuuuauuu

SEQ ID NO: 1091 - RNA, 21 nt, Artificial Sequence
  Description of Artificial Sequence: Synthetic oligonucleotide
cuucuuguccagcuuuauuuu

SEQ ID NO: 1092 - RNA, 21 nt, Artificial Sequence
  Description of Artificial Sequence: Synthetic oligonucleotide
uucuuguccagcuuuauuguu

SEQ ID NO: 1093 - RNA, 21 nt, Artificial Sequence
  Description of Artificial Sequence: Synthetic oligonucleotide
ucuuguccagcuuuauugguu

SEQ ID NO: 1094 - RNA, 21 nt, Artificial Sequence
  Description of Artificial Sequence: Synthetic oligonucleotide
cuuguccagcuuuauuggguu

SEQ ID NO: 1095 - RNA, 21 nt, Artificial Sequence
  Description of Artificial Sequence: Synthetic oligonucleotide
uuguccagcuuuauugggauu

SEQ ID NO: 1096 - RNA, 23 nt, Artificial Sequence
  Description of Artificial Sequence: Synthetic oligonucleotide
caauaaagcuggacaagaagcua

SEQ ID NO: 1097 - RNA, 23 nt, Artificial Sequence
  Description of Artificial Sequence: Synthetic oligonucleotide
uggccucccaauaaagcuggaca

SEQ ID NO: 1098 - RNA, 21 nt, Artificial Sequence
  Description of Artificial Sequence: Synthetic oligonucleotide
uagcuucuuguccagcuuuuu

SEQ ID NO: 1099 - DNA, 25 bp, Artificial Sequence
  Description of Artificial Sequence: Synthetic oligonucleotide
  Description of Combined DNA/RNA Molecule: Synthetic oligonucleotide
uagcuucuuguccagctttattguu

SEQ ID NO: 1100 - RNA, 21 nt, Artificial Sequence
  Description of Artificial Sequence: Synthetic oligonucleotide
uguccagcuuuauugggaguu

SEQ ID NO: 1101 - RNA, 25 nt, Artificial Sequence
  Description of Artificial Sequence: Synthetic oligonucleotide
uguccagcuuuauugggaggccauu

SEQ ID NO: 1102 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuuuu

SEQ ID NO: 1103 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuuuu

SEQ ID NO: 1104 - RNA, 20 nt, Artificial Sequence
  Description of Artificial Sequence: Synthetic oligonucleotide
agcuucuuguccagcuuuuu

SEQ ID NO: 1105 - DNA, 25 bp, Artificial Sequence
  Description of Artificial Sequence: Synthetic oligonucleotide
  Description of Combined DNA/RNA Molecule: Synthetic oligonucleotide
tagcuucuuguccagctttattguu

SEQ ID NO: 1106 - DNA, 25 bp, Artificial Sequence
  Description of Artificial Sequence: Synthetic oligonucleotide
  Description of Combined DNA/RNA Molecule: Synthetic oligonucleotide
tagcuucuuguccagctttattguu

SEQ ID NO: 1107 - DNA, 24 bp, Artificial Sequence
  Description of Artificial Sequence: Synthetic oligonucleotide
  Description of Combined DNA/RNA Molecule: Synthetic oligonucleotide
agcuucuuguccagctttattguu

SEQ ID NO: 1108 - DNA, 20 bp, Artificial Sequence
  Description of Artificial Sequence: Synthetic oligonucleotide
  Description of Combined DNA/RNA Molecule: Synthetic oligonucleotide
ugguaatccactttcagagg

SEQ ID NO: 1109 - RNA, 19 nt, Artificial Sequence
  Description of Artificial Sequence: Synthetic oligonucleotide
uagcuucuuguccagcuuu

SEQ ID NO: 1110 - RNA, 17 nt, Artificial Sequence
  Description of Artificial Sequence: Synthetic oligonucleotide
uagcuucuuguccaguu

SEQ ID NO: 1111 - DNA, 21 bp, Artificial Sequence
  Description of Artificial Sequence: Synthetic oligonucleotide
  Description of Combined DNA/RNA Molecule: Synthetic oligonucleotide
tagctucutgtccagctutuu

SEQ ID NO: 1112 - DNA, 21 bp, Artificial Sequence
  Description of Artificial Sequence: Synthetic oligonucleotide
  Description of Combined DNA/RNA Molecule: Synthetic oligonucleotide
tagctucttgtccagctutuu

SEQ ID NO: 1113 - DNA, 21 bp, Artificial Sequence
  Description of Artificial Sequence: Synthetic oligonucleotide
  Description of Combined DNA/RNA Molecule: Synthetic oligonucleotide
tagctucutguccagctutuu

SEQ ID NO: 1114 - DNA, 21 bp, Artificial Sequence
  Description of Artificial Sequence: Synthetic oligonucleotide
  Description of Combined DNA/RNA Molecule: Synthetic oligonucleotide
tagctucttguccagctutuu

SEQ ID NO: 1115 - RNA, 19 nt, Artificial Sequence
  Description of Artificial Sequence: Synthetic oligonucleotide
uagcuucuuguccagcuuu

SEQ ID NO: 1116 - RNA, 17 nt, Artificial Sequence
  Description of Artificial Sequence: Synthetic oligonucleotide
uagcuucuuguccaguu

SEQ ID NO: 1117 - DNA, 21 bp, Artificial Sequence
  Description of Artificial Sequence: Synthetic oligonucleotide
  Description of Combined DNA/RNA Molecule: Synthetic oligonucleotide
tagctucutgtccagctutuu

SEQ ID NO: 1118 - DNA, 21 bp, Artificial Sequence
  Description of Artificial Sequence: Synthetic oligonucleotide
  Description of Combined DNA/RNA Molecule: Synthetic oligonucleotide
tagctucttgtccagctutuu

SEQ ID NO: 1119 - DNA, 21 bp, Artificial Sequence
  Description of Artificial Sequence: Synthetic oligonucleotide
  Description of Combined DNA/RNA Molecule: Synthetic oligonucleotide
tagctucutguccagctutuu

SEQ ID NO: 1120 - DNA, 21 bp, Artificial Sequence
  Description of Artificial Sequence: Synthetic oligonucleotide
  Description of Combined DNA/RNA Molecule: Synthetic oligonucleotide
tagctucttguccagctutuu

SEQ ID NO: 1121 - DNA, 25 bp, Artificial Sequence
  Description of Artificial Sequence: Synthetic oligonucleotide
  Description of Combined DNA/RNA Molecule: Synthetic oligonucleotide
tagctucutgtccagctttattguu

SEQ ID NO: 1122 - DNA, 25 bp, Artificial Sequence
  Description of Artificial Sequence: Synthetic oligonucleotide
  Description of Combined DNA/RNA Molecule: Synthetic oligonucleotide
tagctucttgtccagctttattguu

SEQ ID NO: 1123 - DNA, 23 bp, Artificial Sequence
  Description of Artificial Sequence: Synthetic oligonucleotide
  Description of Combined DNA/RNA Molecule: Synthetic oligonucleotide
tagcuucuuguccagctttatuu

SEQ ID NO: 1124 - DNA, 21 bp, Artificial Sequence
  Description of Artificial Sequence: Synthetic oligonucleotide
  Description of Combined DNA/RNA Molecule: Synthetic oligonucleotide
tagcuucuuguccagctttuu

SEQ ID NO: 1125 - DNA, 25 bp, Artificial Sequence
  Description of Artificial Sequence: Synthetic oligonucleotide
  Description of Combined DNA/RNA Molecule: Synthetic oligonucleotide
tagctucutguccagctttattguu

SEQ ID NO: 1126 - DNA, 25 bp, Artificial Sequence
  Description of Artificial Sequence: Synthetic oligonucleotide
  Description of Combined DNA/RNA Molecule: Synthetic oligonucleotide
tagctucttguccagctttattguu

SEQ ID NO: 1127 - DNA, 25 bp, Artificial Sequence
  Description of Artificial Sequence: Synthetic oligonucleotide
  Description of Combined DNA/RNA Molecule: Synthetic oligonucleotide
tagctucutgtccagctttattguu

SEQ ID NO: 1128 - DNA, 25 bp, Artificial Sequence
  Description of Artificial Sequence: Synthetic oligonucleotide
  Description of Combined DNA/RNA Molecule: Synthetic oligonucleotide
tagctucttgtccagctttattguu

SEQ ID NO: 1129 - DNA, 23 bp, Artificial Sequence
  Description of Artificial Sequence: Synthetic oligonucleotide
  Description of Combined DNA/RNA Molecule: Synthetic oligonucleotide
tagcuucuuguccagctttatuu

SEQ ID NO: 1130 - DNA, 21 bp, Artificial Sequence
  Description of Artificial Sequence: Synthetic oligonucleotide
  Description of Combined DNA/RNA Molecule: Synthetic oligonucleotide
tagcuucuuguccagctttuu

SEQ ID NO: 1131 - DNA, 25 bp, Artificial Sequence
  Description of Artificial Sequence: Synthetic oligonucleotide
  Description of Combined DNA/RNA Molecule: Synthetic oligonucleotide
tagctucutguccagctttattguu

SEQ ID NO: 1132 - DNA, 25 bp, Artificial Sequence
  Description of Artificial Sequence: Synthetic oligonucleotide
  Description of Combined DNA/RNA Molecule: Synthetic oligonucleotide
tagctucttguccagctttattguu

SEQ ID NO: 1133 - DNA, 21 bp, Artificial Sequence
  Description of Artificial Sequence: Synthetic oligonucleotide
  Description of Combined DNA/RNA Molecule: Synthetic oligonucleotide
tccucagucugcuucgcacuu

SEQ ID NO: 1134 - DNA, 21 bp, Artificial Sequence
  Description of Artificial Sequence: Synthetic oligonucleotide
  Description of Combined DNA/RNA Molecule: Synthetic oligonucleotide
tccucagucugctucgcacuu

SEQ ID NO: 1135 - DNA, 21 bp, Artificial Sequence
  Description of Artificial Sequence: Synthetic oligonucleotide
  Description of Combined DNA/RNA Molecule: Synthetic oligonucleotide
tccucagtcugctucgcacuu

SEQ ID NO: 1136 - DNA, 21 bp, Artificial Sequence
  Description of Artificial Sequence: Synthetic oligonucleotide
  Description of Combined DNA/RNA Molecule: Synthetic oligonucleotide
tccucagucugctucgcacuu

SEQ ID NO: 1137 - DNA, 21 bp, Artificial Sequence
  Description of Artificial Sequence: Synthetic oligonucleotide
  Description of Combined DNA/RNA Molecule: Synthetic oligonucleotide
tccucagtcugctucgcacuu

SEQ ID NO: 1138 - DNA, 21 bp, Artificial Sequence
  Description of Artificial Sequence: Synthetic oligonucleotide
  Description of Combined DNA/RNA Molecule: Synthetic oligonucleotide
tccucagucugcuucgcacuu

SEQ ID NO: 1139 - DNA, 21 bp, Artificial Sequence
  Description of Artificial Sequence: Synthetic oligonucleotide
  Description of Combined DNA/RNA Molecule: Synthetic oligonucleotide
tccucagucugctucgcacuu

SEQ ID NO: 1140 - DNA, 21 bp, Artificial Sequence
  Description of Artificial Sequence: Synthetic oligonucleotide
  Description of Combined DNA/RNA Molecule: Synthetic oligonucleotide
tccucagtcugctucgcacuu

SEQ ID NO: 1141 - DNA, 21 bp, Artificial Sequence
  Description of Artificial Sequence: Synthetic oligonucleotide
  Description of Combined DNA/RNA Molecule: Synthetic oligonucleotide
tccucagucugctucgcacuu

SEQ ID NO: 1142 - DNA, 21 bp, Artificial Sequence
  Description of Artificial Sequence: Synthetic oligonucleotide
  Description of Combined DNA/RNA Molecule: Synthetic oligonucleotide
tccucagtcugctucgcacuu

SEQ ID NO: 1143 - DNA, 25 bp, Artificial Sequence
  Description of Artificial Sequence: Synthetic oligonucleotide
  Description of Combined DNA/RNA Molecule: Synthetic oligonucleotide
tccucagucugcuucgcaccttcuu

SEQ ID NO: 1144 - DNA, 25 bp, Artificial Sequence
  Description of Artificial Sequence: Synthetic oligonucleotide
  Description of Combined DNA/RNA Molecule: Synthetic oligonucleotide
tccucagucugctucgcaccttcuu

SEQ ID NO: 1145 - DNA, 25 bp, Artificial Sequence
  Description of Artificial Sequence: Synthetic oligonucleotide
  Description of Combined DNA/RNA Molecule: Synthetic oligonucleotide
tccucagtcugctucgcaccttcuu

SEQ ID NO: 1146 - DNA, 23 bp, Artificial Sequence
  Description of Artificial Sequence: Synthetic oligonucleotide
  Description of Combined DNA/RNA Molecule: Synthetic oligonucleotide
tccucagucugcuucgcacctuu

SEQ ID NO: 1147 - DNA, 21 bp, Artificial Sequence
  Description of Artificial Sequence: Synthetic oligonucleotide
  Description of Combined DNA/RNA Molecule: Synthetic oligonucleotide
tccucagucugcuucgcacuu

SEQ ID NO: 1148 - DNA, 25 bp, Artificial Sequence
  Description of Artificial Sequence: Synthetic oligonucleotide
  Description of Combined DNA/RNA Molecule: Synthetic oligonucleotide
tccucagucugctucgcaccttcuu

SEQ ID NO: 1149 - DNA, 25 bp, Artificial Sequence
  Description of Artificial Sequence: Synthetic oligonucleotide
  Description of Combined DNA/RNA Molecule: Synthetic oligonucleotide
tccucagtcugctucgcaccttcuu

SEQ ID NO: 1150 - DNA, 25 bp, Artificial Sequence
  Description of Artificial Sequence: Synthetic oligonucleotide
  Description of Combined DNA/RNA Molecule: Synthetic oligonucleotide
tccucagucugcuucgcaccttcuu

SEQ ID NO: 1151 - DNA, 25 bp, Artificial Sequence
  Description of Artificial Sequence: Synthetic oligonucleotide
  Description of Combined DNA/RNA Molecule: Synthetic oligonucleotide
tccucagucugctucgcaccttcuu

SEQ ID NO: 1152 - DNA, 25 bp, Artificial Sequence
  Description of Artificial Sequence: Synthetic oligonucleotide
  Description of Combined DNA/RNA Molecule: Synthetic oligonucleotide
tccucagtcugctucgcaccttcuu

SEQ ID NO: 1153 - DNA, 23 bp, Artificial Sequence
  Description of Artificial Sequence: Synthetic oligonucleotide
  Description of Combined DNA/RNA Molecule: Synthetic oligonucleotide
tccucagucugcuucgcacctuu

SEQ ID NO: 1154 - DNA, 21 bp, Artificial Sequence
  Description of Artificial Sequence: Synthetic oligonucleotide
  Description of Combined DNA/RNA Molecule: Synthetic oligonucleotide
tccucagucugcuucgcacuu

SEQ ID NO: 1155 - DNA, 25 bp, Artificial Sequence
  Description of Artificial Sequence: Synthetic oligonucleotide
  Description of Combined DNA/RNA Molecule: Synthetic oligonucleotide
tccucagucugctucgcaccttcuu

SEQ ID NO: 1156 - DNA, 25 bp, Artificial Sequence
  Description of Artificial Sequence: Synthetic oligonucleotide
  Description of Combined DNA/RNA Molecule: Synthetic oligonucleotide
tccucagtcugctucgcaccttcuu

SEQ ID NO: 1157 - DNA, 21 bp, Artificial Sequence
  Description of Artificial Sequence: Synthetic oligonucleotide
  Description of Combined DNA/RNA Molecule: Synthetic oligonucleotide
tugcuucuuguccagcuuuuu

SEQ ID NO: 1158 - DNA, 21 bp, Artificial Sequence
  Description of Artificial Sequence: Synthetic oligonucleotide
  Description of Combined DNA/RNA Molecule: Synthetic oligonucleotide
tugcuucuuguccagcuuuuu

SEQ ID NO: 1159 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 1160 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 1161 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 1162 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 1163 - DNA, 21 bp, Artificial Sequence
  Description of Artificial Sequence: Synthetic oligonucleotide
  Description of Combined DNA/RNA Molecule: Synthetic oligonucleotide
tuccagcuuuauuagggacuu

SEQ ID NO: 1164 - DNA, 21 bp, Artificial Sequence
  Description of Artificial Sequence: Synthetic oligonucleotide
  Description of Combined DNA/RNA Molecule: Synthetic oligonucleotide
tuccagcutuautagggacuu

SEQ ID NO: 1165 - DNA, 20 bp, Artificial Sequence
  Description of Artificial Sequence: Synthetic oligonucleotide
tgtccagctttattgggagg

SEQ ID NO: 1166 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1167 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1168 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1169 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1170 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1171 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1172 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1173 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuuuu

SEQ ID NO: 1174 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuuuu

SEQ ID NO: 1175 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuuuu

SEQ ID NO: 1176 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuuuu

SEQ ID NO: 1177 - RNA, 20 nt, Artificial Sequence
  Description of Artificial Sequence: Synthetic oligonucleotide
agcuucuuguccagcuuuuu

SEQ ID NO: 1178 - RNA, 20 nt, Artificial Sequence
  Description of Artificial Sequence: Synthetic oligonucleotide
agcuucuuguccagcuuuuu

SEQ ID NO: 1179 - RNA, 20 nt, Artificial Sequence
  Description of Artificial Sequence: Synthetic oligonucleotide
agcuucuuguccagcuuuuu

SEQ ID NO: 1180 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1181 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1182 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1183 - DNA, 21 bp, Artificial Sequence
  Description of Artificial Sequence: Synthetic oligonucleotide
  Description of Combined DNA/RNA Molecule: Synthetic oligonucleotide
tauagcagcuucuuguccauu

SEQ ID NO: 1184 - DNA, 21 bp, Artificial Sequence
  Description of Artificial Sequence: Synthetic oligonucleotide
  Description of Combined DNA/RNA Molecule: Synthetic oligonucleotide
tuagcagcuucuuguccaguu

SEQ ID NO: 1185 - RNA, 21 nt, Artificial Sequence
  Description of Artificial Sequence: Synthetic oligonucleotide
aagcagcuucuuguccagcuu

SEQ ID NO: 1186 - DNA, 21 bp, Artificial Sequence
  Description of Artificial Sequence: Synthetic oligonucleotide
  Description of Combined DNA/RNA Molecule: Synthetic oligonucleotide
tgcagcuucuuguccagcuuu

SEQ ID NO: 1187 - DNA, 21 bp, Artificial Sequence
  Description of Artificial Sequence: Synthetic oligonucleotide
  Description of Combined DNA/RNA Molecule: Synthetic oligonucleotide
tcagcuucuuguccagcuuuu

SEQ ID NO: 1188 - DNA, 21 bp, Artificial Sequence
  Description of Artificial Sequence: Synthetic oligonucleotide
  Description of Combined DNA/RNA Molecule: Synthetic oligonucleotide
tgcuucuuguccagcuuuauu

SEQ ID NO: 1189 - DNA, 21 bp, Artificial Sequence
  Description of Artificial Sequence: Synthetic oligonucleotide
  Description of Combined DNA/RNA Molecule: Synthetic oligonucleotide
tcuucuuguccagcuuuauuu

SEQ ID NO: 1190 - DNA, 21 bp, Artificial Sequence
  Description of Artificial Sequence: Synthetic oligonucleotide
  Description of Combined DNA/RNA Molecule: Synthetic oligonucleotide
tuucuuguccagcuuuauuuu

SEQ ID NO: 1191 - RNA, 21 nt, Artificial Sequence
  Description of Artificial Sequence: Synthetic oligonucleotide
aucuuguccagcuuuauuguu

SEQ ID NO: 1192 - RNA, 21 nt, Artificial Sequence
  Description of Artificial Sequence: Synthetic oligonucleotide
acuuguccagcuuuauugguu

SEQ ID NO: 1193 - DNA, 21 bp, Artificial Sequence
  Description of Artificial Sequence: Synthetic oligonucleotide
  Description of Combined DNA/RNA Molecule: Synthetic oligonucleotide
tuuguccagcuuuauuggguu

SEQ ID NO: 1194 - RNA, 21 nt, Artificial Sequence
  Description of Artificial Sequence: Synthetic oligonucleotide
auguccagcuuuauugggauu

SEQ ID NO: 1195 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1196 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1197 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1198 - DNA, 21 bp, Artificial Sequence
  Description of Artificial Sequence: Synthetic oligonucleotide
  Description of Combined DNA/RNA Molecule: Synthetic oligonucleotide
uguccagcuuuauugggagtu

SEQ ID NO: 1199 - DNA, 21 bp, Artificial Sequence
  Description of Artificial Sequence: Synthetic oligonucleotide
  Description of Combined DNA/RNA Molecule: Synthetic oligonucleotide
uguccagcuuuauugggagtu

SEQ ID NO: 1200 - DNA, 25 bp, Artificial Sequence
  Description of Artificial Sequence: Synthetic oligonucleotide
  Description of Combined DNA/RNA Molecule: Synthetic oligonucleotide
uguccagcuuuauugggaggccatu

SEQ ID NO: 1201 - DNA, 25 bp, Artificial Sequence
  Description of Artificial Sequence: Synthetic oligonucleotide
  Description of Combined DNA/RNA Molecule: Synthetic oligonucleotide
uguccagcuuuauugggaggccatu

SEQ ID NO: 1202 - RNA, 19 nt, Artificial Sequence
  Description of Artificial Sequence: Synthetic oligonucleotide
uguccagcuuuauuggguu

SEQ ID NO: 1203 - DNA, 19 bp, Artificial Sequence
  Description of Artificial Sequence: Synthetic oligonucleotide
  Description of Combined DNA/RNA Molecule: Synthetic oligonucleotide
uguccagcuuuauugggtu

SEQ ID NO: 1204 - RNA, 17 nt, Artificial Sequence
  Description of Artificial Sequence: Synthetic oligonucleotide
uguccagcuuuauuguu

SEQ ID NO: 1205 - DNA, 17 bp, Artificial Sequence
  Description of Artificial Sequence: Synthetic oligonucleotide
  Description of Combined DNA/RNA Molecule: Synthetic oligonucleotide
uguccagcuuuauugtu

SEQ ID NO: 1206 - DNA, 21 bp, Artificial Sequence
  Description of Artificial Sequence: Synthetic oligonucleotide
  Description of Combined DNA/RNA Molecule: Synthetic oligonucleotide
tgtccagctutatugggaguu

SEQ ID NO: 1207 - DNA, 21 bp, Artificial Sequence
  Description of Artificial Sequence: Synthetic oligonucleotide
  Description of Combined DNA/RNA Molecule: Synthetic oligonucleotide
tgtccagctutatugggaguu

SEQ ID NO: 1208 - DNA, 21 bp, Artificial Sequence
  Description of Artificial Sequence: Synthetic oligonucleotide
  Description of Combined DNA/RNA Molecule: Synthetic oligonucleotide
tgtccagctuuatugggaguu

SEQ ID NO: 1209 - DNA, 21 bp, Artificial Sequence
  Description of Artificial Sequence: Synthetic oligonucleotide
  Description of Combined DNA/RNA Molecule: Synthetic oligonucleotide
tgtccagctuuatugggaguu

SEQ ID NO: 1210 - RNA, 21 nt, Artificial Sequence
  Description of Artificial Sequence: Synthetic oligonucleotide
aguccagcuuuauugggaguu

SEQ ID NO: 1211 - RNA, 21 nt, Artificial Sequence
  Description of Artificial Sequence: Synthetic oligonucleotide
aguccagcuuuauugggaguu

SEQ ID NO: 1212 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1213 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1214 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1215 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1216 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1217 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1218 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1219 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1220 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1221 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1222 - DNA, 25 bp, Artificial Sequence
  Description of Artificial Sequence: Synthetic oligonucleotide
  Description of Combined DNA/RNA Molecule: Synthetic oligonucleotide
tguccagcuuuauugggaggccatu

SEQ ID NO: 1223 - DNA, 25 bp, Artificial Sequence
  Description of Artificial Sequence: Synthetic oligonucleotide
  Description of Combined DNA/RNA Molecule: Synthetic oligonucleotide
tguccagcuuuauugggaggccatu

SEQ ID NO: 1224 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1225 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1226 - DNA, 25 bp, Artificial Sequence
  Description of Artificial Sequence: Synthetic oligonucleotide
  Description of Combined DNA/RNA Molecule: Synthetic oligonucleotide
tguccagcuuuauugggaggccatu

SEQ ID NO: 1227 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1228 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1229 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1230 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1231 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1232 - DNA, 21 bp, Artificial Sequence
  Description of Artificial Sequence: Synthetic oligonucleotide
  Description of Combined DNA/RNA Molecule: Synthetic oligonucleotide
tauagcagcuucuuguccatu

SEQ ID NO: 1233 - DNA, 21 bp, Artificial Sequence
  Description of Artificial Sequence: Synthetic oligonucleotide
  Description of Combined DNA/RNA Molecule: Synthetic oligonucleotide
tuagcagcuucuuguccagtu

SEQ ID NO: 1234 - DNA, 21 bp, Artificial Sequence
  Description of Artificial Sequence: Synthetic oligonucleotide
  Description of Combined DNA/RNA Molecule: Synthetic oligonucleotide
tagcagcuucuuguccagctu

SEQ ID NO: 1235 - DNA, 21 bp, Artificial Sequence
  Description of Artificial Sequence: Synthetic oligonucleotide
  Description of Combined DNA/RNA Molecule: Synthetic oligonucleotide
tgcagcuucuuguccagcutu

SEQ ID NO: 1236 - DNA, 21 bp, Artificial Sequence
  Description of Artificial Sequence: Synthetic oligonucleotide
  Description of Combined DNA/RNA Molecule: Synthetic oligonucleotide
tcagcuucuuguccagcuutu

SEQ ID NO: 1237 - DNA, 21 bp, Artificial Sequence
  Description of Artificial Sequence: Synthetic oligonucleotide
  Description of Combined DNA/RNA Molecule: Synthetic oligonucleotide
tgcuucuuguccagcuuuatu

SEQ ID NO: 1238 - DNA, 21 bp, Artificial Sequence
  Description of Artificial Sequence: Synthetic oligonucleotide
  Description of Combined DNA/RNA Molecule: Synthetic oligonucleotide
tcuucuuguccagcuuuautu

SEQ ID NO: 1239 - DNA, 21 bp, Artificial Sequence
  Description of Artificial Sequence: Synthetic oligonucleotide
  Description of Combined DNA/RNA Molecule: Synthetic oligonucleotide
tuucuuguccagcuuuauutu

SEQ ID NO: 1240 - DNA, 21 bp, Artificial Sequence
  Description of Artificial Sequence: Synthetic oligonucleotide
  Description of Combined DNA/RNA Molecule: Synthetic oligonucleotide
tucuuguccagcuuuauugtu

SEQ ID NO: 1241 - DNA, 21 bp, Artificial Sequence
  Description of Artificial Sequence: Synthetic oligonucleotide
  Description of Combined DNA/RNA Molecule: Synthetic oligonucleotide
tcuuguccagcuuuauuggtu

SEQ ID NO: 1242 - DNA, 21 bp, Artificial Sequence
  Description of Artificial Sequence: Synthetic oligonucleotide
  Description of Combined DNA/RNA Molecule: Synthetic oligonucleotide
tuuguccagcuuuauugggtu

SEQ ID NO: 1243 - DNA, 21 bp, Artificial Sequence
  Description of Artificial Sequence: Synthetic oligonucleotide
  Description of Combined DNA/RNA Molecule: Synthetic oligonucleotide
tuguccagcuuuauugggatu

SEQ ID NO: 1244 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1245 - DNA, 21 bp, Artificial Sequence
  Description of Artificial Sequence: Synthetic oligonucleotide
  Description of Combined DNA/RNA Molecule: Synthetic oligonucleotide
tggucucaggcagccacggtu

SEQ ID NO: 1246 - DNA, 21 bp, Artificial Sequence
  Description of Artificial Sequence: Synthetic oligonucleotide
  Description of Combined DNA/RNA Molecule: Synthetic oligonucleotide
tauagcagcuucuuguccatu

SEQ ID NO: 1247 - DNA, 21 bp, Artificial Sequence
  Description of Artificial Sequence: Synthetic oligonucleotide
  Description of Combined DNA/RNA Molecule: Synthetic oligonucleotide
tuagcagcuucuuguccagtu

SEQ ID NO: 1248 - DNA, 21 bp, Artificial Sequence
  Description of Artificial Sequence: Synthetic oligonucleotide
  Description of Combined DNA/RNA Molecule: Synthetic oligonucleotide
tagcagcuucuuguccagctu

SEQ ID NO: 1249 - DNA, 21 bp, Artificial Sequence
  Description of Artificial Sequence: Synthetic oligonucleotide
  Description of Combined DNA/RNA Molecule: Synthetic oligonucleotide
tgcagcuucuuguccagcutu

SEQ ID NO: 1250 - DNA, 21 bp, Artificial Sequence
  Description of Artificial Sequence: Synthetic oligonucleotide
  Description of Combined DNA/RNA Molecule: Synthetic oligonucleotide
tcagcuucuuguccagcuutu

SEQ ID NO: 1251 - DNA, 21 bp, Artificial Sequence
  Description of Artificial Sequence: Synthetic oligonucleotide
  Description of Combined DNA/RNA Molecule: Synthetic oligonucleotide
tgcuucuuguccagcuuuatu

SEQ ID NO: 1252 - DNA, 21 bp, Artificial Sequence
  Description of Artificial Sequence: Synthetic oligonucleotide
  Description of Combined DNA/RNA Molecule: Synthetic oligonucleotide
tcuucuuguccagcuuuautu

SEQ ID NO: 1253 - DNA, 21 bp, Artificial Sequence
  Description of Artificial Sequence: Synthetic oligonucleotide
  Description of Combined DNA/RNA Molecule: Synthetic oligonucleotide
tuucuuguccagcuuuauutu

SEQ ID NO: 1254 - DNA, 21 bp, Artificial Sequence
  Description of Artificial Sequence: Synthetic oligonucleotide
  Description of Combined DNA/RNA Molecule: Synthetic oligonucleotide
tucuuguccagcuuuauugtu

SEQ ID NO: 1255 - DNA, 21 bp, Artificial Sequence
  Description of Artificial Sequence: Synthetic oligonucleotide
  Description of Combined DNA/RNA Molecule: Synthetic oligonucleotide
tcuuguccagcuuuauuggtu

SEQ ID NO: 1256 - DNA, 21 bp, Artificial Sequence
  Description of Artificial Sequence: Synthetic oligonucleotide
  Description of Combined DNA/RNA Molecule: Synthetic oligonucleotide
tuuguccagcuuuauugggtu

SEQ ID NO: 1257 - DNA, 21 bp, Artificial Sequence
  Description of Artificial Sequence: Synthetic oligonucleotide
  Description of Combined DNA/RNA Molecule: Synthetic oligonucleotide
tuguccagcuuuauugggatu

SEQ ID NO: 1258 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1259 - DNA, 21 bp, Artificial Sequence
  Description of Artificial Sequence: Synthetic oligonucleotide
  Description of Combined DNA/RNA Molecule: Synthetic oligonucleotide
tggucucaggcagccacggtu

SEQ ID NO: 1260 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1261 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1262 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1263 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1264 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1265 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1266 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1267 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1268 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1269 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1270 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1271 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1272 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1273 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1274 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1275 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1276 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1277 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1278 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1279 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1280 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1281 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1282 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1283 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1284 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1285 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1286 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1287 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1288 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1289 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1290 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1291 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1292 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1293 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1294 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1295 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1296 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1297 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1298 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1299 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1300 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1301 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1302 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1303 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1304 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1305 - RNA, 20 nt, Artificial Sequence
  Description of Artificial Sequence: Synthetic oligonucleotide
ccucccaauaaagcuggaca

SEQ ID NO: 1306 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1307 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1308 - DNA, 20 bp, Artificial Sequence
  Description of Artificial Sequence: Synthetic oligonucleotide
tgtccagctttattgggagg

SEQ ID NO: 1309 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 1310 - DNA, 20 bp, Artificial Sequence
  Description of Artificial Sequence: Synthetic oligonucleotide
agcttcttgtccagctttat

SEQ ID NO: 1311 - RNA, 24 nt, Artificial Sequence
  Description of Artificial Sequence: Synthetic oligonucleotide
ccaccaagaccgccaaggaugcac

SEQ ID NO: 1312 - RNA, 24 nt, Artificial Sequence
  Description of Artificial Sequence: Synthetic oligonucleotide
accgccaaggaugcacugagcagc

SEQ ID NO: 1313 - RNA, 24 nt, Artificial Sequence
  Description of Artificial Sequence: Synthetic oligonucleotide
agcagcgugcaggagucccaggug

SEQ ID NO: 1314 - RNA, 24 nt, Artificial Sequence
  Description of Artificial Sequence: Synthetic oligonucleotide
ggagucccagguggcccagcaggc

SEQ ID NO: 1315 - RNA, 24 nt, Artificial Sequence
  Description of Artificial Sequence: Synthetic oligonucleotide
caggggcugggugaccgauggcuu

SEQ ID NO: 1316 - RNA, 24 nt, Artificial Sequence
  Description of Artificial Sequence: Synthetic oligonucleotide
ggcugggugaccgauggcuucagu

SEQ ID NO: 1317 - RNA, 24 nt, Artificial Sequence
  Description of Artificial Sequence: Synthetic oligonucleotide
cuggagcaccguuaaggacaaguu

SEQ ID NO: 1318 - RNA, 24 nt, Artificial Sequence
  Description of Artificial Sequence: Synthetic oligonucleotide
cagccguggcugccugagaccuca

SEQ ID NO: 1319 - RNA, 24 nt, Artificial Sequence
  Description of Artificial Sequence: Synthetic oligonucleotide
gccguggcugccugagaccucaau

SEQ ID NO: 1320 - RNA, 25 nt, Artificial Sequence
  Description of Artificial Sequence: Synthetic oligonucleotide
cuuggguccugcaaucuccagggcu

SEQ ID NO: 1321 - RNA, 24 nt, Artificial Sequence
  Description of Artificial Sequence: Synthetic oligonucleotide
cuggccucccaauaaagcuggaca

SEQ ID NO: 1322 - RNA, 24 nt, Artificial Sequence
  Description of Artificial Sequence: Synthetic oligonucleotide
ggccucccaauaaagcuggacaag

SEQ ID NO: 1323 - RNA, 32 nt, Artificial Sequence
  Description of Artificial Sequence: Synthetic oligonucleotide
augcacugagcagcgugcaggagucccaggug

SEQ ID NO: 1324 - RNA, 31 nt, Artificial Sequence
  Description of Artificial Sequence: Synthetic oligonucleotide
ggccaggggcugggugaccgauggcuucagu

SEQ ID NO: 1325 - RNA, 30 nt, Artificial Sequence
  Description of Artificial Sequence: Synthetic oligonucleotide
cuucagccguggcugccugagaccucaaua

SEQ ID NO: 1326 - RNA, 29 nt, Artificial Sequence
  Description of Artificial Sequence: Synthetic oligonucleotide
cuccuuggguccugcaacuccagggcugc

SEQ ID NO: 1327 - RNA, 30 nt, Artificial Sequence
  Description of Artificial Sequence: Synthetic oligonucleotide
gcuggccucccaauaaagcuggacaagaag

SEQ ID NO: 1328 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggaguu

SEQ ID NO: 1329 - DNA, 21 bp, Artificial Sequence
  Description of Artificial Sequence: Synthetic oligonucleotide
  Description of Combined DNA/RNA Molecule: Synthetic oligonucleotide
aguccagcuuuauugggagtu

SEQ ID NO: 1330 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggaguu

SEQ ID NO: 1331 - DNA, 21 bp, Artificial Sequence
  Description of Artificial Sequence: Synthetic oligonucleotide
  Description of Combined DNA/RNA Molecule: Synthetic oligonucleotide
aguccagcuuuauugggagtu

SEQ ID NO: 1332 - DNA, 20 bp, Artificial Sequence
  Description of Artificial Sequence: Synthetic oligonucleotide
  Description of Combined DNA/RNA Molecule: Synthetic oligonucleotide
guccagcuuuauugggagtu

SEQ ID NO: 1333 - DNA, 20 bp, Artificial Sequence
  Description of Artificial Sequence: Synthetic oligonucleotide
  Description of Combined DNA/RNA Molecule: Synthetic oligonucleotide
guccagcuuuauugggagtu

SEQ ID NO: 1334 - DNA, 20 bp, Artificial Sequence
  Description of Artificial Sequence: Synthetic oligonucleotide
  Description of Combined DNA/RNA Molecule: Synthetic oligonucleotide
guccagcuuuauugggagtu

SEQ ID NO: 1335 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1336 - DNA, 20 bp, Artificial Sequence
  Description of Artificial Sequence: Synthetic oligonucleotide
tgtccagctttattgggagg

SEQ ID NO: 1337 - DNA, 20 bp, Artificial Sequence
  Description of Artificial Sequence: Synthetic oligonucleotide
agcttcttgtccagctttat

SEQ ID NO: 1338 - DNA, 20 bp, Artificial Sequence
  Description of Artificial Sequence: Synthetic oligonucleotide
tgtccagctttattgggagg

SEQ ID NO: 1339 - DNA, 20 bp, Artificial Sequence
  Description of Artificial Sequence: Synthetic oligonucleotide
agcttcttgtccagctttat

SEQ ID NO: 1340 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 1341 - DNA, 20 bp, Artificial Sequence
  Description of Artificial Sequence: Synthetic oligonucleotide
  Description of Combined DNA/RNA Molecule: Synthetic oligonucleotide
gcauccttggcggtcuuggu

SEQ ID NO: 1342 - DNA, 20 bp, Artificial Sequence
  Description of Artificial Sequence: Synthetic oligonucleotide
  Description of Combined DNA/RNA Molecule: Synthetic oligonucleotide
ugcucagtgcatcctuggcg

SEQ ID NO: 1343 - DNA, 20 bp, Artificial Sequence
  Description of Artificial Sequence: Synthetic oligonucleotide
  Description of Combined DNA/RNA Molecule: Synthetic oligonucleotide
ccugggactcctgcacgcug

SEQ ID NO: 1344 - DNA, 20 bp, Artificial Sequence
  Description of Artificial Sequence: Synthetic oligonucleotide
  Description of Combined DNA/RNA Molecule: Synthetic oligonucleotide
cugcugggccacctgggacu

SEQ ID NO: 1345 - DNA, 20 bp, Artificial Sequence
  Description of Artificial Sequence: Synthetic oligonucleotide
  Description of Combined DNA/RNA Molecule: Synthetic oligonucleotide
gccaucggtcacccagcccc

SEQ ID NO: 1346 - DNA, 20 bp, Artificial Sequence
  Description of Artificial Sequence: Synthetic oligonucleotide
  Description of Combined DNA/RNA Molecule: Synthetic oligonucleotide
ugaagccatcggtcacccag

SEQ ID NO: 1347 - DNA, 20 bp, Artificial Sequence
  Description of Artificial Sequence: Synthetic oligonucleotide
  Description of Combined DNA/RNA Molecule: Synthetic oligonucleotide
cuuguccttaacggtgcucc

SEQ ID NO: 1348 - DNA, 20 bp, Artificial Sequence
  Description of Artificial Sequence: Synthetic oligonucleotide
  Description of Combined DNA/RNA Molecule: Synthetic oligonucleotide
agguctcaggcagccacggc

SEQ ID NO: 1349 - DNA, 20 bp, Artificial Sequence
  Description of Artificial Sequence: Synthetic oligonucleotide
  Description of Combined DNA/RNA Molecule: Synthetic oligonucleotide
ugaggtctcaggcagccacg

SEQ ID NO: 1350 - DNA, 20 bp, Artificial Sequence
  Description of Artificial Sequence: Synthetic oligonucleotide
  Description of Combined DNA/RNA Molecule: Synthetic oligonucleotide
ccuggagattgcaggaccca

SEQ ID NO: 1351 - DNA, 20 bp, Artificial Sequence
  Description of Artificial Sequence: Synthetic oligonucleotide
  Description of Combined DNA/RNA Molecule: Synthetic oligonucleotide
uccagctttattgggaggcc

SEQ ID NO: 1352 - DNA, 20 bp, Artificial Sequence
  Description of Artificial Sequence: Synthetic oligonucleotide
  Description of Combined DNA/RNA Molecule: Synthetic oligonucleotide
cuuguccagctttatuggga

SEQ ID NO: 1353 - DNA, 20 bp, Artificial Sequence
  Description of Artificial Sequence: Synthetic oligonucleotide
agcttcttgtccagctttat

SEQ ID NO: 1354 - DNA, 21 bp, Artificial Sequence
  Description of Artificial Sequence: Synthetic oligonucleotide
  Description of Combined DNA/RNA Molecule: Synthetic oligonucleotide
tccagcuuuauugggaggctu

SEQ ID NO: 1355 - DNA, 21 bp, Artificial Sequence
  Description of Artificial Sequence: Synthetic oligonucleotide
  Description of Combined DNA/RNA Molecule: Synthetic oligonucleotide
tcccuggagauugcaggactu

SEQ ID NO: 1356 - DNA, 21 bp, Artificial Sequence
  Description of Artificial Sequence: Synthetic oligonucleotide
  Description of Combined DNA/RNA Molecule: Synthetic oligonucleotide
tcuggagauugcaggaccctu

SEQ ID NO: 1357 - DNA, 21 bp, Artificial Sequence
  Description of Artificial Sequence: Synthetic oligonucleotide
  Description of Combined DNA/RNA Molecule: Synthetic oligonucleotide
tgaggucucaggcagccactu

SEQ ID NO: 1358 - DNA, 21 bp, Artificial Sequence
  Description of Artificial Sequence: Synthetic oligonucleotide
  Description of Combined DNA/RNA Molecule: Synthetic oligonucleotide
taggucucaggcagccacgtu

SEQ ID NO: 1359 - DNA, 21 bp, Artificial Sequence
  Description of Artificial Sequence: Synthetic oligonucleotide
  Description of Combined DNA/RNA Molecule: Synthetic oligonucleotide
tggucucaggcagccacggtu

SEQ ID NO: 1360 - DNA, 21 bp, Artificial Sequence
  Description of Artificial Sequence: Synthetic oligonucleotide
  Description of Combined DNA/RNA Molecule: Synthetic oligonucleotide
tucucaggcagccacggcutu

SEQ ID NO: 1361 - DNA, 21 bp, Artificial Sequence
  Description of Artificial Sequence: Synthetic oligonucleotide
  Description of Combined DNA/RNA Molecule: Synthetic oligonucleotide
tccaucggucacccagccctu

SEQ ID NO: 1362 - DNA, 21 bp, Artificial Sequence
  Description of Artificial Sequence: Synthetic oligonucleotide
  Description of Combined DNA/RNA Molecule: Synthetic oligonucleotide
tcugggacuccugcacgcutu

SEQ ID NO: 1363 - DNA, 21 bp, Artificial Sequence
  Description of Artificial Sequence: Synthetic oligonucleotide
  Description of Combined DNA/RNA Molecule: Synthetic oligonucleotide
tgcucagugcauccuuggctu

SEQ ID NO: 1364 - DNA, 21 bp, Artificial Sequence
  Description of Artificial Sequence: Synthetic oligonucleotide
  Description of Combined DNA/RNA Molecule: Synthetic oligonucleotide
tgcauccuuggcggucuugtu

SEQ ID NO: 1365 - DNA, 21 bp, Artificial Sequence
  Description of Artificial Sequence: Synthetic oligonucleotide
  Description of Combined DNA/RNA Molecule: Synthetic oligonucleotide
tccagcuuuauugggaggctu

SEQ ID NO: 1366 - DNA, 21 bp, Artificial Sequence
  Description of Artificial Sequence: Synthetic oligonucleotide
  Description of Combined DNA/RNA Molecule: Synthetic oligonucleotide
tcccuggagauugcaggactu

SEQ ID NO: 1367 - DNA, 21 bp, Artificial Sequence
  Description of Artificial Sequence: Synthetic oligonucleotide
  Description of Combined DNA/RNA Molecule: Synthetic oligonucleotide
tcuggagauugcaggaccctu

SEQ ID NO: 1368 - DNA, 21 bp, Artificial Sequence
  Description of Artificial Sequence: Synthetic oligonucleotide
  Description of Combined DNA/RNA Molecule: Synthetic oligonucleotide
tgaggucucaggcagccactu

SEQ ID NO: 1369 - DNA, 21 bp, Artificial Sequence
  Description of Artificial Sequence: Synthetic oligonucleotide
  Description of Combined DNA/RNA Molecule: Synthetic oligonucleotide
taggucucaggcagccacgtu

SEQ ID NO: 1370 - DNA, 21 bp, Artificial Sequence
  Description of Artificial Sequence: Synthetic oligonucleotide
  Description of Combined DNA/RNA Molecule: Synthetic oligonucleotide
tggucucaggcagccacggtu

SEQ ID NO: 1371 - DNA, 21 bp, Artificial Sequence
  Description of Artificial Sequence: Synthetic oligonucleotide
  Description of Combined DNA/RNA Molecule: Synthetic oligonucleotide
tucucaggcagccacggcutu

SEQ ID NO: 1372 - DNA, 21 bp, Artificial Sequence
  Description of Artificial Sequence: Synthetic oligonucleotide
  Description of Combined DNA/RNA Molecule: Synthetic oligonucleotide
tccaucggucacccagccctu

SEQ ID NO: 1373 - DNA, 21 bp, Artificial Sequence
  Description of Artificial Sequence: Synthetic oligonucleotide
  Description of Combined DNA/RNA Molecule: Synthetic oligonucleotide
tcugggacuccugcacgcutu

SEQ ID NO: 1374 - DNA, 21 bp, Artificial Sequence
  Description of Artificial Sequence: Synthetic oligonucleotide
  Description of Combined DNA/RNA Molecule: Synthetic oligonucleotide
tgcucagugcauccuuggctu

SEQ ID NO: 1375 - DNA, 21 bp, Artificial Sequence
  Description of Artificial Sequence: Synthetic oligonucleotide
  Description of Combined DNA/RNA Molecule: Synthetic oligonucleotide
tgcauccuuggcggucuugtu

SEQ ID NO: 1376 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1377 - DNA, 21 bp, Artificial Sequence
  Description of Artificial Sequence: Synthetic oligonucleotide
  Description of Combined DNA/RNA Molecule: Synthetic oligonucleotide
tccagcuuuauugggaggctu

SEQ ID NO: 1378 - DNA, 21 bp, Artificial Sequence
  Description of Artificial Sequence: Synthetic oligonucleotide
  Description of Combined DNA/RNA Molecule: Synthetic oligonucleotide
tcccuggagauugcaggactu

SEQ ID NO: 1379 - DNA, 21 bp, Artificial Sequence
  Description of Artificial Sequence: Synthetic oligonucleotide
  Description of Combined DNA/RNA Molecule: Synthetic oligonucleotide
tcuggagauugcaggaccctu

SEQ ID NO: 1380 - DNA, 21 bp, Artificial Sequence
  Description of Artificial Sequence: Synthetic oligonucleotide
  Description of Combined DNA/RNA Molecule: Synthetic oligonucleotide
tgaggucucaggcagccactu

SEQ ID NO: 1381 - DNA, 21 bp, Artificial Sequence
  Description of Artificial Sequence: Synthetic oligonucleotide
  Description of Combined DNA/RNA Molecule: Synthetic oligonucleotide
taggucucaggcagccacgtu

SEQ ID NO: 1382 - DNA, 21 bp, Artificial Sequence
  Description of Artificial Sequence: Synthetic oligonucleotide
  Description of Combined DNA/RNA Molecule: Synthetic oligonucleotide
tggucucaggcagccacggtu

SEQ ID NO: 1383 - DNA, 21 bp, Artificial Sequence
  Description of Artificial Sequence: Synthetic oligonucleotide
  Description of Combined DNA/RNA Molecule: Synthetic oligonucleotide
tucucaggcagccacggcutu

SEQ ID NO: 1384 - DNA, 21 bp, Artificial Sequence
  Description of Artificial Sequence: Synthetic oligonucleotide
  Description of Combined DNA/RNA Molecule: Synthetic oligonucleotide
tccaucggucacccagccctu

SEQ ID NO: 1385 - DNA, 21 bp, Artificial Sequence
  Description of Artificial Sequence: Synthetic oligonucleotide
  Description of Combined DNA/RNA Molecule: Synthetic oligonucleotide
tcugggacuccugcacgcutu

SEQ ID NO: 1386 - DNA, 21 bp, Artificial Sequence
  Description of Artificial Sequence: Synthetic oligonucleotide
  Description of Combined DNA/RNA Molecule: Synthetic oligonucleotide
tgcucagugcauccuuggctu

SEQ ID NO: 1387 - DNA, 21 bp, Artificial Sequence
  Description of Artificial Sequence: Synthetic oligonucleotide
  Description of Combined DNA/RNA Molecule: Synthetic oligonucleotide
tgcauccuuggcggucuugtu

SEQ ID NO: 1388 - DNA, 21 bp, Artificial Sequence
  Description of Artificial Sequence: Synthetic oligonucleotide
  Description of Combined DNA/RNA Molecule: Synthetic oligonucleotide
tccagcuuuauugggaggctu

SEQ ID NO: 1389 - DNA, 21 bp, Artificial Sequence
  Description of Artificial Sequence: Synthetic oligonucleotide
  Description of Combined DNA/RNA Molecule: Synthetic oligonucleotide
tcccuggagauugcaggactu

SEQ ID NO: 1390 - DNA, 21 bp, Artificial Sequence
  Description of Artificial Sequence: Synthetic oligonucleotide
  Description of Combined DNA/RNA Molecule: Synthetic oligonucleotide
tcuggagauugcaggaccctu

SEQ ID NO: 1391 - DNA, 21 bp, Artificial Sequence
  Description of Artificial Sequence: Synthetic oligonucleotide
  Description of Combined DNA/RNA Molecule: Synthetic oligonucleotide
tgaggucucaggcagccactu

SEQ ID NO: 1392 - DNA, 21 bp, Artificial Sequence
  Description of Artificial Sequence: Synthetic oligonucleotide
  Description of Combined DNA/RNA Molecule: Synthetic oligonucleotide
taggucucaggcagccacgtu

SEQ ID NO: 1393 - DNA, 21 bp, Artificial Sequence
  Description of Artificial Sequence: Synthetic oligonucleotide
  Description of Combined DNA/RNA Molecule: Synthetic oligonucleotide
tucucaggcagccacggcutu

SEQ ID NO: 1394 - DNA, 21 bp, Artificial Sequence
  Description of Artificial Sequence: Synthetic oligonucleotide
  Description of Combined DNA/RNA Molecule: Synthetic oligonucleotide
tccaucggucacccagccctu

SEQ ID NO: 1395 - DNA, 21 bp, Artificial Sequence
  Description of Artificial Sequence: Synthetic oligonucleotide
  Description of Combined DNA/RNA Molecule: Synthetic oligonucleotide
tcugggacuccugcacgcutu

SEQ ID NO: 1396 - DNA, 21 bp, Artificial Sequence
  Description of Artificial Sequence: Synthetic oligonucleotide
  Description of Combined DNA/RNA Molecule: Synthetic oligonucleotide
tgcucagugcauccuuggctu

SEQ ID NO: 1397 - DNA, 21 bp, Artificial Sequence
  Description of Artificial Sequence: Synthetic oligonucleotide
  Description of Combined DNA/RNA Molecule: Synthetic oligonucleotide
tgcauccuuggcggucuugtu

SEQ ID NO: 1398 - DNA, 21 bp, Artificial Sequence
  Description of Artificial Sequence: Synthetic oligonucleotide
tcactgagaatactgtcccaa

SEQ ID NO: 1399 - DNA, 21 bp, Artificial Sequence
  Description of Artificial Sequence: Synthetic oligonucleotide
tcactgagaatactgtcccaa

SEQ ID NO: 1400 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 1401 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 1402 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 1403 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 1404 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 1405 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 1406 - DNA, 20 bp, Artificial Sequence
  Description of Artificial Sequence: Synthetic oligonucleotide
  Description of Combined DNA/RNA Molecule: Synthetic oligonucleotide
gcauccttggcggtcuuggu

SEQ ID NO: 1407 - DNA, 20 bp, Artificial Sequence
  Description of Artificial Sequence: Synthetic oligonucleotide
  Description of Combined DNA/RNA Molecule: Synthetic oligonucleotide
ugcucagtgcatcctuggcg

SEQ ID NO: 1408 - DNA, 20 bp, Artificial Sequence
  Description of Artificial Sequence: Synthetic oligonucleotide
  Description of Combined DNA/RNA Molecule: Synthetic oligonucleotide
ccugggactcctgcacgcug

SEQ ID NO: 1409 - DNA, 20 bp, Artificial Sequence
  Description of Artificial Sequence: Synthetic oligonucleotide
  Description of Combined DNA/RNA Molecule: Synthetic oligonucleotide
cugcugggccacctgggacu

SEQ ID NO: 1410 - DNA, 20 bp, Artificial Sequence
  Description of Artificial Sequence: Synthetic oligonucleotide
  Description of Combined DNA/RNA Molecule: Synthetic oligonucleotide
gccaucggtcacccagcccc

SEQ ID NO: 1411 - DNA, 20 bp, Artificial Sequence
  Description of Artificial Sequence: Synthetic oligonucleotide
  Description of Combined DNA/RNA Molecule: Synthetic oligonucleotide
ugaagccatcggtcacccag

SEQ ID NO: 1412 - DNA, 20 bp, Artificial Sequence
  Description of Artificial Sequence: Synthetic oligonucleotide
  Description of Combined DNA/RNA Molecule: Synthetic oligonucleotide
cuuguccttaacggtgcucc

SEQ ID NO: 1413 - DNA, 20 bp, Artificial Sequence
  Description of Artificial Sequence: Synthetic oligonucleotide
  Description of Combined DNA/RNA Molecule: Synthetic oligonucleotide
agguctcaggcagccacggc

SEQ ID NO: 1414 - DNA, 20 bp, Artificial Sequence
  Description of Artificial Sequence: Synthetic oligonucleotide
  Description of Combined DNA/RNA Molecule: Synthetic oligonucleotide
ugaggtctcaggcagccacg

SEQ ID NO: 1415 - DNA, 20 bp, Artificial Sequence
  Description of Artificial Sequence: Synthetic oligonucleotide
  Description of Combined DNA/RNA Molecule: Synthetic oligonucleotide
ccuggagattgcaggaccca

SEQ ID NO: 1416 - DNA, 20 bp, Artificial Sequence
  Description of Artificial Sequence: Synthetic oligonucleotide
  Description of Combined DNA/RNA Molecule: Synthetic oligonucleotide
uccagctttattgggaggcc

SEQ ID NO: 1417 - DNA, 20 bp, Artificial Sequence
  Description of Artificial Sequence: Synthetic oligonucleotide
  Description of Combined DNA/RNA Molecule: Synthetic oligonucleotide
cuuguccagctttatuggga

SEQ ID NO: 1418 - DNA, 20 bp, Artificial Sequence
  Description of Artificial Sequence: Synthetic oligonucleotide
  Description of Combined DNA/RNA Molecule: Synthetic oligonucleotide
gcauccttggcggtcuuggu

SEQ ID NO: 1419 - DNA, 20 bp, Artificial Sequence
  Description of Artificial Sequence: Synthetic oligonucleotide
  Description of Combined DNA/RNA Molecule: Synthetic oligonucleotide
ugcucagtgcatcctuggcg

SEQ ID NO: 1420 - DNA, 20 bp, Artificial Sequence
  Description of Artificial Sequence: Synthetic oligonucleotide
  Description of Combined DNA/RNA Molecule: Synthetic oligonucleotide
ccugggactcctgcacgcug

SEQ ID NO: 1421 - DNA, 20 bp, Artificial Sequence
  Description of Artificial Sequence: Synthetic oligonucleotide
  Description of Combined DNA/RNA Molecule: Synthetic oligonucleotide
cugcugggccacctgggacu

SEQ ID NO: 1422 - DNA, 20 bp, Artificial Sequence
  Description of Artificial Sequence: Synthetic oligonucleotide
  Description of Combined DNA/RNA Molecule: Synthetic oligonucleotide
gccaucggtcacccagcccc

SEQ ID NO: 1423 - DNA, 20 bp, Artificial Sequence
  Description of Artificial Sequence: Synthetic oligonucleotide
  Description of Combined DNA/RNA Molecule: Synthetic oligonucleotide
ugaagccatcggtcacccag

SEQ ID NO: 1424 - DNA, 20 bp, Artificial Sequence
  Description of Artificial Sequence: Synthetic oligonucleotide
  Description of Combined DNA/RNA Molecule: Synthetic oligonucleotide
cuuguccttaacggtgcucc

SEQ ID NO: 1425 - DNA, 20 bp, Artificial Sequence
  Description of Artificial Sequence: Synthetic oligonucleotide
  Description of Combined DNA/RNA Molecule: Synthetic oligonucleotide
agguctcaggcagccacggc

SEQ ID NO: 1426 - DNA, 20 bp, Artificial Sequence
  Description of Artificial Sequence: Synthetic oligonucleotide
  Description of Combined DNA/RNA Molecule: Synthetic oligonucleotide
ugaggtctcaggcagccacg

SEQ ID NO: 1427 - DNA, 20 bp, Artificial Sequence
  Description of Artificial Sequence: Synthetic oligonucleotide
  Description of Combined DNA/RNA Molecule: Synthetic oligonucleotide
ccuggagattgcaggaccca

SEQ ID NO: 1428 - DNA, 20 bp, Artificial Sequence
  Description of Artificial Sequence: Synthetic oligonucleotide
  Description of Combined DNA/RNA Molecule: Synthetic oligonucleotide
uccagctttattgggaggcc

SEQ ID NO: 1429 - DNA, 20 bp, Artificial Sequence
  Description of Artificial Sequence: Synthetic oligonucleotide
  Description of Combined DNA/RNA Molecule: Synthetic oligonucleotide
cuuguccagctttatuggga

SEQ ID NO: 1430 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1431 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1432 - DNA, 30 bp, Artificial Sequence; identical to SEQ ID NO: 50
  Description of Artificial Sequence: Synthetic oligonucleotide

SEQ ID NO: 1433 - RNA, 29 nt, Artificial Sequence
  Description of Artificial Sequence: Synthetic oligonucleotide
gcacugagcagcgugcaggagucccaggu

SEQ ID NO: 1434 - RNA, 26 nt, Artificial Sequence
  Description of Artificial Sequence: Synthetic oligonucleotide
gcaggagucccagguggcccagcagg

SEQ ID NO: 1435 - RNA, 30 nt, Artificial Sequence
  Description of Artificial Sequence: Synthetic oligonucleotide
ggccaggggcugggugaccgauggcuucag

SEQ ID NO: 1436 - RNA, 22 nt, Artificial Sequence
  Description of Artificial Sequence: Synthetic oligonucleotide
uggagcaccguuaaggacaagu

SEQ ID NO: 1437 - RNA, 26 nt, Artificial Sequence
  Description of Artificial Sequence: Synthetic oligonucleotide
ucagccguggcugccugagaccucaa

SEQ ID NO: 1438 - RNA, 24 nt, Artificial Sequence
  Description of Artificial Sequence: Synthetic oligonucleotide
uuggguccugcaaucuccagggcu

SEQ ID NO: 1439 - RNA, 27 nt, Artificial Sequence
  Description of Artificial Sequence: Synthetic oligonucleotide
uggccucccaauaaagcuggacaagaa

SEQ ID NO: 1440 - RNA, 26 nt, Artificial Sequence
  Description of Artificial Sequence: Synthetic oligonucleotide
aauaaagcuggacaagaagcugcuau

SEQ ID NO: 1441 - DNA, 20 bp, Artificial Sequence
  Description of Artificial Sequence: Synthetic oligonucleotide
tgtccagctttattgggagg

SEQ ID NO: 1442 - DNA, 20 bp, Artificial Sequence
  Description of Artificial Sequence: Synthetic oligonucleotide
agcttcttgtccagctttat

SEQ ID NO: 1443 - DNA, 20 bp, Artificial Sequence
  Description of Artificial Sequence: Synthetic oligonucleotide
tgtccagctttattgggagg

SEQ ID NO: 1444 - DNA, 20 bp, Artificial Sequence
  Description of Artificial Sequence: Synthetic oligonucleotide
agcttcttgtccagctttat

SEQ ID NO: 1445 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1446 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1447 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1448 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1449 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1450 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1451 - RNA, 30 nt, Artificial Sequence
  Description of Artificial Sequence: Synthetic oligonucleotide
caccaagaccgccaaggaugcacugagcag

SEQ ID NO: 1452 - DNA, 21 bp, Artificial Sequence
  Description of Artificial Sequence: Synthetic oligonucleotide
  Description of Combined DNA/RNA Molecule: Synthetic oligonucleotide
tcauccuuggcggucuuggtu

SEQ ID NO: 1453 - DNA, 21 bp, Artificial Sequence
  Description of Artificial Sequence: Synthetic oligonucleotide
  Description of Combined DNA/RNA Molecule: Synthetic oligonucleotide
tugcugggccaccugggactu

SEQ ID NO: 1454 - DNA, 21 bp, Artificial Sequence
  Description of Artificial Sequence: Synthetic oligonucleotide
  Description of Combined DNA/RNA Molecule: Synthetic oligonucleotide
tgaagccaucggucacccatu

SEQ ID NO: 1455 - DNA, 21 bp, Artificial Sequence
  Description of Artificial Sequence: Synthetic oligonucleotide
  Description of Combined DNA/RNA Molecule: Synthetic oligonucleotide
tuuguccuuaacggugcuctu

SEQ ID NO: 1456 - DNA, 21 bp, Artificial Sequence
  Description of Artificial Sequence: Synthetic oligonucleotide
  Description of Combined DNA/RNA Molecule: Synthetic oligonucleotide
tuuguccagcuuuauugggtu

SEQ ID NO: 1457 - DNA, 21 bp, Artificial Sequence
  Description of Artificial Sequence: Synthetic oligonucleotide
  Description of Combined DNA/RNA Molecule: Synthetic oligonucleotide
tcauccuuggcggucuuggtu

SEQ ID NO: 1458 - DNA, 21 bp, Artificial Sequence
  Description of Artificial Sequence: Synthetic oligonucleotide
  Description of Combined DNA/RNA Molecule: Synthetic oligonucleotide
tugcugggccaccugggactu

SEQ ID NO: 1459 - DNA, 21 bp, Artificial Sequence
  Description of Artificial Sequence: Synthetic oligonucleotide
  Description of Combined DNA/RNA Molecule: Synthetic oligonucleotide
tgaagccaucggucacccatu

SEQ ID NO: 1460 - DNA, 21 bp, Artificial Sequence
  Description of Artificial Sequence: Synthetic oligonucleotide
  Description of Combined DNA/RNA Molecule: Synthetic oligonucleotide
tuuguccuuaacggugcuctu

SEQ ID NO: 1461 - DNA, 21 bp, Artificial Sequence
  Description of Artificial Sequence: Synthetic oligonucleotide
  Description of Combined DNA/RNA Molecule: Synthetic oligonucleotide
tuuguccagcuuuauugggtu

SEQ ID NO: 1462 - DNA, 21 bp, Artificial Sequence
  Description of Artificial Sequence: Synthetic oligonucleotide
  Description of Combined DNA/RNA Molecule: Synthetic oligonucleotide
tcauccuuggcggucuuggtu

SEQ ID NO: 1463 - DNA, 21 bp, Artificial Sequence
  Description of Artificial Sequence: Synthetic oligonucleotide
  Description of Combined DNA/RNA Molecule: Synthetic oligonucleotide
tugcugggccaccugggactu

SEQ ID NO: 1464 - DNA, 21 bp, Artificial Sequence
  Description of Artificial Sequence: Synthetic oligonucleotide
  Description of Combined DNA/RNA Molecule: Synthetic oligonucleotide
tgaagccaucggucacccatu

SEQ ID NO: 1465 - DNA, 21 bp, Artificial Sequence
  Description of Artificial Sequence: Synthetic oligonucleotide
  Description of Combined DNA/RNA Molecule: Synthetic oligonucleotide
tuuguccuuaacggugcuctu

SEQ ID NO: 1466 - DNA, 21 bp, Artificial Sequence
  Description of Artificial Sequence: Synthetic oligonucleotide
  Description of Combined DNA/RNA Molecule: Synthetic oligonucleotide
tuuguccagcuuuauugggtu

SEQ ID NO: 1467 - DNA, 21 bp, Artificial Sequence
  Description of Artificial Sequence: Synthetic oligonucleotide
  Description of Combined DNA/RNA Molecule: Synthetic oligonucleotide
tcauccuuggcggucuuggtu

SEQ ID NO: 1468 - DNA, 21 bp, Artificial Sequence
  Description of Artificial Sequence: Synthetic oligonucleotide
  Description of Combined DNA/RNA Molecule: Synthetic oligonucleotide
tugcugggccaccugggactu

SEQ ID NO: 1469 - DNA, 21 bp, Artificial Sequence
  Description of Artificial Sequence: Synthetic oligonucleotide
  Description of Combined DNA/RNA Molecule: Synthetic oligonucleotide
tgaagccaucggucacccatu

SEQ ID NO: 1470 - DNA, 21 bp, Artificial Sequence
  Description of Artificial Sequence: Synthetic oligonucleotide
  Description of Combined DNA/RNA Molecule: Synthetic oligonucleotide
tuuguccuuaacggugcuctu

SEQ ID NO: 1471 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1472 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1473 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1474 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1475 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1476 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1477 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1478 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1479 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1480 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1481 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1482 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1483 - DNA, 20 bp, Artificial Sequence
  Description of Artificial Sequence: Synthetic oligonucleotide
  Description of Combined DNA/RNA Molecule: Synthetic oligonucleotide
guccagcuuuauugggagtu

SEQ ID NO: 1484 - DNA, 20 bp, Artificial Sequence
  Description of Artificial Sequence: Synthetic oligonucleotide
  Description of Combined DNA/RNA Molecule: Synthetic oligonucleotide
agcuucuuguccagcuuutu

SEQ ID NO: 1485 - DNA, 20 bp, Artificial Sequence
  Description of Artificial Sequence: Synthetic oligonucleotide
  Description of Combined DNA/RNA Molecule: Synthetic oligonucleotide
gcauccttggcggtcuuggu

SEQ ID NO: 1486 - DNA, 20 bp, Artificial Sequence
  Description of Artificial Sequence: Synthetic oligonucleotide
  Description of Combined DNA/RNA Molecule: Synthetic oligonucleotide
ugcucagtgcatcctuggcg

SEQ ID NO: 1487 - DNA, 20 bp, Artificial Sequence
  Description of Artificial Sequence: Synthetic oligonucleotide
  Description of Combined DNA/RNA Molecule: Synthetic oligonucleotide
ccugggactcctgcacgcug

SEQ ID NO: 1488 - DNA, 20 bp, Artificial Sequence
  Description of Artificial Sequence: Synthetic oligonucleotide
  Description of Combined DNA/RNA Molecule: Synthetic oligonucleotide
cugcugggccacctgggacu

SEQ ID NO: 1489 - DNA, 20 bp, Artificial Sequence
  Description of Artificial Sequence: Synthetic oligonucleotide
  Description of Combined DNA/RNA Molecule: Synthetic oligonucleotide
gccaucggtcacccagcccc

SEQ ID NO: 1490 - DNA, 20 bp, Artificial Sequence
  Description of Artificial Sequence: Synthetic oligonucleotide
  Description of Combined DNA/RNA Molecule: Synthetic oligonucleotide
ugaagccatcggtcacccag

SEQ ID NO: 1491 - DNA, 20 bp, Artificial Sequence
  Description of Artificial Sequence: Synthetic oligonucleotide
  Description of Combined DNA/RNA Molecule: Synthetic oligonucleotide
cuuguccttaacggtgcucc

SEQ ID NO: 1492 - DNA, 20 bp, Artificial Sequence
  Description of Artificial Sequence: Synthetic oligonucleotide
  Description of Combined DNA/RNA Molecule: Synthetic oligonucleotide
agguctcaggcagccacggc

SEQ ID NO: 1493 - DNA, 20 bp, Artificial Sequence
  Description of Artificial Sequence: Synthetic oligonucleotide
  Description of Combined DNA/RNA Molecule: Synthetic oligonucleotide
ugaggtctcaggcagccacg

SEQ ID NO: 1494 - DNA, 20 bp, Artificial Sequence
  Description of Artificial Sequence: Synthetic oligonucleotide
  Description of Combined DNA/RNA Molecule: Synthetic oligonucleotide
ccuggagattgcaggaccca

SEQ ID NO: 1495 - DNA, 20 bp, Artificial Sequence
  Description of Artificial Sequence: Synthetic oligonucleotide
  Description of Combined DNA/RNA Molecule: Synthetic oligonucleotide
uccagctttattgggaggcc

SEQ ID NO: 1496 - DNA, 20 bp, Artificial Sequence
  Description of Artificial Sequence: Synthetic oligonucleotide
  Description of Combined DNA/RNA Molecule: Synthetic oligonucleotide
cuuguccagctttatuggga

SEQ ID NO: 1497 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1498 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1499 - DNA, 20 bp, Artificial Sequence
  Description of Artificial Sequence: Synthetic oligonucleotide
agcttcttgtccagctttat

SEQ ID NO: 1500 - DNA, 20 bp, Artificial Sequence
  Description of Artificial Sequence: Synthetic oligonucleotide
agcttcttgtccagctttat

SEQ ID NO: 1501 - DNA, 20 bp, Artificial Sequence
  Description of Artificial Sequence: Synthetic oligonucleotide
agcttcttgtccagctttat

SEQ ID NO: 1502 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuau

SEQ ID NO: 1503 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuau

SEQ ID NO: 1504 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuau

SEQ ID NO: 1505 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuau

SEQ ID NO: 1506 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1507 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1508 - DNA, 20 bp, Artificial Sequence
  Description of Artificial Sequence: Synthetic oligonucleotide
agcttcttgtccagctttat

SEQ ID NO: 1509 - DNA, 20 bp, Artificial Sequence
  Description of Artificial Sequence: Synthetic oligonucleotide
agcttcttgtccagctttat

SEQ ID NO: 1510 - DNA, 20 bp, Artificial Sequence
  Description of Artificial Sequence: Synthetic oligonucleotide
agcttcttgtccagctttat

SEQ ID NO: 1511 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuau

SEQ ID NO: 1512 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuau

SEQ ID NO: 1513 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuau

SEQ ID NO: 1514 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuau

SEQ ID NO: 1515 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1516 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1517 - DNA, 20 bp, Artificial Sequence
  Description of Artificial Sequence: Synthetic oligonucleotide
agcttcttgtccagctttat

SEQ ID NO: 1518 - DNA, 20 bp, Artificial Sequence
  Description of Artificial Sequence: Synthetic oligonucleotide
agcttcttgtccagctttat

SEQ ID NO: 1519 - DNA, 20 bp, Artificial Sequence
  Description of Artificial Sequence: Synthetic oligonucleotide
agcttcttgtccagctttat

SEQ ID NO: 1520 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuau

SEQ ID NO: 1521 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuau

SEQ ID NO: 1522 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuau

SEQ ID NO: 1523 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuau

SEQ ID NO: 1524 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1525 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1526 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1527 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1528 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1529 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1530 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1531 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1532 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1533 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1534 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1535 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1536 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1537 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1538 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1539 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuutu

SEQ ID NO: 1540 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1541 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1542 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1543 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1544 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1545 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1546 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1547 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1548 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1549 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1550 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1551 - DNA, 23 bp, Artificial Sequence
  Description of Artificial Sequence: Synthetic oligonucleotide
  Description of Combined DNA/RNA Molecule: Synthetic oligonucleotide
tguccagctuuatugggaggctu

SEQ ID NO: 1552 - DNA, 23 bp, Artificial Sequence
  Description of Artificial Sequence: Synthetic oligonucleotide
  Description of Combined DNA/RNA Molecule: Synthetic oligonucleotide
tguccagctuuauugggaggctu

SEQ ID NO: 1553 - DNA, 23 bp, Artificial Sequence
  Description of Artificial Sequence: Synthetic oligonucleotide
  Description of Combined DNA/RNA Molecule: Synthetic oligonucleotide
tguccagcuuuatugggaggctu

SEQ ID NO: 1554 - DNA, 23 bp, Artificial Sequence
  Description of Artificial Sequence: Synthetic oligonucleotide
  Description of Combined DNA/RNA Molecule: Synthetic oligonucleotide
tguccagctuuatugggaggctu

SEQ ID NO: 1555 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1556 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1557 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1558 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1559 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1560 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1561 - DNA, 23 bp, Artificial Sequence
  Description of Artificial Sequence: Synthetic oligonucleotide
  Description of Combined DNA/RNA Molecule: Synthetic oligonucleotide
tagctucutguccagcuuuautu

SEQ ID NO: 1562 - DNA, 23 bp, Artificial Sequence
  Description of Artificial Sequence: Synthetic oligonucleotide
  Description of Combined DNA/RNA Molecule: Synthetic oligonucleotide
tagctucuuguccagcuuuautu

SEQ ID NO: 1563 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1564 - DNA, 23 bp, Artificial Sequence
  Description of Artificial Sequence: Synthetic oligonucleotide
  Description of Combined DNA/RNA Molecule: Synthetic oligonucleotide
tagcuucutguccagcuuuautu

SEQ ID NO: 1565 - DNA, 23 bp, Artificial Sequence
  Description of Artificial Sequence: Synthetic oligonucleotide
  Description of Combined DNA/RNA Molecule: Synthetic oligonucleotide
tagctucutguccagcuuuautu

SEQ ID NO: 1566 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1567 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1568 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1569 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1570 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1571 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1572 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1573 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1574 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1575 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctc

SEQ ID NO: 1576 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggcta

SEQ ID NO: 1577 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctg

SEQ ID NO: 1578 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1579 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1580 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1581 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1582 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1583 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1584 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1585 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1586 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1587 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1588 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1589 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1590 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1591 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1592 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1593 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1594 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1595 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1596 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1597 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1598 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1599 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1600 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1601 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1602 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1603 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1604 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1605 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1606 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1607 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1608 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1609 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1610 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1611 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1612 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1613 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1614 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1615 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1616 - DNA, 20 bp, Artificial Sequence
  Description of Artificial Sequence: Synthetic oligonucleotide
agcttcttgtccagctttat

SEQ ID NO: 1617 - DNA, 20 bp, Artificial Sequence
  Description of Artificial Sequence: Synthetic oligonucleotide
agcttcttgtccagctttat

SEQ ID NO: 1618 - DNA, 20 bp, Artificial Sequence
  Description of Artificial Sequence: Synthetic oligonucleotide
agcttcttgtccagctttat

SEQ ID NO: 1619 - DNA, 20 bp, Artificial Sequence
  Description of Artificial Sequence: Synthetic oligonucleotide
agcttcttgtccagctttat

SEQ ID NO: 1620 - DNA, 20 bp, Artificial Sequence
  Description of Artificial Sequence: Synthetic oligonucleotide
agcttcttgtccagctttat

SEQ ID NO: 1621 - DNA, 20 bp, Artificial Sequence
  Description of Artificial Sequence: Synthetic oligonucleotide
agcttcttgtccagctttat

SEQ ID NO: 1622 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuau

SEQ ID NO: 1623 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 1624 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 1625 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 1626 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 1627 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 1628 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 1629 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 1630 - DNA, 20 bp, Artificial Sequence
  Description of Artificial Sequence: Synthetic oligonucleotide
agcttcttgtccagctttat

SEQ ID NO: 1631 - DNA, 20 bp, Artificial Sequence
  Description of Artificial Sequence: Synthetic oligonucleotide
agcttcttgtccagctttat

SEQ ID NO: 1632 - DNA, 20 bp, Artificial Sequence
  Description of Artificial Sequence: Synthetic oligonucleotide
agcttcttgtccagctttat

SEQ ID NO: 1633 - DNA, 20 bp, Artificial Sequence
  Description of Artificial Sequence: Synthetic oligonucleotide
agcttcttgtccagctttat

SEQ ID NO: 1634 - DNA, 20 bp, Artificial Sequence
  Description of Artificial Sequence: Synthetic oligonucleotide
agcttcttgtccagctttat

SEQ ID NO: 1635 - DNA, 20 bp, Artificial Sequence
  Description of Artificial Sequence: Synthetic oligonucleotide
agcttcttgtccagctttat

SEQ ID NO: 1636 - DNA, 20 bp, Artificial Sequence
  Description of Artificial Sequence: Synthetic oligonucleotide
agcttcttgtccagctttat

SEQ ID NO: 1637 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuat

SEQ ID NO: 1638 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuat

SEQ ID NO: 1639 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuat

SEQ ID NO: 1640 - DNA, 20 bp, Artificial Sequence
  Description of Artificial Sequence: Synthetic oligonucleotide
  Description of Combined DNA/RNA Molecule: Synthetic oligonucleotide
agcuucttgtccagctuuat

SEQ ID NO: 1641 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuat

SEQ ID NO: 1642 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuat

SEQ ID NO: 1643 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuat

SEQ ID NO: 1644 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuat

SEQ ID NO: 1645 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuat

SEQ ID NO: 1646 - DNA, 20 bp, Artificial Sequence
  Description of Artificial Sequence: Synthetic oligonucleotide
  Description of Combined DNA/RNA Molecule: Synthetic oligonucleotide
agcutcttgtccagctuuat

SEQ ID NO: 1647 - DNA, 20 bp, Artificial Sequence
  Description of Artificial Sequence: Synthetic oligonucleotide
agcttcttgtccagctttat

SEQ ID NO: 1648 - DNA, 20 bp, Artificial Sequence
  Description of Artificial Sequence: Synthetic oligonucleotide
agcttcttgtccagctttat

SEQ ID NO: 1649 - DNA, 20 bp, Artificial Sequence
  Description of Artificial Sequence: Synthetic oligonucleotide
agcttcttgtccagctttat

SEQ ID NO: 1650 - DNA, 20 bp, Artificial Sequence
  Description of Artificial Sequence: Synthetic oligonucleotide
agcttcttgtccagctttat

SEQ ID NO: 1651 - DNA, 20 bp, Artificial Sequence
  Description of Artificial Sequence: Synthetic oligonucleotide
agcttcttgtccagctttat

SEQ ID NO: 1652 - DNA, 20 bp, Artificial Sequence
  Description of Artificial Sequence: Synthetic oligonucleotide
agcttcttgtccagctttat

SEQ ID NO: 1653 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1654 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1655 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1656 - DNA, 21 bp, Artificial Sequence
  Description of Artificial Sequence: Synthetic oligonucleotide
  Description of Combined DNA/RNA Molecule: Synthetic oligonucleotide
tguccagcuuuauugggagtu

SEQ ID NO: 1657 - DNA, 20 bp, Artificial Sequence
  Description of Artificial Sequence: Synthetic oligonucleotide
agcttcttgtccagctttat

SEQ ID NO: 1658 - DNA, 20 bp, Artificial Sequence
  Description of Artificial Sequence: Synthetic oligonucleotide
agcttcttgtccagctttat

SEQ ID NO: 1659 - DNA, 20 bp, Artificial Sequence
  Description of Artificial Sequence: Synthetic oligonucleotide
agcttcttgtccagctttat

SEQ ID NO: 1660 - DNA, 20 bp, Artificial Sequence
  Description of Artificial Sequence: Synthetic oligonucleotide
agcttcttgtccagctttat

SEQ ID NO: 1661 - DNA, 20 bp, Artificial Sequence
  Description of Artificial Sequence: Synthetic oligonucleotide
agcttcttgtccagctttat

SEQ ID NO: 1662 - DNA, 20 bp, Artificial Sequence
  Description of Artificial Sequence: Synthetic oligonucleotide
atagcagcttcttgtccagc

SEQ ID NO: 1663 - DNA, 20 bp, Artificial Sequence
  Description of Artificial Sequence: Synthetic oligonucleotide
atagcagcttcttgtccagc

SEQ ID NO: 1664 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccauc

SEQ ID NO: 1665 - DNA, 20 bp, Artificial Sequence
  Description of Artificial Sequence: Synthetic oligonucleotide
atagcagcttcttgtccagc

SEQ ID NO: 1666 - DNA, 20 bp, Artificial Sequence
  Description of Artificial Sequence: Synthetic oligonucleotide
atagcagcttcttgtccagc

SEQ ID NO: 1667 - DNA, 20 bp, Artificial Sequence
  Description of Artificial Sequence: Synthetic oligonucleotide
atagcagcttcttgtccagc

SEQ ID NO: 1668 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1669 - DNA, 20 bp, Artificial Sequence
  Description of Artificial Sequence: Synthetic oligonucleotide
atagcagcttcttgtccagc

SEQ ID NO: 1670 - DNA, 20 bp, Artificial Sequence
  Description of Artificial Sequence: Synthetic oligonucleotide
atagcagcttcttgtccagc

SEQ ID NO: 1671 - DNA, 20 bp, Artificial Sequence
  Description of Artificial Sequence: Synthetic oligonucleotide
atagcagcttcttgtccagc

SEQ ID NO: 1672 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccauc

SEQ ID NO: 1673 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccauc

SEQ ID NO: 1674 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccauc

SEQ ID NO: 1675 - DNA, 20 bp, Artificial Sequence
  Description of Artificial Sequence: Synthetic oligonucleotide
atagcagcttcttgtccagc

SEQ ID NO: 1676 - DNA, 20 bp, Artificial Sequence
  Description of Artificial Sequence: Synthetic oligonucleotide
atagcagcttcttgtccagc

SEQ ID NO: 1677 - DNA, 20 bp, Artificial Sequence
  Description of Artificial Sequence: Synthetic oligonucleotide
atagcagcttcttgtccagc

SEQ ID NO: 1678 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1679 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1680 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1681 - DNA, 20 bp, Artificial Sequence
  Description of Artificial Sequence: Synthetic oligonucleotide
atagcagcttcttgtcgagc

SEQ ID NO: 1682 - DNA, 20 bp, Artificial Sequence
  Description of Artificial Sequence: Synthetic oligonucleotide
atagcagcttcttgtccagc

SEQ ID NO: 1683 - DNA, 20 bp, Artificial Sequence
  Description of Artificial Sequence: Synthetic oligonucleotide
atagcagcttcttgtccagc

SEQ ID NO: 1684 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccauc

SEQ ID NO: 1685 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccauc

SEQ ID NO: 1686 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccauc

SEQ ID NO: 1687 - DNA, 20 bp, Artificial Sequence
  Description of Artificial Sequence: Synthetic oligonucleotide
atagcagcttcttgtccagc

SEQ ID NO: 1688 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1689 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1690 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1691 - DNA, 20 bp, Artificial Sequence
  Description of Artificial Sequence: Synthetic oligonucleotide
atagcagcttcttgtccagc

SEQ ID NO: 1692 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1693 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1694 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1695 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1696 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1697 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1698 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1699 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 1700 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 1701 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 1702 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 1703 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 1704 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 1705 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 1706 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 1707 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 1708 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1709 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1710 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1711 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1712 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1713 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1714 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1715 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1716 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1717 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1718 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1719 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1720 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1721 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1722 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1723 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1724 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1725 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1726 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1727 - DNA, 23 bp, Artificial Sequence
  Description of Artificial Sequence: Synthetic oligonucleotide
  Description of Combined DNA/RNA Molecule: Synthetic oligonucleotide
tagcuucuuguccagctttattu

SEQ ID NO: 1728 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1729 - DNA, 23 bp, Artificial Sequence
  Description of Artificial Sequence: Synthetic oligonucleotide
  Description of Combined DNA/RNA Molecule: Synthetic oligonucleotide
tagcuucuuguccagctttattu

SEQ ID NO: 1730 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1731 - DNA, 23 bp, Artificial Sequence
  Description of Artificial Sequence: Synthetic oligonucleotide
  Description of Combined DNA/RNA Molecule: Synthetic oligonucleotide
tagcuucuuguccagctttattu

SEQ ID NO: 1732 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1733 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1734 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1735 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1736 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1737 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1738 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1739 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1740 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1741 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1742 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1743 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1744 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1745 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1746 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1747 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1748 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1749 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1750 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1751 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1752 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1753 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1754 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1755 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1756 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1757 - DNA, 23 bp, Artificial Sequence
  Description of Artificial Sequence: Synthetic oligonucleotide
  Description of Combined DNA/RNA Molecule: Synthetic oligonucleotide
tuuguccagcuuuauugggagtu

SEQ ID NO: 1758 - DNA, 23 bp, Artificial Sequence
  Description of Artificial Sequence: Synthetic oligonucleotide
  Description of Combined DNA/RNA Molecule: Synthetic oligonucleotide
tcuuguccagcuuuauugggatu

SEQ ID NO: 1759 - DNA, 23 bp, Artificial Sequence
  Description of Artificial Sequence: Synthetic oligonucleotide
  Description of Combined DNA/RNA Molecule: Synthetic oligonucleotide
tucuuguccagcuuuauugggtu

SEQ ID NO: 1760 - DNA, 23 bp, Artificial Sequence
  Description of Artificial Sequence: Synthetic oligonucleotide
  Description of Combined DNA/RNA Molecule: Synthetic oligonucleotide
tuagcagcuucuuguccagcutu

SEQ ID NO: 1761 - DNA, 23 bp, Artificial Sequence
  Description of Artificial Sequence: Synthetic oligonucleotide
  Description of Combined DNA/RNA Molecule: Synthetic oligonucleotide
tauagcagcuucuuguccagctu

SEQ ID NO: 1762 - DNA, 23 bp, Artificial Sequence
  Description of Artificial Sequence: Synthetic oligonucleotide
  Description of Combined DNA/RNA Molecule: Synthetic oligonucleotide
tcauagcagcuucuuguccagtu

SEQ ID NO: 1763 - DNA, 23 bp, Artificial Sequence
  Description of Artificial Sequence: Synthetic oligonucleotide
  Description of Combined DNA/RNA Molecule: Synthetic oligonucleotide
tuuguccagcuuuauugggagtu

SEQ ID NO: 1764 - DNA, 23 bp, Artificial Sequence
  Description of Artificial Sequence: Synthetic oligonucleotide
  Description of Combined DNA/RNA Molecule: Synthetic oligonucleotide
tcuuguccagcuuuauugggatu

SEQ ID NO: 1765 - DNA, 23 bp, Artificial Sequence
  Description of Artificial Sequence: Synthetic oligonucleotide
  Description of Combined DNA/RNA Molecule: Synthetic oligonucleotide
tucuuguccagcuuuauugggtu

SEQ ID NO: 1766 - DNA, 23 bp, Artificial Sequence
  Description of Artificial Sequence: Synthetic oligonucleotide
  Description of Combined DNA/RNA Molecule: Synthetic oligonucleotide
tuagcagcuucuuguccagcutu

SEQ ID NO: 1767 - DNA, 23 bp, Artificial Sequence
  Description of Artificial Sequence: Synthetic oligonucleotide
  Description of Combined DNA/RNA Molecule: Synthetic oligonucleotide
tauagcagcuucuuguccagctu

SEQ ID NO: 1768 - DNA, 23 bp, Artificial Sequence
  Description of Artificial Sequence: Synthetic oligonucleotide
  Description of Combined DNA/RNA Molecule: Synthetic oligonucleotide
tcauagcagcuucuuguccagtu

SEQ ID NO: 1769 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 1770 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 1771 - DNA, 20 bp, Artificial Sequence
  Description of Artificial Sequence: Synthetic oligonucleotide
ccagctttattagggacagc

SEQ ID NO: 1772 - DNA, 20 bp, Artificial Sequence
  Description of Artificial Sequence: Synthetic oligonucleotide
ccagctttattagggacagc

SEQ ID NO: 1773 - DNA, 20 bp, Artificial Sequence
  Description of Artificial Sequence: Synthetic oligonucleotide
ggagcagctgcctctaggga

SEQ ID NO: 1774 - DNA, 20 bp, Artificial Sequence
  Description of Artificial Sequence: Synthetic oligonucleotide
tggagcagctgcctctaggg

SEQ ID NO: 1775 - DNA, 20 bp, Artificial Sequence
  Description of Artificial Sequence: Synthetic oligonucleotide
tgttcctggagcagctgcct

SEQ ID NO: 1776 - DNA, 20 bp, Artificial Sequence
  Description of Artificial Sequence: Synthetic oligonucleotide
tccttggcggtcttggtggc

SEQ ID NO: 1777 - DNA, 20 bp, Artificial Sequence
  Description of Artificial Sequence: Synthetic oligonucleotide
atccttggcggtcttggtgg

SEQ ID NO: 1778 - DNA, 20 bp, Artificial Sequence
  Description of Artificial Sequence: Synthetic oligonucleotide
catccttggcggtcttggtg

SEQ ID NO: 1779 - DNA, 20 bp, Artificial Sequence
  Description of Artificial Sequence: Synthetic oligonucleotide
gcatccttggcggtcttggt

SEQ ID NO: 1780 - DNA, 20 bp, Artificial Sequence
  Description of Artificial Sequence: Synthetic oligonucleotide
ctggcctgctgggccacctg

SEQ ID NO: 1781 - DNA, 20 bp, Artificial Sequence
  Description of Artificial Sequence: Synthetic oligonucleotide
ggcggtcttggtggcgtgct

SEQ ID NO: 1782 - DNA, 20 bp, Artificial Sequence
  Description of Artificial Sequence: Synthetic oligonucleotide
tggcggtcttggtggcgtgc

SEQ ID NO: 1783 - DNA, 20 bp, Artificial Sequence
  Description of Artificial Sequence: Synthetic oligonucleotide
ttggcggtcttggtggcgtg

SEQ ID NO: 1784 - DNA, 20 bp, Artificial Sequence
  Description of Artificial Sequence: Synthetic oligonucleotide
cttggcggtcttggtggcgt

SEQ ID NO: 1785 - DNA, 20 bp, Artificial Sequence
  Description of Artificial Sequence: Synthetic oligonucleotide
ccttggcggtcttggtggcg

SEQ ID NO: 1786 - DNA, 20 bp, Artificial Sequence
  Description of Artificial Sequence: Synthetic oligonucleotide
gcccctggcctgctgggcca

SEQ ID NO: 1787 - DNA, 20 bp, Artificial Sequence
  Description of Artificial Sequence: Synthetic oligonucleotide
ggcagaggccaggagcgcca

SEQ ID NO: 1788 - DNA, 20 bp, Artificial Sequence
  Description of Artificial Sequence: Synthetic oligonucleotide
gaggcatcctcggcctctga

SEQ ID NO: 1789 - DNA, 20 bp, Artificial Sequence
  Description of Artificial Sequence: Synthetic oligonucleotide
ggaggcatcctcggcctctg

SEQ ID NO: 1790 - DNA, 20 bp, Artificial Sequence
  Description of Artificial Sequence: Synthetic oligonucleotide
gggaggcatcctcggcctct

SEQ ID NO: 1791 - DNA, 20 bp, Artificial Sequence
  Description of Artificial Sequence: Synthetic oligonucleotide
agggaggcatcctcggcctc

SEQ ID NO: 1792 - DNA, 20 bp, Artificial Sequence
  Description of Artificial Sequence: Synthetic oligonucleotide
aagggaggcatcctcggcct

SEQ ID NO: 1793 - DNA, 20 bp, Artificial Sequence
  Description of Artificial Sequence: Synthetic oligonucleotide
gaagggaggcatcctcggcc

SEQ ID NO: 1794 - DNA, 20 bp, Artificial Sequence
  Description of Artificial Sequence: Synthetic oligonucleotide
ggtcttggtggcgtgcttca

SEQ ID NO: 1795 - DNA, 20 bp, Artificial Sequence
  Description of Artificial Sequence: Synthetic oligonucleotide
gcggtcttggtggcgtgctt

SEQ ID NO: 1796 - DNA, 20 bp, Artificial Sequence
  Description of Artificial Sequence: Synthetic oligonucleotide
gtctcaggcagccacggctg

SEQ ID NO: 1797 - DNA, 20 bp, Artificial Sequence
  Description of Artificial Sequence: Synthetic oligonucleotide
aggccagcatgcctggaggg

SEQ ID NO: 1798 - DNA, 20 bp, Artificial Sequence
  Description of Artificial Sequence: Synthetic oligonucleotide
tgcatccttggcggtcttgg

SEQ ID NO: 1799 - DNA, 20 bp, Artificial Sequence
  Description of Artificial Sequence: Synthetic oligonucleotide
gtgcatccttggcggtcttg

SEQ ID NO: 1800 - DNA, 20 bp, Artificial Sequence
  Description of Artificial Sequence: Synthetic oligonucleotide
ctgctgggccacctgggact

SEQ ID NO: 1801 - DNA, 20 bp, Artificial Sequence
  Description of Artificial Sequence: Synthetic oligonucleotide
tgaagccatcggtcacccag

SEQ ID NO: 1802 - DNA, 20 bp, Artificial Sequence
  Description of Artificial Sequence: Synthetic oligonucleotide
ctgaagccatcggtcaccca

SEQ ID NO: 1803 - DNA, 20 bp, Artificial Sequence
  Description of Artificial Sequence: Synthetic oligonucleotide
cttgtccttaacggtgctcc

SEQ ID NO: 1804 - DNA, 20 bp, Artificial Sequence
  Description of Artificial Sequence: Synthetic oligonucleotide
tgtccagctttattgggagg

SEQ ID NO: 1805 - DNA, 20 bp, Artificial Sequence
  Description of Artificial Sequence: Synthetic oligonucleotide
tgcctctagggatgaactga

SEQ ID NO: 1806 - DNA, 20 bp, Artificial Sequence
  Description of Artificial Sequence: Synthetic oligonucleotide
ctgcatggcacctctgttcc

SEQ ID NO: 1807 - DNA, 20 bp, Artificial Sequence
  Description of Artificial Sequence: Synthetic oligonucleotide
gggctgcatggcacctctgt

SEQ ID NO: 1808 - DNA, 20 bp, Artificial Sequence
  Description of Artificial Sequence: Synthetic oligonucleotide
ctctgaagctcgggcagagg

SEQ ID NO: 1809 - DNA, 20 bp, Artificial Sequence
  Description of Artificial Sequence: Synthetic oligonucleotide
cctctgaagctcgggcagag

SEQ ID NO: 1810 - DNA, 20 bp, Artificial Sequence
  Description of Artificial Sequence: Synthetic oligonucleotide
gcctctgaagctcgggcaga

SEQ ID NO: 1811 - DNA, 20 bp, Artificial Sequence
  Description of Artificial Sequence: Synthetic oligonucleotide
cggcctctgaagctcgggca

SEQ ID NO: 1812 - DNA, 20 bp, Artificial Sequence
  Description of Artificial Sequence: Synthetic oligonucleotide
tcggcctctgaagctcgggc

SEQ ID NO: 1813 - DNA, 20 bp, Artificial Sequence
  Description of Artificial Sequence: Synthetic oligonucleotide
ctcggcctctgaagctcggg

SEQ ID NO: 1814 - DNA, 20 bp, Artificial Sequence
  Description of Artificial Sequence: Synthetic oligonucleotide
cctcggcctctgaagctcgg

SEQ ID NO: 1815 - DNA, 20 bp, Artificial Sequence
  Description of Artificial Sequence: Synthetic oligonucleotide
tcctcggcctctgaagctcg

SEQ ID NO: 1816 - DNA, 20 bp, Artificial Sequence
  Description of Artificial Sequence: Synthetic oligonucleotide
tgctcagtgcatccttggcg

SEQ ID NO: 1817 - DNA, 20 bp, Artificial Sequence
  Description of Artificial Sequence: Synthetic oligonucleotide
cctgggactcctgcacgctg

SEQ ID NO: 1818 - DNA, 20 bp, Artificial Sequence
  Description of Artificial Sequence: Synthetic oligonucleotide
ccacctgggactcctgcacg

SEQ ID NO: 1819 - DNA, 20 bp, Artificial Sequence
  Description of Artificial Sequence: Synthetic oligonucleotide
tcggtcacccagcccctggc

SEQ ID NO: 1820 - DNA, 20 bp, Artificial Sequence
  Description of Artificial Sequence: Synthetic oligonucleotide
atcggtcacccagcccctgg

SEQ ID NO: 1821 - DNA, 20 bp, Artificial Sequence
  Description of Artificial Sequence: Synthetic oligonucleotide
catcggtcacccagcccctg

SEQ ID NO: 1822 - DNA, 20 bp, Artificial Sequence
  Description of Artificial Sequence: Synthetic oligonucleotide
ccatcggtcacccagcccct

SEQ ID NO: 1823 - DNA, 20 bp, Artificial Sequence
  Description of Artificial Sequence: Synthetic oligonucleotide
gccatcggtcacccagcccc

SEQ ID NO: 1824 - DNA, 20 bp, Artificial Sequence
  Description of Artificial Sequence: Synthetic oligonucleotide
agccatcggtcacccagccc

SEQ ID NO: 1825 - DNA, 20 bp, Artificial Sequence
  Description of Artificial Sequence: Synthetic oligonucleotide
tccagctttattgggaggcc

SEQ ID NO: 1826 - DNA, 20 bp, Artificial Sequence
  Description of Artificial Sequence: Synthetic oligonucleotide
catcctcggcctctgaagct

SEQ ID NO: 1827 - DNA, 20 bp, Artificial Sequence
  Description of Artificial Sequence: Synthetic oligonucleotide
aggcatcctcggcctctgaa

SEQ ID NO: 1828 - DNA, 20 bp, Artificial Sequence
  Description of Artificial Sequence: Synthetic oligonucleotide
tcttggtggcgtgcttcatg

SEQ ID NO: 1829 - DNA, 20 bp, Artificial Sequence
  Description of Artificial Sequence: Synthetic oligonucleotide
cacgctgctcagtgcatcct

SEQ ID NO: 1830 - DNA, 20 bp, Artificial Sequence
  Description of Artificial Sequence: Synthetic oligonucleotide
ctcctgcacgctgctcagtg

SEQ ID NO: 1831 - DNA, 20 bp, Artificial Sequence
  Description of Artificial Sequence: Synthetic oligonucleotide
ggactcctgcacgctgctca

SEQ ID NO: 1832 - DNA, 20 bp, Artificial Sequence
  Description of Artificial Sequence: Synthetic oligonucleotide
gggactcctgcacgctgctc

SEQ ID NO: 1833 - DNA, 20 bp, Artificial Sequence
  Description of Artificial Sequence: Synthetic oligonucleotide
tgggactcctgcacgctgct

SEQ ID NO: 1834 - DNA, 20 bp, Artificial Sequence
  Description of Artificial Sequence: Synthetic oligonucleotide
aggtctcaggcagccacggc

SEQ ID NO: 1835 - DNA, 20 bp, Artificial Sequence
  Description of Artificial Sequence: Synthetic oligonucleotide
gaggtctcaggcagccacgg

SEQ ID NO: 1836 - DNA, 20 bp, Artificial Sequence
  Description of Artificial Sequence: Synthetic oligonucleotide
tgaggtctcaggcagccacg

SEQ ID NO: 1837 - DNA, 20 bp, Artificial Sequence
  Description of Artificial Sequence: Synthetic oligonucleotide
cctggagattgcaggaccca

SEQ ID NO: 1838 - DNA, 20 bp, Artificial Sequence
  Description of Artificial Sequence: Synthetic oligonucleotide
gccctggagattgcaggacc

SEQ ID NO: 1839 - DNA, 20 bp, Artificial Sequence
  Description of Artificial Sequence: Synthetic oligonucleotide
ccaggagcgccaggagggca

SEQ ID NO: 1840 - DNA, 20 bp, Artificial Sequence
  Description of Artificial Sequence: Synthetic oligonucleotide
cgtgcttcatgtaaccctgc

SEQ ID NO: 1841 - DNA, 20 bp, Artificial Sequence
  Description of Artificial Sequence: Synthetic oligonucleotide
tggtctgacctcagggtcca

SEQ ID NO: 1842 - DNA, 20 bp, Artificial Sequence
  Description of Artificial Sequence: Synthetic oligonucleotide
ttggtctgacctcagggtcc

SEQ ID NO: 1843 - DNA, 20 bp, Artificial Sequence
  Description of Artificial Sequence: Synthetic oligonucleotide
aagttggtctgacctcaggg

SEQ ID NO: 1844 - DNA, 20 bp, Artificial Sequence
  Description of Artificial Sequence: Synthetic oligonucleotide
tgaagttggtctgacctcag

SEQ ID NO: 1845 - DNA, 20 bp, Artificial Sequence
  Description of Artificial Sequence: Synthetic oligonucleotide
cacggctgaagttggtctga

SEQ ID NO: 1846 - DNA, 20 bp, Artificial Sequence
  Description of Artificial Sequence: Synthetic oligonucleotide
ccacggctgaagttggtctg

SEQ ID NO: 1847 - DNA, 20 bp, Artificial Sequence
  Description of Artificial Sequence: Synthetic oligonucleotide
gccacggctgaagttggtct

SEQ ID NO: 1848 - DNA, 20 bp, Artificial Sequence
  Description of Artificial Sequence: Synthetic oligonucleotide
agccacggctgaagttggtc

SEQ ID NO: 1849 - DNA, 20 bp, Artificial Sequence
  Description of Artificial Sequence: Synthetic oligonucleotide
gtcttggtggcgtgcttcat

SEQ ID NO: 1850 - DNA, 20 bp, Artificial Sequence
  Description of Artificial Sequence: Synthetic oligonucleotide
cagtgcatccttggcggtct

SEQ ID NO: 1851 - DNA, 20 bp, Artificial Sequence
  Description of Artificial Sequence: Synthetic oligonucleotide
ctgcctctagggatgaactg

SEQ ID NO: 1852 - DNA, 20 bp, Artificial Sequence
  Description of Artificial Sequence: Synthetic oligonucleotide
ggcatcctcggcctctgaag

SEQ ID NO: 1853 - DNA, 20 bp, Artificial Sequence
  Description of Artificial Sequence: Synthetic oligonucleotide
ttggtggcgtgcttcatgta

SEQ ID NO: 1854 - DNA, 20 bp, Artificial Sequence
  Description of Artificial Sequence: Synthetic oligonucleotide
gcgtgcttcatgtaaccctg

SEQ ID NO: 1855 - DNA, 20 bp, Artificial Sequence
  Description of Artificial Sequence: Synthetic oligonucleotide
tgagaagggaggcatcctcg

SEQ ID NO: 1856 - DNA, 20 bp, Artificial Sequence
  Description of Artificial Sequence: Synthetic oligonucleotide
gctgaagttggtctgacctc

SEQ ID NO: 1857 - DNA, 20 bp, Artificial Sequence
  Description of Artificial Sequence: Synthetic oligonucleotide
gggcctcccaaggcaaaccc

SEQ ID NO: 1858 - DNA, 20 bp, Artificial Sequence
  Description of Artificial Sequence: Synthetic oligonucleotide
gtttatgcccctgggcctga

SEQ ID NO: 1859 - DNA, 20 bp, Artificial Sequence
  Description of Artificial Sequence: Synthetic oligonucleotide
aaccttagctgggtctgcca

SEQ ID NO: 1860 - DNA, 20 bp, Artificial Sequence
  Description of Artificial Sequence: Synthetic oligonucleotide
cacccattgggactgggatc

SEQ ID NO: 1861 - DNA, 20 bp, Artificial Sequence
  Description of Artificial Sequence: Synthetic oligonucleotide
ctcctgcttgaccacccatt

SEQ ID NO: 1862 - DNA, 20 bp, Artificial Sequence
  Description of Artificial Sequence: Synthetic oligonucleotide
gctcctgcttgaccacccat

SEQ ID NO: 1863 - DNA, 20 bp, Artificial Sequence
  Description of Artificial Sequence: Synthetic oligonucleotide
tgggctcctgcttgaccacc

SEQ ID NO: 1864 - DNA, 20 bp, Artificial Sequence
  Description of Artificial Sequence: Synthetic oligonucleotide
gcctgacaaaggccctgtga

SEQ ID NO: 1865 - DNA, 20 bp, Artificial Sequence
  Description of Artificial Sequence: Synthetic oligonucleotide
tccttgcaggaaccccagca

SEQ ID NO: 1866 - DNA, 20 bp, Artificial Sequence
  Description of Artificial Sequence: Synthetic oligonucleotide
acaccaccctctcaacttca

SEQ ID NO: 1867 - DNA, 20 bp, Artificial Sequence
  Description of Artificial Sequence: Synthetic oligonucleotide
acacccatgtccccactgga

SEQ ID NO: 1868 - DNA, 20 bp, Artificial Sequence
  Description of Artificial Sequence: Synthetic oligonucleotide
tgagaactcctctgtaggca

SEQ ID NO: 1869 - DNA, 20 bp, Artificial Sequence
  Description of Artificial Sequence: Synthetic oligonucleotide
ggagcagctgcctctaggga

SEQ ID NO: 1870 - DNA, 20 bp, Artificial Sequence
  Description of Artificial Sequence: Synthetic oligonucleotide
  Description of Combined DNA/RNA Molecule: Synthetic oligonucleotide
uggagcagctgcctctaggg

SEQ ID NO: 1871 - DNA, 20 bp, Artificial Sequence
  Description of Artificial Sequence: Synthetic oligonucleotide
  Description of Combined DNA/RNA Molecule: Synthetic oligonucleotide
uguucctggagcagctgcct

SEQ ID NO: 1872 - DNA, 20 bp, Artificial Sequence
  Description of Artificial Sequence: Synthetic oligonucleotide
  Description of Combined DNA/RNA Molecule: Synthetic oligonucleotide
uccuuggcggtcttggtggc

SEQ ID NO: 1873 - DNA, 20 bp, Artificial Sequence
  Description of Artificial Sequence: Synthetic oligonucleotide
  Description of Combined DNA/RNA Molecule: Synthetic oligonucleotide
auccutggcggtcttggtgg

SEQ ID NO: 1874 - DNA, 20 bp, Artificial Sequence
  Description of Artificial Sequence: Synthetic oligonucleotide
  Description of Combined DNA/RNA Molecule: Synthetic oligonucleotide
cauccttggcggtcttggtg

SEQ ID NO: 1875 - DNA, 20 bp, Artificial Sequence
  Description of Artificial Sequence: Synthetic oligonucleotide
  Description of Combined DNA/RNA Molecule: Synthetic oligonucleotide
gcauccttggcggtcttggt

SEQ ID NO: 1876 - DNA, 20 bp, Artificial Sequence
  Description of Artificial Sequence: Synthetic oligonucleotide
  Description of Combined DNA/RNA Molecule: Synthetic oligonucleotide
cuggcctgctgggccacctg

SEQ ID NO: 1877 - DNA, 20 bp, Artificial Sequence
  Description of Artificial Sequence: Synthetic oligonucleotide
ggcggtcttggtggcgtgct

SEQ ID NO: 1878 - DNA, 20 bp, Artificial Sequence
  Description of Artificial Sequence: Synthetic oligonucleotide
  Description of Combined DNA/RNA Molecule: Synthetic oligonucleotide
uggcggtcttggtggcgtgc

SEQ ID NO: 1879 - DNA, 20 bp, Artificial Sequence
  Description of Artificial Sequence: Synthetic oligonucleotide
  Description of Combined DNA/RNA Molecule: Synthetic oligonucleotide
uuggcggtcttggtggcgtg

SEQ ID NO: 1880 - DNA, 20 bp, Artificial Sequence
  Description of Artificial Sequence: Synthetic oligonucleotide
  Description of Combined DNA/RNA Molecule: Synthetic oligonucleotide
cuuggcggtcttggtggcgt

SEQ ID NO: 1881 - DNA, 20 bp, Artificial Sequence
  Description of Artificial Sequence: Synthetic oligonucleotide
  Description of Combined DNA/RNA Molecule: Synthetic oligonucleotide
ccuuggcggtcttggtggcg

SEQ ID NO: 1882 - DNA, 20 bp, Artificial Sequence
  Description of Artificial Sequence: Synthetic oligonucleotide
gcccctggcctgctgggcca

SEQ ID NO: 1883 - DNA, 20 bp, Artificial Sequence
  Description of Artificial Sequence: Synthetic oligonucleotide
ggcagaggccaggagcgcca

SEQ ID NO: 1884 - DNA, 20 bp, Artificial Sequence
  Description of Artificial Sequence: Synthetic oligonucleotide
gaggcatcctcggcctctga

SEQ ID NO: 1885 - DNA, 20 bp, Artificial Sequence
  Description of Artificial Sequence: Synthetic oligonucleotide
ggaggcatcctcggcctctg

SEQ ID NO: 1886 - DNA, 20 bp, Artificial Sequence
  Description of Artificial Sequence: Synthetic oligonucleotide
gggaggcatcctcggcctct

SEQ ID NO: 1887 - DNA, 20 bp, Artificial Sequence
  Description of Artificial Sequence: Synthetic oligonucleotide
agggaggcatcctcggcctc

SEQ ID NO: 1888 - DNA, 20 bp, Artificial Sequence
  Description of Artificial Sequence: Synthetic oligonucleotide
aagggaggcatcctcggcct

SEQ ID NO: 1889 - DNA, 20 bp, Artificial Sequence
  Description of Artificial Sequence: Synthetic oligonucleotide
gaagggaggcatcctcggcc

SEQ ID NO: 1890 - DNA, 20 bp, Artificial Sequence
  Description of Artificial Sequence: Synthetic oligonucleotide
  Description of Combined DNA/RNA Molecule: Synthetic oligonucleotide
ggucutggtggcgtgcttca

SEQ ID NO: 1891 - DNA, 20 bp, Artificial Sequence
  Description of Artificial Sequence: Synthetic oligonucleotide
  Description of Combined DNA/RNA Molecule: Synthetic oligonucleotide
gcggucttggtggcgtgctt

SEQ ID NO: 1892 - DNA, 20 bp, Artificial Sequence
  Description of Artificial Sequence: Synthetic oligonucleotide
  Description of Combined DNA/RNA Molecule: Synthetic oligonucleotide
gucucaggcagccacggctg

SEQ ID NO: 1893 - DNA, 20 bp, Artificial Sequence
  Description of Artificial Sequence: Synthetic oligonucleotide
aggccagcatgcctggaggg

SEQ ID NO: 1894 - DNA, 20 bp, Artificial Sequence
  Description of Artificial Sequence: Synthetic oligonucleotide
  Description of Combined DNA/RNA Molecule: Synthetic oligonucleotide
ugcauccttggcggtcttgg

SEQ ID NO: 1895 - DNA, 20 bp, Artificial Sequence
  Description of Artificial Sequence: Synthetic oligonucleotide
  Description of Combined DNA/RNA Molecule: Synthetic oligonucleotide
gugcatccttggcggtcttg

SEQ ID NO: 1896 - DNA, 20 bp, Artificial Sequence
  Description of Artificial Sequence: Synthetic oligonucleotide
  Description of Combined DNA/RNA Molecule: Synthetic oligonucleotide
cugcugggccacctgggact

SEQ ID NO: 1897 - DNA, 20 bp, Artificial Sequence
  Description of Artificial Sequence: Synthetic oligonucleotide
  Description of Combined DNA/RNA Molecule: Synthetic oligonucleotide
ugaagccatcggtcacccag

SEQ ID NO: 1898 - DNA, 20 bp, Artificial Sequence
  Description of Artificial Sequence: Synthetic oligonucleotide
  Description of Combined DNA/RNA Molecule: Synthetic oligonucleotide
cugaagccatcggtcaccca

SEQ ID NO: 1899 - DNA, 20 bp, Artificial Sequence
  Description of Artificial Sequence: Synthetic oligonucleotide
  Description of Combined DNA/RNA Molecule: Synthetic oligonucleotide
cuuguccttaacggtgctcc

SEQ ID NO: 1900 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1901 - DNA, 20 bp, Artificial Sequence
  Description of Artificial Sequence: Synthetic oligonucleotide
  Description of Combined DNA/RNA Molecule: Synthetic oligonucleotide
ugccuctagggatgaactga

SEQ ID NO: 1902 - DNA, 20 bp, Artificial Sequence
  Description of Artificial Sequence: Synthetic oligonucleotide
  Description of Combined DNA/RNA Molecule: Synthetic oligonucleotide
cugcatggcacctctgttcc

SEQ ID NO: 1903 - DNA, 20 bp, Artificial Sequence
  Description of Artificial Sequence: Synthetic oligonucleotide
  Description of Combined DNA/RNA Molecule: Synthetic oligonucleotide
gggcugcatggcacctctgt

SEQ ID NO: 1904 - DNA, 20 bp, Artificial Sequence
  Description of Artificial Sequence: Synthetic oligonucleotide
  Description of Combined DNA/RNA Molecule: Synthetic oligonucleotide
cucugaagctcgggcagagg

SEQ ID NO: 1905 - DNA, 20 bp, Artificial Sequence
  Description of Artificial Sequence: Synthetic oligonucleotide
  Description of Combined DNA/RNA Molecule: Synthetic oligonucleotide
ccucugaagctcgggcagag

SEQ ID NO: 1906 - DNA, 20 bp, Artificial Sequence
  Description of Artificial Sequence: Synthetic oligonucleotide
  Description of Combined DNA/RNA Molecule: Synthetic oligonucleotide
gccuctgaagctcgggcaga

SEQ ID NO: 1907 - DNA, 20 bp, Artificial Sequence
  Description of Artificial Sequence: Synthetic oligonucleotide
cggcctctgaagctcgggca

SEQ ID NO: 1908 - DNA, 20 bp, Artificial Sequence
  Description of Artificial Sequence: Synthetic oligonucleotide
  Description of Combined DNA/RNA Molecule: Synthetic oligonucleotide
ucggcctctgaagctcgggc

SEQ ID NO: 1909 - DNA, 20 bp, Artificial Sequence
  Description of Artificial Sequence: Synthetic oligonucleotide
  Description of Combined DNA/RNA Molecule: Synthetic oligonucleotide
cucggcctctgaagctcggg

SEQ ID NO: 1910 - DNA, 20 bp, Artificial Sequence
  Description of Artificial Sequence: Synthetic oligonucleotide
  Description of Combined DNA/RNA Molecule: Synthetic oligonucleotide
ccucggcctctgaagctcgg

SEQ ID NO: 1911 - DNA, 20 bp, Artificial Sequence
  Description of Artificial Sequence: Synthetic oligonucleotide
  Description of Combined DNA/RNA Molecule: Synthetic oligonucleotide
uccucggcctctgaagctcg

SEQ ID NO: 1912 - DNA, 20 bp, Artificial Sequence
  Description of Artificial Sequence: Synthetic oligonucleotide
  Description of Combined DNA/RNA Molecule: Synthetic oligonucleotide
ugcucagtgcatccttggcg

SEQ ID NO: 1913 - DNA, 20 bp, Artificial Sequence
  Description of Artificial Sequence: Synthetic oligonucleotide
  Description of Combined DNA/RNA Molecule: Synthetic oligonucleotide
ccugggactcctgcacgctg

SEQ ID NO: 1914 - DNA, 20 bp, Artificial Sequence
  Description of Artificial Sequence: Synthetic oligonucleotide
ccacctgggactcctgcacg

SEQ ID NO: 1915 - DNA, 20 bp, Artificial Sequence
  Description of Artificial Sequence: Synthetic oligonucleotide
  Description of Combined DNA/RNA Molecule: Synthetic oligonucleotide
ucggucacccagcccctggc

SEQ ID NO: 1916 - DNA, 20 bp, Artificial Sequence
  Description of Artificial Sequence: Synthetic oligonucleotide
  Description of Combined DNA/RNA Molecule: Synthetic oligonucleotide
aucggtcacccagcccctgg

SEQ ID NO: 1917 - DNA, 20 bp, Artificial Sequence
  Description of Artificial Sequence: Synthetic oligonucleotide
  Description of Combined DNA/RNA Molecule: Synthetic oligonucleotide
caucggtcacccagcccctg

SEQ ID NO: 1918 - DNA, 20 bp, Artificial Sequence
  Description of Artificial Sequence: Synthetic oligonucleotide
  Description of Combined DNA/RNA Molecule: Synthetic oligonucleotide
ccaucggtcacccagcccct

SEQ ID NO: 1919 - DNA, 20 bp, Artificial Sequence
  Description of Artificial Sequence: Synthetic oligonucleotide
  Description of Combined DNA/RNA Molecule: Synthetic oligonucleotide
gccaucggtcacccagcccc

SEQ ID NO: 1920 - DNA, 20 bp, Artificial Sequence
  Description of Artificial Sequence: Synthetic oligonucleotide
agccatcggtcacccagccc

SEQ ID NO: 1921 - DNA, 20 bp, Artificial Sequence
  Description of Artificial Sequence: Synthetic oligonucleotide
  Description of Combined DNA/RNA Molecule: Synthetic oligonucleotide
uccagctttattgggaggcc

SEQ ID NO: 1922 - DNA, 20 bp, Artificial Sequence
  Description of Artificial Sequence: Synthetic oligonucleotide
  Description of Combined DNA/RNA Molecule: Synthetic oligonucleotide
caucctcggcctctgaagct

SEQ ID NO: 1923 - DNA, 20 bp, Artificial Sequence
  Description of Artificial Sequence: Synthetic oligonucleotide
aggcatcctcggcctctgaa

SEQ ID NO: 1924 - DNA, 20 bp, Artificial Sequence
  Description of Artificial Sequence: Synthetic oligonucleotide
  Description of Combined DNA/RNA Molecule: Synthetic oligonucleotide
ucuuggtggcgtgcttcatg

SEQ ID NO: 1925 - DNA, 20 bp, Artificial Sequence
  Description of Artificial Sequence: Synthetic oligonucleotide
cacgctgctcagtgcatcct

SEQ ID NO: 1926 - DNA, 20 bp, Artificial Sequence
  Description of Artificial Sequence: Synthetic oligonucleotide
  Description of Combined DNA/RNA Molecule: Synthetic oligonucleotide
cuccugcacgctgctcagtg

SEQ ID NO: 1927 - DNA, 20 bp, Artificial Sequence
  Description of Artificial Sequence: Synthetic oligonucleotide
  Description of Combined DNA/RNA Molecule: Synthetic oligonucleotide
ggacucctgcacgctgctca

SEQ ID NO: 1928 - DNA, 20 bp, Artificial Sequence
  Description of Artificial Sequence: Synthetic oligonucleotide
gggactcctgcacgctgctc

SEQ ID NO: 1929 - DNA, 20 bp, Artificial Sequence
  Description of Artificial Sequence: Synthetic oligonucleotide
  Description of Combined DNA/RNA Molecule: Synthetic oligonucleotide
ugggactcctgcacgctgct

SEQ ID NO: 1930 - DNA, 20 bp, Artificial Sequence
  Description of Artificial Sequence: Synthetic oligonucleotide
  Description of Combined DNA/RNA Molecule: Synthetic oligonucleotide
agguctcaggcagccacggc

SEQ ID NO: 1931 - DNA, 20 bp, Artificial Sequence
  Description of Artificial Sequence: Synthetic oligonucleotide
  Description of Combined DNA/RNA Molecule: Synthetic oligonucleotide
gagguctcaggcagccacgg

SEQ ID NO: 1932 - DNA, 20 bp, Artificial Sequence
  Description of Artificial Sequence: Synthetic oligonucleotide
  Description of Combined DNA/RNA Molecule: Synthetic oligonucleotide
ugaggtctcaggcagccacg

SEQ ID NO: 1933 - DNA, 20 bp, Artificial Sequence
  Description of Artificial Sequence: Synthetic oligonucleotide
  Description of Combined DNA/RNA Molecule: Synthetic oligonucleotide
ccuggagattgcaggaccca

SEQ ID NO: 1934 - DNA, 20 bp, Artificial Sequence
  Description of Artificial Sequence: Synthetic oligonucleotide
  Description of Combined DNA/RNA Molecule: Synthetic oligonucleotide
gcccuggagattgcaggacc

SEQ ID NO: 1935 - DNA, 20 bp, Artificial Sequence
  Description of Artificial Sequence: Synthetic oligonucleotide
ccaggagcgccaggagggca

SEQ ID NO: 1936 - DNA, 20 bp, Artificial Sequence
  Description of Artificial Sequence: Synthetic oligonucleotide
  Description of Combined DNA/RNA Molecule: Synthetic oligonucleotide
cgugcttcatgtaaccctgc

SEQ ID NO: 1937 - DNA, 20 bp, Artificial Sequence
  Description of Artificial Sequence: Synthetic oligonucleotide
  Description of Combined DNA/RNA Molecule: Synthetic oligonucleotide
ugguctgacctcagggtcca

SEQ ID NO: 1938 - DNA, 20 bp, Artificial Sequence
  Description of Artificial Sequence: Synthetic oligonucleotide
  Description of Combined DNA/RNA Molecule: Synthetic oligonucleotide
uugguctgacctcagggtcc

SEQ ID NO: 1939 - DNA, 20 bp, Artificial Sequence
  Description of Artificial Sequence: Synthetic oligonucleotide
  Description of Combined DNA/RNA Molecule: Synthetic oligonucleotide
aaguuggtctgacctcaggg

SEQ ID NO: 1940 - DNA, 20 bp, Artificial Sequence
  Description of Artificial Sequence: Synthetic oligonucleotide
  Description of Combined DNA/RNA Molecule: Synthetic oligonucleotide
ugaagttggtctgacctcag

SEQ ID NO: 1941 - DNA, 20 bp, Artificial Sequence
  Description of Artificial Sequence: Synthetic oligonucleotide
cacggctgaagttggtctga

SEQ ID NO: 1942 - DNA, 20 bp, Artificial Sequence
  Description of Artificial Sequence: Synthetic oligonucleotide
ccacggctgaagttggtctg

SEQ ID NO: 1943 - DNA, 20 bp, Artificial Sequence
  Description of Artificial Sequence: Synthetic oligonucleotide
gccacggctgaagttggtct

SEQ ID NO: 1944 - DNA, 20 bp, Artificial Sequence
  Description of Artificial Sequence: Synthetic oligonucleotide
agccacggctgaagttggtc

SEQ ID NO: 1945 - DNA, 20 bp, Artificial Sequence
  Description of Artificial Sequence: Synthetic oligonucleotide
  Description of Combined DNA/RNA Molecule: Synthetic oligonucleotide
gucuuggtggcgtgcttcat

SEQ ID NO: 1946 - DNA, 20 bp, Artificial Sequence
  Description of Artificial Sequence: Synthetic oligonucleotide
  Description of Combined DNA/RNA Molecule: Synthetic oligonucleotide
cagugcatccttggcggtct

SEQ ID NO: 1947 - DNA, 20 bp, Artificial Sequence
  Description of Artificial Sequence: Synthetic oligonucleotide
  Description of Combined DNA/RNA Molecule: Synthetic oligonucleotide
cugcctctagggatgaactg

SEQ ID NO: 1948 - DNA, 20 bp, Artificial Sequence
  Description of Artificial Sequence: Synthetic oligonucleotide
  Description of Combined DNA/RNA Molecule: Synthetic oligonucleotide
ggcaucctcggcctctgaag

SEQ ID NO: 1949 - DNA, 20 bp, Artificial Sequence
  Description of Artificial Sequence: Synthetic oligonucleotide
  Description of Combined DNA/RNA Molecule: Synthetic oligonucleotide
uugguggcgtgcttcatgta

SEQ ID NO: 1950 - DNA, 20 bp, Artificial Sequence
  Description of Artificial Sequence: Synthetic oligonucleotide
  Description of Combined DNA/RNA Molecule: Synthetic oligonucleotide
gcgugcttcatgtaaccctg

SEQ ID NO: 1951 - DNA, 20 bp, Artificial Sequence
  Description of Artificial Sequence: Synthetic oligonucleotide
  Description of Combined DNA/RNA Molecule: Synthetic oligonucleotide
ugagaagggaggcatcctcg

SEQ ID NO: 1952 - DNA, 20 bp, Artificial Sequence
  Description of Artificial Sequence: Synthetic oligonucleotide
  Description of Combined DNA/RNA Molecule: Synthetic oligonucleotide
gcugaagttggtctgacctc

SEQ ID NO: 1953 - DNA, 20 bp, Artificial Sequence
  Description of Artificial Sequence: Synthetic oligonucleotide
gggcctcccaaggcaaaccc

SEQ ID NO: 1954 - DNA, 20 bp, Artificial Sequence
  Description of Artificial Sequence: Synthetic oligonucleotide
  Description of Combined DNA/RNA Molecule: Synthetic oligonucleotide
guuuatgcccctgggcctga

SEQ ID NO: 1955 - DNA, 20 bp, Artificial Sequence
  Description of Artificial Sequence: Synthetic oligonucleotide
  Description of Combined DNA/RNA Molecule: Synthetic oligonucleotide
aaccutagctgggtctgcca

SEQ ID NO: 1956 - DNA, 20 bp, Artificial Sequence
  Description of Artificial Sequence: Synthetic oligonucleotide
cacccattgggactgggatc

SEQ ID NO: 1957 - DNA, 20 bp, Artificial Sequence
  Description of Artificial Sequence: Synthetic oligonucleotide
  Description of Combined DNA/RNA Molecule: Synthetic oligonucleotide
cuccugcttgaccacccatt

SEQ ID NO: 1958 - DNA, 20 bp, Artificial Sequence
  Description of Artificial Sequence: Synthetic oligonucleotide
  Description of Combined DNA/RNA Molecule: Synthetic oligonucleotide
gcucctgcttgaccacccat

SEQ ID NO: 1959 - DNA, 20 bp, Artificial Sequence
  Description of Artificial Sequence: Synthetic oligonucleotide
  Description of Combined DNA/RNA Molecule: Synthetic oligonucleotide
ugggctcctgcttgaccacc

SEQ ID NO: 1960 - DNA, 20 bp, Artificial Sequence
  Description of Artificial Sequence: Synthetic oligonucleotide
  Description of Combined DNA/RNA Molecule: Synthetic oligonucleotide
gccugacaaaggccctgtga

SEQ ID NO: 1961 - RNA, 20 nt, Artificial Sequence
  Description of Artificial Sequence: Synthetic oligonucleotide
uccuugcaggaaccccagca

SEQ ID NO: 1962 - DNA, 20 bp, Artificial Sequence
  Description of Artificial Sequence: Synthetic oligonucleotide
acaccaccctctcaacttca

SEQ ID NO: 1963 - DNA, 20 bp, Artificial Sequence
  Description of Artificial Sequence: Synthetic oligonucleotide
acacccatgtccccactgga

SEQ ID NO: 1964 - DNA, 20 bp, Artificial Sequence
  Description of Artificial Sequence: Synthetic oligonucleotide
  Description of Combined DNA/RNA Molecule: Synthetic oligonucleotide
ugagaactcctctgtaggca

SEQ ID NO: 1965 - DNA, 20 bp, Artificial Sequence
  Description of Artificial Sequence: Synthetic oligonucleotide
  Description of Combined DNA/RNA Molecule: Synthetic oligonucleotide
uccuuggcggtcttgguggc

SEQ ID NO: 1966 - DNA, 20 bp, Artificial Sequence
  Description of Artificial Sequence: Synthetic oligonucleotide
  Description of Combined DNA/RNA Molecule: Synthetic oligonucleotide
auccutggcggtcttggugg

SEQ ID NO: 1967 - DNA, 20 bp, Artificial Sequence
  Description of Artificial Sequence: Synthetic oligonucleotide
  Description of Combined DNA/RNA Molecule: Synthetic oligonucleotide
gcauccttggcggtcuuggu

SEQ ID NO: 1968 - DNA, 20 bp, Artificial Sequence
  Description of Artificial Sequence: Synthetic oligonucleotide
  Description of Combined DNA/RNA Molecule: Synthetic oligonucleotide
cuggcctgctgggccaccug

SEQ ID NO: 1969 - DNA, 20 bp, Artificial Sequence
  Description of Artificial Sequence: Synthetic oligonucleotide
  Description of Combined DNA/RNA Molecule: Synthetic oligonucleotide
ggcggtcttggtggcgugcu

SEQ ID NO: 1970 - DNA, 20 bp, Artificial Sequence
  Description of Artificial Sequence: Synthetic oligonucleotide
  Description of Combined DNA/RNA Molecule: Synthetic oligonucleotide
uggcggtcttggtggcgugc

SEQ ID NO: 1971 - DNA, 20 bp, Artificial Sequence
  Description of Artificial Sequence: Synthetic oligonucleotide
  Description of Combined DNA/RNA Molecule: Synthetic oligonucleotide
cuuggcggtcttggtggcgu

SEQ ID NO: 1972 - DNA, 20 bp, Artificial Sequence
  Description of Artificial Sequence: Synthetic oligonucleotide
  Description of Combined DNA/RNA Molecule: Synthetic oligonucleotide
ccuuggcggtcttgguggcg

SEQ ID NO: 1973 - DNA, 20 bp, Artificial Sequence
  Description of Artificial Sequence: Synthetic oligonucleotide
ggcagaggccaggagcgcca

SEQ ID NO: 1974 - DNA, 20 bp, Artificial Sequence
  Description of Artificial Sequence: Synthetic oligonucleotide
  Description of Combined DNA/RNA Molecule: Synthetic oligonucleotide
gggaggcatcctcggccucu

SEQ ID NO: 1975 - DNA, 20 bp, Artificial Sequence
  Description of Artificial Sequence: Synthetic oligonucleotide
  Description of Combined DNA/RNA Molecule: Synthetic oligonucleotide
aagggaggcatcctcggccu

SEQ ID NO: 1976 - DNA, 20 bp, Artificial Sequence
  Description of Artificial Sequence: Synthetic oligonucleotide
gaagggaggcatcctcggcc

SEQ ID NO: 1977 - DNA, 20 bp, Artificial Sequence
  Description of Artificial Sequence: Synthetic oligonucleotide
  Description of Combined DNA/RNA Molecule: Synthetic oligonucleotide
gcggucttggtggcgugcuu

SEQ ID NO: 1978 - RNA, 20 nt, Artificial Sequence
  Description of Artificial Sequence: Synthetic oligonucleotide
gucucaggcagccacggcug

SEQ ID NO: 1979 - DNA, 20 bp, Artificial Sequence
  Description of Artificial Sequence: Synthetic oligonucleotide
  Description of Combined DNA/RNA Molecule: Synthetic oligonucleotide
ugcauccttggcggtcuugg

SEQ ID NO: 1980 - DNA, 20 bp, Artificial Sequence
  Description of Artificial Sequence: Synthetic oligonucleotide
  Description of Combined DNA/RNA Molecule: Synthetic oligonucleotide
cugcugggccacctgggacu

SEQ ID NO: 1981 - DNA, 20 bp, Artificial Sequence
  Description of Artificial Sequence: Synthetic oligonucleotide
  Description of Combined DNA/RNA Molecule: Synthetic oligonucleotide
ugaagccatcggtcacccag

SEQ ID NO: 1982 - DNA, 20 bp, Artificial Sequence
  Description of Artificial Sequence: Synthetic oligonucleotide
  Description of Combined DNA/RNA Molecule: Synthetic oligonucleotide
cuuguccttaacggtgcucc

SEQ ID NO: 1983 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 1984 - DNA, 20 bp, Artificial Sequence
  Description of Artificial Sequence: Synthetic oligonucleotide
  Description of Combined DNA/RNA Molecule: Synthetic oligonucleotide
cugcatggcacctctguucc

SEQ ID NO: 1985 - DNA, 20 bp, Artificial Sequence
  Description of Artificial Sequence: Synthetic oligonucleotide
  Description of Combined DNA/RNA Molecule: Synthetic oligonucleotide
ugcucagtgcatcctuggcg

SEQ ID NO: 1986 - DNA, 20 bp, Artificial Sequence
  Description of Artificial Sequence: Synthetic oligonucleotide
  Description of Combined DNA/RNA Molecule: Synthetic oligonucleotide
ccugggactcctgcacgcug

SEQ ID NO: 1987 - RNA, 20 nt, Artificial Sequence
  Description of Artificial Sequence: Synthetic oligonucleotide
ucggucacccagccccuggc

SEQ ID NO: 1988 - DNA, 20 bp, Artificial Sequence
  Description of Artificial Sequence: Synthetic oligonucleotide
  Description of Combined DNA/RNA Molecule: Synthetic oligonucleotide
aucggtcacccagccccugg

SEQ ID NO: 1989 - DNA, 20 bp, Artificial Sequence
  Description of Artificial Sequence: Synthetic oligonucleotide
  Description of Combined DNA/RNA Molecule: Synthetic oligonucleotide
caucggtcacccagccccug

SEQ ID NO: 1990 - DNA, 20 bp, Artificial Sequence
  Description of Artificial Sequence: Synthetic oligonucleotide
  Description of Combined DNA/RNA Molecule: Synthetic oligonucleotide
ccaucggtcacccagccccu

SEQ ID NO: 1991 - DNA, 20 bp, Artificial Sequence
  Description of Artificial Sequence: Synthetic oligonucleotide
  Description of Combined DNA/RNA Molecule: Synthetic oligonucleotide
gccaucggtcacccagcccc

SEQ ID NO: 1992 - DNA, 20 bp, Artificial Sequence
  Description of Artificial Sequence: Synthetic oligonucleotide
agccatcggtcacccagccc

SEQ ID NO: 1993 - DNA, 20 bp, Artificial Sequence
  Description of Artificial Sequence: Synthetic oligonucleotide
  Description of Combined DNA/RNA Molecule: Synthetic oligonucleotide
uccagctttattgggaggcc

SEQ ID NO: 1994 - DNA, 20 bp, Artificial Sequence
  Description of Artificial Sequence: Synthetic oligonucleotide
  Description of Combined DNA/RNA Molecule: Synthetic oligonucleotide
cacgctgctcagtgcauccu

SEQ ID NO: 1995 - DNA, 20 bp, Artificial Sequence
  Description of Artificial Sequence: Synthetic oligonucleotide
  Description of Combined DNA/RNA Molecule: Synthetic oligonucleotide
cuccugcacgctgctcagug

SEQ ID NO: 1996 - DNA, 20 bp, Artificial Sequence
  Description of Artificial Sequence: Synthetic oligonucleotide
  Description of Combined DNA/RNA Molecule: Synthetic oligonucleotide
gggactcctgcacgcugcuc

SEQ ID NO: 1997 - DNA, 20 bp, Artificial Sequence
  Description of Artificial Sequence: Synthetic oligonucleotide
  Description of Combined DNA/RNA Molecule: Synthetic oligonucleotide
ugggactcctgcacgcugcu

SEQ ID NO: 1998 - DNA, 20 bp, Artificial Sequence
  Description of Artificial Sequence: Synthetic oligonucleotide
  Description of Combined DNA/RNA Molecule: Synthetic oligonucleotide
agguctcaggcagccacggc

SEQ ID NO: 1999 - DNA, 20 bp, Artificial Sequence
  Description of Artificial Sequence: Synthetic oligonucleotide
  Description of Combined DNA/RNA Molecule: Synthetic oligonucleotide
gagguctcaggcagccacgg

SEQ ID NO: 2000 - DNA, 20 bp, Artificial Sequence
  Description of Artificial Sequence: Synthetic oligonucleotide
  Description of Combined DNA/RNA Molecule: Synthetic oligonucleotide
ugaggtctcaggcagccacg

SEQ ID NO: 2001 - DNA, 20 bp, Artificial Sequence
  Description of Artificial Sequence: Synthetic oligonucleotide
  Description of Combined DNA/RNA Molecule: Synthetic oligonucleotide
ccuggagattgcaggaccca

SEQ ID NO: 2002 - DNA, 20 bp, Artificial Sequence
  Description of Artificial Sequence: Synthetic oligonucleotide
  Description of Combined DNA/RNA Molecule: Synthetic oligonucleotide
gcccuggagattgcaggacc

SEQ ID NO: 2003 - DNA, 20 bp, Artificial Sequence
  Description of Artificial Sequence: Synthetic oligonucleotide
  Description of Combined DNA/RNA Molecule: Synthetic oligonucleotide
cgugcttcatgtaacccugc

SEQ ID NO: 2004 - DNA, 20 bp, Artificial Sequence
  Description of Artificial Sequence: Synthetic oligonucleotide
  Description of Combined DNA/RNA Molecule: Synthetic oligonucleotide
ugguctgacctcagggucca

SEQ ID NO: 2005 - DNA, 20 bp, Artificial Sequence
  Description of Artificial Sequence: Synthetic oligonucleotide
  Description of Combined DNA/RNA Molecule: Synthetic oligonucleotide
aaguuggtctgacctcaggg

SEQ ID NO: 2006 - DNA, 20 bp, Artificial Sequence
  Description of Artificial Sequence: Synthetic oligonucleotide
  Description of Combined DNA/RNA Molecule: Synthetic oligonucleotide
ccacggctgaagttggucug

SEQ ID NO: 2007 - DNA, 20 bp, Artificial Sequence
  Description of Artificial Sequence: Synthetic oligonucleotide
  Description of Combined DNA/RNA Molecule: Synthetic oligonucleotide
agccacggctgaagtugguc

SEQ ID NO: 2008 - DNA, 20 bp, Artificial Sequence
  Description of Artificial Sequence: Synthetic oligonucleotide
  Description of Combined DNA/RNA Molecule: Synthetic oligonucleotide
gucuuggtggcgtgcuucau

SEQ ID NO: 2009 - DNA, 20 bp, Artificial Sequence
  Description of Artificial Sequence: Synthetic oligonucleotide
  Description of Combined DNA/RNA Molecule: Synthetic oligonucleotide
gcgugcttcatgtaacccug

SEQ ID NO: 2010 - DNA, 20 bp, Artificial Sequence
  Description of Artificial Sequence: Synthetic oligonucleotide
  Description of Combined DNA/RNA Molecule: Synthetic oligonucleotide
gcugaagttggtctgaccuc

SEQ ID NO: 2011 - DNA, 20 bp, Artificial Sequence
  Description of Artificial Sequence: Synthetic oligonucleotide
gggcctcccaaggcaaaccc

SEQ ID NO: 2012 - DNA, 20 bp, Artificial Sequence
  Description of Artificial Sequence: Synthetic oligonucleotide
  Description of Combined DNA/RNA Molecule: Synthetic oligonucleotide
aaccutagctgggtcugcca

SEQ ID NO: 2013 - DNA, 20 bp, Artificial Sequence
  Description of Artificial Sequence: Synthetic oligonucleotide
  Description of Combined DNA/RNA Molecule: Synthetic oligonucleotide
uuguccagctttattgggag

SEQ ID NO: 2014 - DNA, 20 bp, Artificial Sequence
  Description of Artificial Sequence: Synthetic oligonucleotide
  Description of Combined DNA/RNA Molecule: Synthetic oligonucleotide
cuuguccagctttatuggga

SEQ ID NO: 2015 - DNA, 20 bp, Artificial Sequence
  Description of Artificial Sequence: Synthetic oligonucleotide
  Description of Combined DNA/RNA Molecule: Synthetic oligonucleotide
ucuugtccagctttauuggg

SEQ ID NO: 2016 - DNA, 20 bp, Artificial Sequence
  Description of Artificial Sequence: Synthetic oligonucleotide
  Description of Combined DNA/RNA Molecule: Synthetic oligonucleotide
uucuugtccagctttauugg

SEQ ID NO: 2017 - DNA, 20 bp, Artificial Sequence
  Description of Artificial Sequence: Synthetic oligonucleotide
  Description of Combined DNA/RNA Molecule: Synthetic oligonucleotide
cuucutgtccagcttuauug

SEQ ID NO: 2018 - DNA, 20 bp, Artificial Sequence
  Description of Artificial Sequence: Synthetic oligonucleotide
  Description of Combined DNA/RNA Molecule: Synthetic oligonucleotide
gcuucttgtccagctuuauu

SEQ ID NO: 2019 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 2020 - DNA, 20 bp, Artificial Sequence
  Description of Artificial Sequence: Synthetic oligonucleotide
  Description of Combined DNA/RNA Molecule: Synthetic oligonucleotide
cagcutcttgtccagcuuua

SEQ ID NO: 2021 - DNA, 20 bp, Artificial Sequence
  Description of Artificial Sequence: Synthetic oligonucleotide
  Description of Combined DNA/RNA Molecule: Synthetic oligonucleotide
gcagcttcttgtccagcuuu

SEQ ID NO: 2022 - DNA, 20 bp, Artificial Sequence
  Description of Artificial Sequence: Synthetic oligonucleotide
  Description of Combined DNA/RNA Molecule: Synthetic oligonucleotide
agcagcttcttgtccagcuu

SEQ ID NO: 2023 - DNA, 20 bp, Artificial Sequence
  Description of Artificial Sequence: Synthetic oligonucleotide
  Description of Combined DNA/RNA Molecule: Synthetic oligonucleotide
uagcagcttcttgtccagcu

SEQ ID NO: 2024 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 2025 - DNA, 20 bp, Artificial Sequence
  Description of Artificial Sequence: Synthetic oligonucleotide
  Description of Combined DNA/RNA Molecule: Synthetic oligonucleotide
cauagcagcttcttguccag

SEQ ID NO: 2026 - DNA, 20 bp, Artificial Sequence
  Description of Artificial Sequence: Synthetic oligonucleotide
  Description of Combined DNA/RNA Molecule: Synthetic oligonucleotide
uuguccagctttattgggag

SEQ ID NO: 2027 - DNA, 20 bp, Artificial Sequence
  Description of Artificial Sequence: Synthetic oligonucleotide
  Description of Combined DNA/RNA Molecule: Synthetic oligonucleotide
cuuguccagctttatuggga

SEQ ID NO: 2028 - DNA, 20 bp, Artificial Sequence
  Description of Artificial Sequence: Synthetic oligonucleotide
  Description of Combined DNA/RNA Molecule: Synthetic oligonucleotide
ucuugtccagctttauuggg

SEQ ID NO: 2029 - DNA, 20 bp, Artificial Sequence
  Description of Artificial Sequence: Synthetic oligonucleotide
  Description of Combined DNA/RNA Molecule: Synthetic oligonucleotide
uucuugtccagctttauugg

SEQ ID NO: 2030 - DNA, 20 bp, Artificial Sequence
  Description of Artificial Sequence: Synthetic oligonucleotide
  Description of Combined DNA/RNA Molecule: Synthetic oligonucleotide
cuucutgtccagcttuauug

SEQ ID NO: 2031 - DNA, 20 bp, Artificial Sequence
  Description of Artificial Sequence: Synthetic oligonucleotide
  Description of Combined DNA/RNA Molecule: Synthetic oligonucleotide
gcuucttgtccagctuuauu

SEQ ID NO: 2032 - DNA, 20 bp, Artificial Sequence
  Description of Artificial Sequence: Synthetic oligonucleotide
  Description of Combined DNA/RNA Molecule: Synthetic oligonucleotide
agcuucttgtccagcuuuau

SEQ ID NO: 2033 - DNA, 20 bp, Artificial Sequence
  Description of Artificial Sequence: Synthetic oligonucleotide
  Description of Combined DNA/RNA Molecule: Synthetic oligonucleotide
cagcutcttgtccagcuuua

SEQ ID NO: 2034 - DNA, 20 bp, Artificial Sequence
  Description of Artificial Sequence: Synthetic oligonucleotide
  Description of Combined DNA/RNA Molecule: Synthetic oligonucleotide
gcagcttcttgtccagcuuu

SEQ ID NO: 2035 - DNA, 20 bp, Artificial Sequence
  Description of Artificial Sequence: Synthetic oligonucleotide
  Description of Combined DNA/RNA Molecule: Synthetic oligonucleotide
agcagcttcttgtccagcuu

SEQ ID NO: 2036 - DNA, 20 bp, Artificial Sequence
  Description of Artificial Sequence: Synthetic oligonucleotide
  Description of Combined DNA/RNA Molecule: Synthetic oligonucleotide
uagcagcttcttgtccagcu

SEQ ID NO: 2037 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 2038 - DNA, 20 bp, Artificial Sequence
  Description of Artificial Sequence: Synthetic oligonucleotide
  Description of Combined DNA/RNA Molecule: Synthetic oligonucleotide
cauagcagcttcttguccag

SEQ ID NO: 2039 - DNA, 20 bp, Artificial Sequence
  Description of Artificial Sequence: Synthetic oligonucleotide
agcttcttgtccagctttat

SEQ ID NO: 2040 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 2041 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 2042 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 2043 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 2044 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 2045 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 2046 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 2047 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 2048 - DNA, 20 bp, Artificial Sequence
  Description of Artificial Sequence: Synthetic oligonucleotide
ggagcagctgcctctaggga

SEQ ID NO: 2049 - DNA, 20 bp, Artificial Sequence
  Description of Artificial Sequence: Synthetic oligonucleotide
  Description of Combined DNA/RNA Molecule: Synthetic oligonucleotide
uggagcagctgcctcuaggg

SEQ ID NO: 2050 - DNA, 20 bp, Artificial Sequence
  Description of Artificial Sequence: Synthetic oligonucleotide
  Description of Combined DNA/RNA Molecule: Synthetic oligonucleotide
uguucctggagcagcugccu

SEQ ID NO: 2051 - DNA, 20 bp, Artificial Sequence
  Description of Artificial Sequence: Synthetic oligonucleotide
  Description of Combined DNA/RNA Molecule: Synthetic oligonucleotide
uccuuggcggtcttgguggc

SEQ ID NO: 2052 - DNA, 20 bp, Artificial Sequence
  Description of Artificial Sequence: Synthetic oligonucleotide
  Description of Combined DNA/RNA Molecule: Synthetic oligonucleotide
auccutggcggtcttggugg

SEQ ID NO: 2053 - DNA, 20 bp, Artificial Sequence
  Description of Artificial Sequence: Synthetic oligonucleotide
  Description of Combined DNA/RNA Molecule: Synthetic oligonucleotide
cauccttggcggtctuggug

SEQ ID NO: 2054 - DNA, 20 bp, Artificial Sequence
  Description of Artificial Sequence: Synthetic oligonucleotide
  Description of Combined DNA/RNA Molecule: Synthetic oligonucleotide
gcauccttggcggtcuuggu

SEQ ID NO: 2055 - DNA, 20 bp, Artificial Sequence
  Description of Artificial Sequence: Synthetic oligonucleotide
  Description of Combined DNA/RNA Molecule: Synthetic oligonucleotide
cuggcctgctgggccaccug

SEQ ID NO: 2056 - DNA, 20 bp, Artificial Sequence
  Description of Artificial Sequence: Synthetic oligonucleotide
  Description of Combined DNA/RNA Molecule: Synthetic oligonucleotide
ggcggtcttggtggcgugcu

SEQ ID NO: 2057 - DNA, 20 bp, Artificial Sequence
  Description of Artificial Sequence: Synthetic oligonucleotide
  Description of Combined DNA/RNA Molecule: Synthetic oligonucleotide
uggcggtcttggtggcgugc

SEQ ID NO: 2058 - DNA, 20 bp, Artificial Sequence
  Description of Artificial Sequence: Synthetic oligonucleotide
  Description of Combined DNA/RNA Molecule: Synthetic oligonucleotide
uuggcggtcttggtggcgug

SEQ ID NO: 2059 - DNA, 20 bp, Artificial Sequence
  Description of Artificial Sequence: Synthetic oligonucleotide
  Description of Combined DNA/RNA Molecule: Synthetic oligonucleotide
cuuggcggtcttggtggcgu

SEQ ID NO: 2060 - DNA, 20 bp, Artificial Sequence
  Description of Artificial Sequence: Synthetic oligonucleotide
  Description of Combined DNA/RNA Molecule: Synthetic oligonucleotide
ccuuggcggtcttgguggcg

SEQ ID NO: 2061 - DNA, 20 bp, Artificial Sequence
  Description of Artificial Sequence: Synthetic oligonucleotide
gcccctggcctgctgggcca

SEQ ID NO: 2062 - DNA, 20 bp, Artificial Sequence
  Description of Artificial Sequence: Synthetic oligonucleotide
ggcagaggccaggagcgcca

SEQ ID NO: 2063 - DNA, 20 bp, Artificial Sequence
  Description of Artificial Sequence: Synthetic oligonucleotide
  Description of Combined DNA/RNA Molecule: Synthetic oligonucleotide
gaggcatcctcggccucuga

SEQ ID NO: 2064 - DNA, 20 bp, Artificial Sequence
  Description of Artificial Sequence: Synthetic oligonucleotide
  Description of Combined DNA/RNA Molecule: Synthetic oligonucleotide
ggaggcatcctcggccucug

SEQ ID NO: 2065 - DNA, 20 bp, Artificial Sequence
  Description of Artificial Sequence: Synthetic oligonucleotide
  Description of Combined DNA/RNA Molecule: Synthetic oligonucleotide
gggaggcatcctcggccucu

SEQ ID NO: 2066 - DNA, 20 bp, Artificial Sequence
  Description of Artificial Sequence: Synthetic oligonucleotide
  Description of Combined DNA/RNA Molecule: Synthetic oligonucleotide
agggaggcatcctcggccuc

SEQ ID NO: 2067 - DNA, 20 bp, Artificial Sequence
  Description of Artificial Sequence: Synthetic oligonucleotide
  Description of Combined DNA/RNA Molecule: Synthetic oligonucleotide
aagggaggcatcctcggccu

SEQ ID NO: 2068 - DNA, 20 bp, Artificial Sequence
  Description of Artificial Sequence: Synthetic oligonucleotide
gaagggaggcatcctcggcc

SEQ ID NO: 2069 - DNA, 20 bp, Artificial Sequence
  Description of Artificial Sequence: Synthetic oligonucleotide
  Description of Combined DNA/RNA Molecule: Synthetic oligonucleotide
ggucutggtggcgtgcuuca

SEQ ID NO: 2070 - DNA, 20 bp, Artificial Sequence
  Description of Artificial Sequence: Synthetic oligonucleotide
  Description of Combined DNA/RNA Molecule: Synthetic oligonucleotide
gcggucttggtggcgugcuu

SEQ ID NO: 2071 - RNA, 20 nt, Artificial Sequence
  Description of Artificial Sequence: Synthetic oligonucleotide
gucucaggcagccacggcug

SEQ ID NO: 2072 - DNA, 20 bp, Artificial Sequence
  Description of Artificial Sequence: Synthetic oligonucleotide
aggccagcatgcctggaggg

SEQ ID NO: 2073 - DNA, 20 bp, Artificial Sequence
  Description of Artificial Sequence: Synthetic oligonucleotide
  Description of Combined DNA/RNA Molecule: Synthetic oligonucleotide
ugcauccttggcggtcuugg

SEQ ID NO: 2074 - DNA, 20 bp, Artificial Sequence
  Description of Artificial Sequence: Synthetic oligonucleotide
  Description of Combined DNA/RNA Molecule: Synthetic oligonucleotide
gugcatccttggcggucuug

SEQ ID NO: 2075 - DNA, 20 bp, Artificial Sequence
  Description of Artificial Sequence: Synthetic oligonucleotide
  Description of Combined DNA/RNA Molecule: Synthetic oligonucleotide
cugcugggccacctgggacu

SEQ ID NO: 2076 - DNA, 20 bp, Artificial Sequence
  Description of Artificial Sequence: Synthetic oligonucleotide
  Description of Combined DNA/RNA Molecule: Synthetic oligonucleotide
ugaagccatcggtcacccag

SEQ ID NO: 2077 - DNA, 20 bp, Artificial Sequence
  Description of Artificial Sequence: Synthetic oligonucleotide
  Description of Combined DNA/RNA Molecule: Synthetic oligonucleotide
cugaagccatcggtcaccca

SEQ ID NO: 2078 - DNA, 20 bp, Artificial Sequence
  Description of Artificial Sequence: Synthetic oligonucleotide
  Description of Combined DNA/RNA Molecule: Synthetic oligonucleotide
cuuguccttaacggtgcucc

SEQ ID NO: 2079 - DNA, 20 bp, Artificial Sequence
  Description of Artificial Sequence: Synthetic oligonucleotide
  Description of Combined DNA/RNA Molecule: Synthetic oligonucleotide
uguccagctttattgggagg

SEQ ID NO: 2080 - DNA, 20 bp, Artificial Sequence
  Description of Artificial Sequence: Synthetic oligonucleotide
  Description of Combined DNA/RNA Molecule: Synthetic oligonucleotide
ugccuctagggatgaacuga

SEQ ID NO: 2081 - DNA, 20 bp, Artificial Sequence
  Description of Artificial Sequence: Synthetic oligonucleotide
  Description of Combined DNA/RNA Molecule: Synthetic oligonucleotide
cugcatggcacctctguucc

SEQ ID NO: 2082 - DNA, 20 bp, Artificial Sequence
  Description of Artificial Sequence: Synthetic oligonucleotide
  Description of Combined DNA/RNA Molecule: Synthetic oligonucleotide
gggcugcatggcaccucugu

SEQ ID NO: 2083 - DNA, 20 bp, Artificial Sequence
  Description of Artificial Sequence: Synthetic oligonucleotide
  Description of Combined DNA/RNA Molecule: Synthetic oligonucleotide
cucugaagctcgggcagagg

SEQ ID NO: 2084 - DNA, 20 bp, Artificial Sequence
  Description of Artificial Sequence: Synthetic oligonucleotide
  Description of Combined DNA/RNA Molecule: Synthetic oligonucleotide
ccucugaagctcgggcagag

SEQ ID NO: 2085 - DNA, 20 bp, Artificial Sequence
  Description of Artificial Sequence: Synthetic oligonucleotide
  Description of Combined DNA/RNA Molecule: Synthetic oligonucleotide
gccuctgaagctcgggcaga

SEQ ID NO: 2086 - DNA, 20 bp, Artificial Sequence
  Description of Artificial Sequence: Synthetic oligonucleotide
cggcctctgaagctcgggca

SEQ ID NO: 2087 - DNA, 20 bp, Artificial Sequence
  Description of Artificial Sequence: Synthetic oligonucleotide
  Description of Combined DNA/RNA Molecule: Synthetic oligonucleotide
ucggcctctgaagctcgggc

SEQ ID NO: 2088 - DNA, 20 bp, Artificial Sequence
  Description of Artificial Sequence: Synthetic oligonucleotide
  Description of Combined DNA/RNA Molecule: Synthetic oligonucleotide
cucggcctctgaagcucggg

SEQ ID NO: 2089 - DNA, 20 bp, Artificial Sequence
  Description of Artificial Sequence: Synthetic oligonucleotide
  Description of Combined DNA/RNA Molecule: Synthetic oligonucleotide
ccucggcctctgaagcucgg

SEQ ID NO: 2090 - DNA, 20 bp, Artificial Sequence
  Description of Artificial Sequence: Synthetic oligonucleotide
  Description of Combined DNA/RNA Molecule: Synthetic oligonucleotide
uccucggcctctgaagcucg

SEQ ID NO: 2091 - DNA, 20 bp, Artificial Sequence
  Description of Artificial Sequence: Synthetic oligonucleotide
  Description of Combined DNA/RNA Molecule: Synthetic oligonucleotide
ugcucagtgcatcctuggcg

SEQ ID NO: 2092 - DNA, 20 bp, Artificial Sequence
  Description of Artificial Sequence: Synthetic oligonucleotide
  Description of Combined DNA/RNA Molecule: Synthetic oligonucleotide
ccugggactcctgcacgcug

SEQ ID NO: 2093 - DNA, 20 bp, Artificial Sequence
  Description of Artificial Sequence: Synthetic oligonucleotide
ccacctgggactcctgcacg

SEQ ID NO: 2094 - RNA, 20 nt, Artificial Sequence
  Description of Artificial Sequence: Synthetic oligonucleotide
ucggucacccagccccuggc

SEQ ID NO: 2095 - DNA, 20 bp, Artificial Sequence
  Description of Artificial Sequence: Synthetic oligonucleotide
  Description of Combined DNA/RNA Molecule: Synthetic oligonucleotide
aucggtcacccagccccugg

SEQ ID NO: 2096 - DNA, 20 bp, Artificial Sequence
  Description of Artificial Sequence: Synthetic oligonucleotide
  Description of Combined DNA/RNA Molecule: Synthetic oligonucleotide
caucggtcacccagccccug

SEQ ID NO: 2097 - DNA, 20 bp, Artificial Sequence
  Description of Artificial Sequence: Synthetic oligonucleotide
  Description of Combined DNA/RNA Molecule: Synthetic oligonucleotide
ccaucggtcacccagccccu

SEQ ID NO: 2098 - DNA, 20 bp, Artificial Sequence
  Description of Artificial Sequence: Synthetic oligonucleotide
  Description of Combined DNA/RNA Molecule: Synthetic oligonucleotide
gccaucggtcacccagcccc

SEQ ID NO: 2099 - DNA, 20 bp, Artificial Sequence
  Description of Artificial Sequence: Synthetic oligonucleotide
agccatcggtcacccagccc

SEQ ID NO: 2100 - DNA, 20 bp, Artificial Sequence
  Description of Artificial Sequence: Synthetic oligonucleotide
  Description of Combined DNA/RNA Molecule: Synthetic oligonucleotide
uccagctttattgggaggcc

SEQ ID NO: 2101 - DNA, 20 bp, Artificial Sequence
  Description of Artificial Sequence: Synthetic oligonucleotide
  Description of Combined DNA/RNA Molecule: Synthetic oligonucleotide
caucctcggcctctgaagcu

SEQ ID NO: 2102 - DNA, 20 bp, Artificial Sequence
  Description of Artificial Sequence: Synthetic oligonucleotide
  Description of Combined DNA/RNA Molecule: Synthetic oligonucleotide
aggcatcctcggcctcugaa

SEQ ID NO: 2103 - DNA, 20 bp, Artificial Sequence
  Description of Artificial Sequence: Synthetic oligonucleotide
  Description of Combined DNA/RNA Molecule: Synthetic oligonucleotide
ucuuggtggcgtgctucaug

SEQ ID NO: 2104 - DNA, 20 bp, Artificial Sequence
  Description of Artificial Sequence: Synthetic oligonucleotide
  Description of Combined DNA/RNA Molecule: Synthetic oligonucleotide
cacgctgctcagtgcauccu

SEQ ID NO: 2105 - DNA, 20 bp, Artificial Sequence
  Description of Artificial Sequence: Synthetic oligonucleotide
  Description of Combined DNA/RNA Molecule: Synthetic oligonucleotide
cuccugcacgctgctcagug

SEQ ID NO: 2106 - DNA, 20 bp, Artificial Sequence
  Description of Artificial Sequence: Synthetic oligonucleotide
  Description of Combined DNA/RNA Molecule: Synthetic oligonucleotide
ggacucctgcacgctgcuca

SEQ ID NO: 2107 - DNA, 20 bp, Artificial Sequence
  Description of Artificial Sequence: Synthetic oligonucleotide
  Description of Combined DNA/RNA Molecule: Synthetic oligonucleotide
gggactcctgcacgcugcuc

SEQ ID NO: 2108 - DNA, 20 bp, Artificial Sequence
  Description of Artificial Sequence: Synthetic oligonucleotide
  Description of Combined DNA/RNA Molecule: Synthetic oligonucleotide
ugggactcctgcacgcugcu

SEQ ID NO: 2109 - DNA, 20 bp, Artificial Sequence
  Description of Artificial Sequence: Synthetic oligonucleotide
  Description of Combined DNA/RNA Molecule: Synthetic oligonucleotide
agguctcaggcagccacggc

SEQ ID NO: 2110 - DNA, 20 bp, Artificial Sequence
  Description of Artificial Sequence: Synthetic oligonucleotide
  Description of Combined DNA/RNA Molecule: Synthetic oligonucleotide
gagguctcaggcagccacgg

SEQ ID NO: 2111 - DNA, 20 bp, Artificial Sequence
  Description of Artificial Sequence: Synthetic oligonucleotide
  Description of Combined DNA/RNA Molecule: Synthetic oligonucleotide
ugaggtctcaggcagccacg

SEQ ID NO: 2112 - DNA, 20 bp, Artificial Sequence
  Description of Artificial Sequence: Synthetic oligonucleotide
  Description of Combined DNA/RNA Molecule: Synthetic oligonucleotide
ccuggagattgcaggaccca

SEQ ID NO: 2113 - DNA, 20 bp, Artificial Sequence
  Description of Artificial Sequence: Synthetic oligonucleotide
  Description of Combined DNA/RNA Molecule: Synthetic oligonucleotide
gcccuggagattgcaggacc

SEQ ID NO: 2114 - DNA, 20 bp, Artificial Sequence
  Description of Artificial Sequence: Synthetic oligonucleotide
ccaggagcgccaggagggca

SEQ ID NO: 2115 - DNA, 20 bp, Artificial Sequence
  Description of Artificial Sequence: Synthetic oligonucleotide
  Description of Combined DNA/RNA Molecule: Synthetic oligonucleotide
cgugcttcatgtaacccugc

SEQ ID NO: 2116 - DNA, 20 bp, Artificial Sequence
  Description of Artificial Sequence: Synthetic oligonucleotide
  Description of Combined DNA/RNA Molecule: Synthetic oligonucleotide
ugguctgacctcagggucca

SEQ ID NO: 2117 - DNA, 20 bp, Artificial Sequence
  Description of Artificial Sequence: Synthetic oligonucleotide
  Description of Combined DNA/RNA Molecule: Synthetic oligonucleotide
uugguctgacctcagggucc

SEQ ID NO: 2118 - DNA, 20 bp, Artificial Sequence
  Description of Artificial Sequence: Synthetic oligonucleotide
  Description of Combined DNA/RNA Molecule: Synthetic oligonucleotide
aaguuggtctgacctcaggg

SEQ ID NO: 2119 - DNA, 20 bp, Artificial Sequence
  Description of Artificial Sequence: Synthetic oligonucleotide
  Description of Combined DNA/RNA Molecule: Synthetic oligonucleotide
ugaagttggtctgaccucag

SEQ ID NO: 2120 - DNA, 20 bp, Artificial Sequence
  Description of Artificial Sequence: Synthetic oligonucleotide
  Description of Combined DNA/RNA Molecule: Synthetic oligonucleotide
cacggctgaagttggucuga

SEQ ID NO: 2121 - DNA, 20 bp, Artificial Sequence
  Description of Artificial Sequence: Synthetic oligonucleotide
  Description of Combined DNA/RNA Molecule: Synthetic oligonucleotide
ccacggctgaagttggucug

SEQ ID NO: 2122 - DNA, 20 bp, Artificial Sequence
  Description of Artificial Sequence: Synthetic oligonucleotide
  Description of Combined DNA/RNA Molecule: Synthetic oligonucleotide
gccacggctgaagttggucu

SEQ ID NO: 2123 - DNA, 20 bp, Artificial Sequence
  Description of Artificial Sequence: Synthetic oligonucleotide
  Description of Combined DNA/RNA Molecule: Synthetic oligonucleotide
agccacggctgaagtugguc

SEQ ID NO: 2124 - DNA, 20 bp, Artificial Sequence
  Description of Artificial Sequence: Synthetic oligonucleotide
  Description of Combined DNA/RNA Molecule: Synthetic oligonucleotide
gucuuggtggcgtgcuucau

SEQ ID NO: 2125 - DNA, 20 bp, Artificial Sequence
  Description of Artificial Sequence: Synthetic oligonucleotide
  Description of Combined DNA/RNA Molecule: Synthetic oligonucleotide
cagugcatccttggcggucu

SEQ ID NO: 2126 - DNA, 20 bp, Artificial Sequence
  Description of Artificial Sequence: Synthetic oligonucleotide
  Description of Combined DNA/RNA Molecule: Synthetic oligonucleotide
cugcctctagggatgaacug

SEQ ID NO: 2127 - DNA, 20 bp, Artificial Sequence
  Description of Artificial Sequence: Synthetic oligonucleotide
  Description of Combined DNA/RNA Molecule: Synthetic oligonucleotide
ggcaucctcggcctcugaag

SEQ ID NO: 2128 - DNA, 20 bp, Artificial Sequence
  Description of Artificial Sequence: Synthetic oligonucleotide
  Description of Combined DNA/RNA Molecule: Synthetic oligonucleotide
uugguggcgtgcttcaugua

SEQ ID NO: 2129 - DNA, 20 bp, Artificial Sequence
  Description of Artificial Sequence: Synthetic oligonucleotide
  Description of Combined DNA/RNA Molecule: Synthetic oligonucleotide
gcgugcttcatgtaacccug

SEQ ID NO: 2130 - DNA, 20 bp, Artificial Sequence
  Description of Artificial Sequence: Synthetic oligonucleotide
  Description of Combined DNA/RNA Molecule: Synthetic oligonucleotide
ugagaagggaggcatccucg

SEQ ID NO: 2131 - DNA, 20 bp, Artificial Sequence
  Description of Artificial Sequence: Synthetic oligonucleotide
  Description of Combined DNA/RNA Molecule: Synthetic oligonucleotide
gcugaagttggtctgaccuc

SEQ ID NO: 2132 - DNA, 20 bp, Artificial Sequence
  Description of Artificial Sequence: Synthetic oligonucleotide
gggcctcccaaggcaaaccc

SEQ ID NO: 2133 - DNA, 20 bp, Artificial Sequence
  Description of Artificial Sequence: Synthetic oligonucleotide
  Description of Combined DNA/RNA Molecule: Synthetic oligonucleotide
guuuatgcccctgggccuga

SEQ ID NO: 2134 - DNA, 20 bp, Artificial Sequence
  Description of Artificial Sequence: Synthetic oligonucleotide
  Description of Combined DNA/RNA Molecule: Synthetic oligonucleotide
aaccutagctgggtcugcca

SEQ ID NO: 2135 - DNA, 20 bp, Artificial Sequence
  Description of Artificial Sequence: Synthetic oligonucleotide
  Description of Combined DNA/RNA Molecule: Synthetic oligonucleotide
cacccattgggactgggauc

SEQ ID NO: 2136 - DNA, 20 bp, Artificial Sequence
  Description of Artificial Sequence: Synthetic oligonucleotide
  Description of Combined DNA/RNA Molecule: Synthetic oligonucleotide
cuccugcttgaccacccauu

SEQ ID NO: 2137 - DNA, 20 bp, Artificial Sequence
  Description of Artificial Sequence: Synthetic oligonucleotide
  Description of Combined DNA/RNA Molecule: Synthetic oligonucleotide
gcucctgcttgaccacccau

SEQ ID NO: 2138 - DNA, 20 bp, Artificial Sequence
  Description of Artificial Sequence: Synthetic oligonucleotide
  Description of Combined DNA/RNA Molecule: Synthetic oligonucleotide
ugggctcctgcttgaccacc

SEQ ID NO: 2139 - DNA, 45 bp, Artificial Sequence
  Description of Artificial Sequence: Synthetic oligonucleotide
  Description of Combined DNA/RNA Molecule: Synthetic oligonucleotide
tguccagcuuuauugggagtutttttggtaatccactttcagagg

SEQ ID NO: 2140 - DNA, 45 bp, Artificial Sequence; identical to SEQ ID NO: 2139
  Description of Artificial Sequence: Synthetic oligonucleotide
  Description of Combined DNA/RNA Molecule: Synthetic oligonucleotide

SEQ ID NO: 2141 - DNA, 45 bp, Artificial Sequence; identical to SEQ ID NO: 2139
  Description of Artificial Sequence: Synthetic oligonucleotide
  Description of Combined DNA/RNA Molecule: Synthetic oligonucleotide

SEQ ID NO: 2142 - DNA, 45 bp, Artificial Sequence; identical to SEQ ID NO: 2139
  Description of Artificial Sequence: Synthetic oligonucleotide
  Description of Combined DNA/RNA Molecule: Synthetic oligonucleotide

SEQ ID NO: 2143 - DNA, 45 bp, Artificial Sequence; identical to SEQ ID NO: 2139
  Description of Artificial Sequence: Synthetic oligonucleotide
  Description of Combined DNA/RNA Molecule: Synthetic oligonucleotide

SEQ ID NO: 2144 - DNA, 45 bp, Artificial Sequence; identical to SEQ ID NO: 2139
  Description of Artificial Sequence: Synthetic oligonucleotide
  Description of Combined DNA/RNA Molecule: Synthetic oligonucleotide

SEQ ID NO: 2145 - DNA, 45 bp, Artificial Sequence; identical to SEQ ID NO: 2139
  Description of Artificial Sequence: Synthetic oligonucleotide
  Description of Combined DNA/RNA Molecule: Synthetic oligonucleotide

SEQ ID NO: 2146 - DNA, 45 bp, Artificial Sequence; identical to SEQ ID NO: 2139
  Description of Artificial Sequence: Synthetic oligonucleotide
  Description of Combined DNA/RNA Molecule: Synthetic oligonucleotide

SEQ ID NO: 2147 - DNA, 45 bp, Artificial Sequence; identical to SEQ ID NO: 2139
  Description of Artificial Sequence: Synthetic oligonucleotide
  Description of Combined DNA/RNA Molecule: Synthetic oligonucleotide

SEQ ID NO: 2148 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2149 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2150 - DNA, 45 bp, Artificial Sequence; identical to SEQ ID NO: 2139
  Description of Artificial Sequence: Synthetic oligonucleotide
  Description of Combined DNA/RNA Molecule: Synthetic oligonucleotide

SEQ ID NO: 2151 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2152 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2153 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2154 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2155 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2156 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2157 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2158 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2159 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2160 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2161 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2162 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2163 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2164 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2165 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2166 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2167 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2168 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2169 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2170 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2171 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2172 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2173 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2174 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2175 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2176 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2177 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2178 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2179 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2180 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2181 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2182 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2183 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2184 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2185 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2186 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2187 - DNA, 20 bp, Artificial Sequence
  Description of Artificial Sequence: Synthetic oligonucleotide
cttgtccagctttattggga

SEQ ID NO: 2188 - DNA, 20 bp, Artificial Sequence
  Description of Artificial Sequence: Synthetic oligonucleotide
cttgtccagctttattggga

SEQ ID NO: 2189 - DNA, 20 bp, Artificial Sequence
  Description of Artificial Sequence: Synthetic oligonucleotide
cttgtccagctttattggga

SEQ ID NO: 2190 - DNA, 20 bp, Artificial Sequence
  Description of Artificial Sequence: Synthetic oligonucleotide
cttgtccagctttattggga

SEQ ID NO: 2191 - DNA, 20 bp, Artificial Sequence
  Description of Artificial Sequence: Synthetic oligonucleotide
  Description of Combined DNA/RNA Molecule: Synthetic oligonucleotide
cttgtccagctttatuggga

SEQ ID NO: 2192 - DNA, 20 bp, Artificial Sequence
  Description of Artificial Sequence: Synthetic oligonucleotide
  Description of Combined DNA/RNA Molecule: Synthetic oligonucleotide
cttgtccagctttatuggga

SEQ ID NO: 2193 - DNA, 20 bp, Artificial Sequence
  Description of Artificial Sequence: Synthetic oligonucleotide
  Description of Combined DNA/RNA Molecule: Synthetic oligonucleotide
cttgtccagctttatuggga

SEQ ID NO: 2194 - DNA, 20 bp, Artificial Sequence
  Description of Artificial Sequence: Synthetic oligonucleotide
  Description of Combined DNA/RNA Molecule: Synthetic oligonucleotide
cttgtccagctttatuggga

SEQ ID NO: 2195 - DNA, 20 bp, Artificial Sequence
  Description of Artificial Sequence: Synthetic oligonucleotide
atagcagcttcttgtccagc

SEQ ID NO: 2196 - DNA, 20 bp, Artificial Sequence
  Description of Artificial Sequence: Synthetic oligonucleotide
atagcagcttcttgtccagc

SEQ ID NO: 2197 - DNA, 20 bp, Artificial Sequence
  Description of Artificial Sequence: Synthetic oligonucleotide
atagcagcttcttgtccagc

SEQ ID NO: 2198 - DNA, 20 bp, Artificial Sequence
  Description of Artificial Sequence: Synthetic oligonucleotide
atagcagcttcttgtccagc

SEQ ID NO: 2199 - DNA, 20 bp, Artificial Sequence
  Description of Artificial Sequence: Synthetic oligonucleotide
atagcagcttcttgtccagc

SEQ ID NO: 2200 - DNA, 20 bp, Artificial Sequence
  Description of Artificial Sequence: Synthetic oligonucleotide
atagcagcttcttgtccagc

SEQ ID NO: 2201 - DNA, 20 bp, Artificial Sequence
  Description of Artificial Sequence: Synthetic oligonucleotide
atagcagcttcttgtccagc

SEQ ID NO: 2202 - DNA, 20 bp, Artificial Sequence
  Description of Artificial Sequence: Synthetic oligonucleotide
atagcagcttcttgtccagc

SEQ ID NO: 2203 - DNA, 20 bp, Artificial Sequence
  Description of Artificial Sequence: Synthetic oligonucleotide
cttgtccagctttattggga

SEQ ID NO: 2204 - DNA, 20 bp, Artificial Sequence
  Description of Artificial Sequence: Synthetic oligonucleotide
cttgtccagctttattggga

SEQ ID NO: 2205 - DNA, 20 bp, Artificial Sequence
  Description of Artificial Sequence: Synthetic oligonucleotide
cttgtccagctttattggga

SEQ ID NO: 2206 - DNA, 20 bp, Artificial Sequence
  Description of Artificial Sequence: Synthetic oligonucleotide
cttgtccagctttattggga

SEQ ID NO: 2207 - DNA, 20 bp, Artificial Sequence
  Description of Artificial Sequence: Synthetic oligonucleotide
  Description of Combined DNA/RNA Molecule: Synthetic oligonucleotide
cttgtccagctttatuggga

SEQ ID NO: 2208 - DNA, 20 bp, Artificial Sequence
  Description of Artificial Sequence: Synthetic oligonucleotide
  Description of Combined DNA/RNA Molecule: Synthetic oligonucleotide
cttgtccagctttatuggga

SEQ ID NO: 2209 - DNA, 20 bp, Artificial Sequence
  Description of Artificial Sequence: Synthetic oligonucleotide
  Description of Combined DNA/RNA Molecule: Synthetic oligonucleotide
cttgtccagctttatuggga

SEQ ID NO: 2210 - DNA, 20 bp, Artificial Sequence
  Description of Artificial Sequence: Synthetic oligonucleotide
  Description of Combined DNA/RNA Molecule: Synthetic oligonucleotide
cttgtccagctttatuggga

SEQ ID NO: 2211 - DNA, 20 bp, Artificial Sequence
  Description of Artificial Sequence: Synthetic oligonucleotide
atagcagcttcttgtccagc

SEQ ID NO: 2212 - DNA, 20 bp, Artificial Sequence
  Description of Artificial Sequence: Synthetic oligonucleotide
atagcagcttcttgtccagc

SEQ ID NO: 2213 - DNA, 20 bp, Artificial Sequence
  Description of Artificial Sequence: Synthetic oligonucleotide
atagcagcttcttgtccagc

SEQ ID NO: 2214 - DNA, 20 bp, Artificial Sequence
  Description of Artificial Sequence: Synthetic oligonucleotide
atagcagcttcttgtccagc

SEQ ID NO: 2215 - DNA, 20 bp, Artificial Sequence
  Description of Artificial Sequence: Synthetic oligonucleotide
atagcagcttcttgtccagc

SEQ ID NO: 2216 - DNA, 20 bp, Artificial Sequence
  Description of Artificial Sequence: Synthetic oligonucleotide
atagcagcttcttgtccagc

SEQ ID NO: 2217 - DNA, 20 bp, Artificial Sequence
  Description of Artificial Sequence: Synthetic oligonucleotide
atagcagcttcttgtccagc

SEQ ID NO: 2218 - DNA, 20 bp, Artificial Sequence
  Description of Artificial Sequence: Synthetic oligonucleotide
atagcagcttcttgtccagc

SEQ ID NO: 2219 - DNA, 20 bp, Artificial Sequence
  Description of Artificial Sequence: Synthetic oligonucleotide
atagcagcttcttgtccagc

SEQ ID NO: 2220 - DNA, 20 bp, Artificial Sequence
  Description of Artificial Sequence: Synthetic oligonucleotide
atagcagcttcttgtccagc

SEQ ID NO: 2221 - DNA, 20 bp, Artificial Sequence
  Description of Artificial Sequence: Synthetic oligonucleotide
atagcagcttcttgtccagc

SEQ ID NO: 2222 - DNA, 20 bp, Artificial Sequence
  Description of Artificial Sequence: Synthetic oligonucleotide
atagcagcttcttgtccagc

SEQ ID NO: 2223 - DNA, 20 bp, Artificial Sequence
  Description of Artificial Sequence: Synthetic oligonucleotide
atagcagcttcttgtccagc

SEQ ID NO: 2224 - DNA, 20 bp, Artificial Sequence
  Description of Artificial Sequence: Synthetic oligonucleotide
atagcagcttcttgtccagc

SEQ ID NO: 2225 - DNA, 20 bp, Artificial Sequence
  Description of Artificial Sequence: Synthetic oligonucleotide
atagcagcttcttgtccagc

SEQ ID NO: 2226 - DNA, 20 bp, Artificial Sequence
  Description of Artificial Sequence: Synthetic oligonucleotide
atagcagcttcttgtccagc

SEQ ID NO: 2227 - DNA, 20 bp, Artificial Sequence
  Description of Artificial Sequence: Synthetic oligonucleotide
  Description of Combined DNA/RNA Molecule: Synthetic oligonucleotide
cttguccagctttatuggga

SEQ ID NO: 2228 - DNA, 20 bp, Artificial Sequence
  Description of Artificial Sequence: Synthetic oligonucleotide
  Description of Combined DNA/RNA Molecule: Synthetic oligonucleotide
cttguccagctttatuggga

SEQ ID NO: 2229 - DNA, 20 bp, Artificial Sequence
  Description of Artificial Sequence: Synthetic oligonucleotide
  Description of Combined DNA/RNA Molecule: Synthetic oligonucleotide
cttguccagctttatuggga

SEQ ID NO: 2230 - DNA, 20 bp, Artificial Sequence
  Description of Artificial Sequence: Synthetic oligonucleotide
  Description of Combined DNA/RNA Molecule: Synthetic oligonucleotide
cttguccagctttatuggga

SEQ ID NO: 2231 - DNA, 20 bp, Artificial Sequence
  Description of Artificial Sequence: Synthetic oligonucleotide
atagcagcttcttgtccagc

SEQ ID NO: 2232 - DNA, 20 bp, Artificial Sequence
  Description of Artificial Sequence: Synthetic oligonucleotide
atagcagcttcttgtccagc

SEQ ID NO: 2233 - DNA, 20 bp, Artificial Sequence
  Description of Artificial Sequence: Synthetic oligonucleotide
atagcagcttcttgtccagc

SEQ ID NO: 2234 - DNA, 20 bp, Artificial Sequence
  Description of Artificial Sequence: Synthetic oligonucleotide
atagcagcttcttgtccagc

SEQ ID NO: 2235 - DNA, 20 bp, Artificial Sequence
  Description of Artificial Sequence: Synthetic oligonucleotide
  Description of Combined DNA/RNA Molecule: Synthetic oligonucleotide
cttguccagctttatuggga

SEQ ID NO: 2236 - DNA, 20 bp, Artificial Sequence
  Description of Artificial Sequence: Synthetic oligonucleotide
  Description of Combined DNA/RNA Molecule: Synthetic oligonucleotide
cttguccagctttatuggga

SEQ ID NO: 2237 - DNA, 20 bp, Artificial Sequence
  Description of Artificial Sequence: Synthetic oligonucleotide
  Description of Combined DNA/RNA Molecule: Synthetic oligonucleotide
cttguccagctttatuggga

SEQ ID NO: 2238 - DNA, 20 bp, Artificial Sequence
  Description of Artificial Sequence: Synthetic oligonucleotide
  Description of Combined DNA/RNA Molecule: Synthetic oligonucleotide
cttguccagctttatuggga

SEQ ID NO: 2239 - DNA, 20 bp, Artificial Sequence
  Description of Artificial Sequence: Synthetic oligonucleotide
atagcagcttcttgtccagc

SEQ ID NO: 2240 - DNA, 20 bp, Artificial Sequence
  Description of Artificial Sequence: Synthetic oligonucleotide
atagcagcttcttgtccagc

SEQ ID NO: 2241 - DNA, 20 bp, Artificial Sequence
  Description of Artificial Sequence: Synthetic oligonucleotide
atagcagcttcttgtccagc

SEQ ID NO: 2242 - DNA, 20 bp, Artificial Sequence
  Description of Artificial Sequence: Synthetic oligonucleotide
atagcagcttcttgtccagc

SEQ ID NO: 2243 - DNA, 20 bp, Artificial Sequence
  Description of Artificial Sequence: Synthetic oligonucleotide
cttgtccagctttattggga

SEQ ID NO: 2244 - DNA, 20 bp, Artificial Sequence
  Description of Artificial Sequence: Synthetic oligonucleotide
cttgtccagctttattggga

SEQ ID NO: 2245 - DNA, 20 bp, Artificial Sequence
  Description of Artificial Sequence: Synthetic oligonucleotide
cttgtccagctttattggga

SEQ ID NO: 2246 - DNA, 20 bp, Artificial Sequence
  Description of Artificial Sequence: Synthetic oligonucleotide
cttgtccagctttattggga

SEQ ID NO: 2247 - DNA, 20 bp, Artificial Sequence
  Description of Artificial Sequence: Synthetic oligonucleotide
  Description of Combined DNA/RNA Molecule: Synthetic oligonucleotide
cttguccagctttatuggga

SEQ ID NO: 2248 - DNA, 20 bp, Artificial Sequence
  Description of Artificial Sequence: Synthetic oligonucleotide
  Description of Combined DNA/RNA Molecule: Synthetic oligonucleotide
cttguccagctttatuggga

SEQ ID NO: 2249 - DNA, 20 bp, Artificial Sequence
  Description of Artificial Sequence: Synthetic oligonucleotide
  Description of Combined DNA/RNA Molecule: Synthetic oligonucleotide
cttguccagctttatuggga

SEQ ID NO: 2250 - DNA, 20 bp, Artificial Sequence
  Description of Artificial Sequence: Synthetic oligonucleotide
  Description of Combined DNA/RNA Molecule: Synthetic oligonucleotide
cttguccagctttatuggga

SEQ ID NO: 2251 - DNA, 20 bp, Artificial Sequence
  Description of Artificial Sequence: Synthetic oligonucleotide
atagcagcttcttgtccagc

SEQ ID NO: 2252 - DNA, 20 bp, Artificial Sequence
  Description of Artificial Sequence: Synthetic oligonucleotide
atagcagcttcttgtccagc

SEQ ID NO: 2253 - DNA, 20 bp, Artificial Sequence
  Description of Artificial Sequence: Synthetic oligonucleotide
atagcagcttcttgtccagc

SEQ ID NO: 2254 - DNA, 20 bp, Artificial Sequence
  Description of Artificial Sequence: Synthetic oligonucleotide
atagcagcttcttgtccagc

SEQ ID NO: 2255 - DNA, 20 bp, Artificial Sequence
  Description of Artificial Sequence: Synthetic oligonucleotide
atagcagcttcttgtccagc

SEQ ID NO: 2256 - DNA, 20 bp, Artificial Sequence
  Description of Artificial Sequence: Synthetic oligonucleotide
atagcagcttcttgtccagc

SEQ ID NO: 2257 - DNA, 20 bp, Artificial Sequence
  Description of Artificial Sequence: Synthetic oligonucleotide
atagcagcttcttgtccagc

SEQ ID NO: 2258 - DNA, 20 bp, Artificial Sequence
  Description of Artificial Sequence: Synthetic oligonucleotide
atagcagcttcttgtccagc

SEQ ID NO: 2259 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2260 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2261 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2262 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2263 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2264 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2265 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2266 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggutu

SEQ ID NO: 2267 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2268 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2269 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2270 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2271 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2272 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2273 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2274 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2275 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2276 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2277 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2278 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2279 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2280 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2281 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2282 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2283 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2284 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2285 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2286 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2287 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2288 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2289 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2290 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2291 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2292 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2293 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2294 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2295 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2296 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2297 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2298 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2299 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2300 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2301 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2302 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2303 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2304 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2305 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2306 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2307 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2308 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2309 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2310 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2311 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2312 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2313 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2314 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2315 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2316 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2317 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2318 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2319 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2320 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2321 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2322 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2323 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2324 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2325 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2326 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2327 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2328 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2329 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2330 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2331 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2332 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2333 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2334 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2335 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2336 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2337 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2338 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2339 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2340 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2341 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2342 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2343 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2344 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2345 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2346 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2347 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2348 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2349 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2350 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2351 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2352 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2353 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2354 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2355 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2356 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2357 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2358 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2359 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2360 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2361 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2362 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2363 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2364 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2365 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2366 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2367 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2368 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2369 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2370 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2371 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2372 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2373 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2374 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2375 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2376 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2377 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2378 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2379 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2380 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2381 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2382 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2383 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2384 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2385 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2386 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2387 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2388 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2389 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2390 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2391 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2392 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2393 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2394 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2395 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2396 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2397 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2398 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2399 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2400 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2401 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2402 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2403 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2404 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2405 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2406 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2407 - DNA, 22 bp, Artificial Sequence
  Description of Artificial Sequence: Synthetic oligonucleotide
  Description of Combined DNA/RNA Molecule: Synthetic oligonucleotide
guccagcuuuauugggaggctu

SEQ ID NO: 2408 - DNA, 22 bp, Artificial Sequence
  Description of Artificial Sequence: Synthetic oligonucleotide
  Description of Combined DNA/RNA Molecule: Synthetic oligonucleotide
tuccagcuuuauugggaggctu

SEQ ID NO: 2409 - DNA, 22 bp, Artificial Sequence
  Description of Artificial Sequence: Synthetic oligonucleotide
  Description of Combined DNA/RNA Molecule: Synthetic oligonucleotide
tgccagcuuuauugggaggctu

SEQ ID NO: 2410 - DNA, 22 bp, Artificial Sequence
  Description of Artificial Sequence: Synthetic oligonucleotide
  Description of Combined DNA/RNA Molecule: Synthetic oligonucleotide
tgucagcuuuauugggaggctu

SEQ ID NO: 2411 - DNA, 22 bp, Artificial Sequence
  Description of Artificial Sequence: Synthetic oligonucleotide
  Description of Combined DNA/RNA Molecule: Synthetic oligonucleotide
tgucagcuuuauugggaggctu

SEQ ID NO: 2412 - DNA, 22 bp, Artificial Sequence
  Description of Artificial Sequence: Synthetic oligonucleotide
  Description of Combined DNA/RNA Molecule: Synthetic oligonucleotide
tguccgcuuuauugggaggctu

SEQ ID NO: 2413 - DNA, 22 bp, Artificial Sequence
  Description of Artificial Sequence: Synthetic oligonucleotide
  Description of Combined DNA/RNA Molecule: Synthetic oligonucleotide
tguccacuuuauugggaggctu

SEQ ID NO: 2414 - DNA, 22 bp, Artificial Sequence
  Description of Artificial Sequence: Synthetic oligonucleotide
  Description of Combined DNA/RNA Molecule: Synthetic oligonucleotide
tguccaguuuauugggaggctu

SEQ ID NO: 2415 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 2416 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 2417 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 2418 - DNA, 22 bp, Artificial Sequence
  Description of Artificial Sequence: Synthetic oligonucleotide
  Description of Combined DNA/RNA Molecule: Synthetic oligonucleotide
guccagcuuuauugggaggctu

SEQ ID NO: 2419 - DNA, 22 bp, Artificial Sequence
  Description of Artificial Sequence: Synthetic oligonucleotide
  Description of Combined DNA/RNA Molecule: Synthetic oligonucleotide
tuccagcuuuauugggaggctu

SEQ ID NO: 2420 - DNA, 22 bp, Artificial Sequence
  Description of Artificial Sequence: Synthetic oligonucleotide
  Description of Combined DNA/RNA Molecule: Synthetic oligonucleotide
tgccagcuuuauugggaggctu

SEQ ID NO: 2421 - DNA, 22 bp, Artificial Sequence
  Description of Artificial Sequence: Synthetic oligonucleotide
  Description of Combined DNA/RNA Molecule: Synthetic oligonucleotide
tgucagcuuuauugggaggctu

SEQ ID NO: 2422 - DNA, 22 bp, Artificial Sequence
  Description of Artificial Sequence: Synthetic oligonucleotide
  Description of Combined DNA/RNA Molecule: Synthetic oligonucleotide
tgucagcuuuauugggaggctu

SEQ ID NO: 2423 - DNA, 22 bp, Artificial Sequence
  Description of Artificial Sequence: Synthetic oligonucleotide
  Description of Combined DNA/RNA Molecule: Synthetic oligonucleotide
tguccgcuuuauugggaggctu

SEQ ID NO: 2424 - DNA, 22 bp, Artificial Sequence
  Description of Artificial Sequence: Synthetic oligonucleotide
  Description of Combined DNA/RNA Molecule: Synthetic oligonucleotide
tguccacuuuauugggaggctu

SEQ ID NO: 2425 - DNA, 22 bp, Artificial Sequence
  Description of Artificial Sequence: Synthetic oligonucleotide
  Description of Combined DNA/RNA Molecule: Synthetic oligonucleotide
tguccaguuuauugggaggctu

SEQ ID NO: 2426 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 2427 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 2428 - DNA, 22 bp, Artificial Sequence
  Description of Artificial Sequence: Synthetic oligonucleotide
  Description of Combined DNA/RNA Molecule: Synthetic oligonucleotide
tguccagcuuauugggaggctu

SEQ ID NO: 2429 - DNA, 22 bp, Artificial Sequence
  Description of Artificial Sequence: Synthetic oligonucleotide
  Description of Combined DNA/RNA Molecule: Synthetic oligonucleotide
gccacuguagaaaggcaugatu

SEQ ID NO: 2430 - DNA, 22 bp, Artificial Sequence
  Description of Artificial Sequence: Synthetic oligonucleotide
  Description of Combined DNA/RNA Molecule: Synthetic oligonucleotide
tccacuguagaaaggcaugatu

SEQ ID NO: 2431 - DNA, 22 bp, Artificial Sequence
  Description of Artificial Sequence: Synthetic oligonucleotide
  Description of Combined DNA/RNA Molecule: Synthetic oligonucleotide
tgcacuguagaaaggcaugatu

SEQ ID NO: 2432 - DNA, 22 bp, Artificial Sequence
  Description of Artificial Sequence: Synthetic oligonucleotide
  Description of Combined DNA/RNA Molecule: Synthetic oligonucleotide
tgcacuguagaaaggcaugatu

SEQ ID NO: 2433 - DNA, 22 bp, Artificial Sequence
  Description of Artificial Sequence: Synthetic oligonucleotide
  Description of Combined DNA/RNA Molecule: Synthetic oligonucleotide
tgcccuguagaaaggcaugatu

SEQ ID NO: 2434 - DNA, 22 bp, Artificial Sequence
  Description of Artificial Sequence: Synthetic oligonucleotide
  Description of Combined DNA/RNA Molecule: Synthetic oligonucleotide
tgccauguagaaaggcaugatu

SEQ ID NO: 2435 - DNA, 22 bp, Artificial Sequence
  Description of Artificial Sequence: Synthetic oligonucleotide
  Description of Combined DNA/RNA Molecule: Synthetic oligonucleotide
tgccacguagaaaggcaugatu

SEQ ID NO: 2436 - DNA, 22 bp, Artificial Sequence
  Description of Artificial Sequence: Synthetic oligonucleotide
  Description of Combined DNA/RNA Molecule: Synthetic oligonucleotide
tgccacuuagaaaggcaugatu

SEQ ID NO: 2437 - DNA, 22 bp, Artificial Sequence
  Description of Artificial Sequence: Synthetic oligonucleotide
  Description of Combined DNA/RNA Molecule: Synthetic oligonucleotide
tgccacugagaaaggcaugatu

SEQ ID NO: 2438 - DNA, 22 bp, Artificial Sequence
  Description of Artificial Sequence: Synthetic oligonucleotide
  Description of Combined DNA/RNA Molecule: Synthetic oligonucleotide
tgccacugugaaaggcaugatu

SEQ ID NO: 2439 - DNA, 22 bp, Artificial Sequence
  Description of Artificial Sequence: Synthetic oligonucleotide
  Description of Combined DNA/RNA Molecule: Synthetic oligonucleotide
tgccacuguaaaaggcaugatu

SEQ ID NO: 2440 - DNA, 22 bp, Artificial Sequence
  Description of Artificial Sequence: Synthetic oligonucleotide
  Description of Combined DNA/RNA Molecule: Synthetic oligonucleotide
tgccacuguagaaggcaugatu

SEQ ID NO: 2441 - DNA, 22 bp, Artificial Sequence
  Description of Artificial Sequence: Synthetic oligonucleotide
  Description of Combined DNA/RNA Molecule: Synthetic oligonucleotide
gccacuguagaaaggcaugatu

SEQ ID NO: 2442 - DNA, 22 bp, Artificial Sequence
  Description of Artificial Sequence: Synthetic oligonucleotide
  Description of Combined DNA/RNA Molecule: Synthetic oligonucleotide
tccacuguagaaaggcaugatu

SEQ ID NO: 2443 - DNA, 22 bp, Artificial Sequence
  Description of Artificial Sequence: Synthetic oligonucleotide
  Description of Combined DNA/RNA Molecule: Synthetic oligonucleotide
tgcacuguagaaaggcaugatu

SEQ ID NO: 2444 - DNA, 22 bp, Artificial Sequence
  Description of Artificial Sequence: Synthetic oligonucleotide
  Description of Combined DNA/RNA Molecule: Synthetic oligonucleotide
tgcacuguagaaaggcaugatu

SEQ ID NO: 2445 - DNA, 22 bp, Artificial Sequence
  Description of Artificial Sequence: Synthetic oligonucleotide
  Description of Combined DNA/RNA Molecule: Synthetic oligonucleotide
tgcccuguagaaaggcaugatu

SEQ ID NO: 2446 - DNA, 22 bp, Artificial Sequence
  Description of Artificial Sequence: Synthetic oligonucleotide
  Description of Combined DNA/RNA Molecule: Synthetic oligonucleotide
tgccauguagaaaggcaugatu

SEQ ID NO: 2447 - DNA, 22 bp, Artificial Sequence
  Description of Artificial Sequence: Synthetic oligonucleotide
  Description of Combined DNA/RNA Molecule: Synthetic oligonucleotide
tgccacguagaaaggcaugatu

SEQ ID NO: 2448 - DNA, 22 bp, Artificial Sequence
  Description of Artificial Sequence: Synthetic oligonucleotide
  Description of Combined DNA/RNA Molecule: Synthetic oligonucleotide
tgccacuuagaaaggcaugatu

SEQ ID NO: 2449 - DNA, 22 bp, Artificial Sequence
  Description of Artificial Sequence: Synthetic oligonucleotide
  Description of Combined DNA/RNA Molecule: Synthetic oligonucleotide
tgccacugagaaaggcaugatu

SEQ ID NO: 2450 - DNA, 22 bp, Artificial Sequence
  Description of Artificial Sequence: Synthetic oligonucleotide
  Description of Combined DNA/RNA Molecule: Synthetic oligonucleotide
tgccacugugaaaggcaugatu

SEQ ID NO: 2451 - DNA, 22 bp, Artificial Sequence
  Description of Artificial Sequence: Synthetic oligonucleotide
  Description of Combined DNA/RNA Molecule: Synthetic oligonucleotide
tgccacuguaaaaggcaugatu

SEQ ID NO: 2452 - DNA, 22 bp, Artificial Sequence
  Description of Artificial Sequence: Synthetic oligonucleotide
  Description of Combined DNA/RNA Molecule: Synthetic oligonucleotide
tgccacuguagaaggcaugatu

SEQ ID NO: 2453 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2454 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2455 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2456 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2457 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2458 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2459 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2460 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2461 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2462 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2463 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2464 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2465 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2466 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2467 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2468 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2469 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2470 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2471 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2472 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2473 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2474 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2475 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2476 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2477 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2478 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2479 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2480 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2481 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2482 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2483 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2484 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2485 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2486 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2487 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2488 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2489 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2490 - DNA, 20 bp, Artificial Sequence
  Description of Artificial Sequence: Synthetic oligonucleotide
agcttcttgtccagctttat

SEQ ID NO: 2491 - DNA, 20 bp, Artificial Sequence
  Description of Artificial Sequence: Synthetic oligonucleotide
agcttcttgtccagctttat

SEQ ID NO: 2492 - DNA, 20 bp, Artificial Sequence
  Description of Artificial Sequence: Synthetic oligonucleotide
agcttcttgtccagctttat

SEQ ID NO: 2493 - DNA, 20 bp, Artificial Sequence
  Description of Artificial Sequence: Synthetic oligonucleotide
agcttcttgtccagctttat

SEQ ID NO: 2494 - DNA, 20 bp, Artificial Sequence
  Description of Artificial Sequence: Synthetic oligonucleotide
agcttcttgtccagctttat

SEQ ID NO: 2495 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2496 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2497 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2498 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2499 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2500 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2501 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2502 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2503 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2504 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2505 - DNA, 23 bp, Artificial Sequence
  Description of Artificial Sequence: Synthetic oligonucleotide
  Description of Combined DNA/RNA Molecule: Synthetic oligonucleotide
tgccacuguagaaaggcaugatu

SEQ ID NO: 2506 - DNA, 23 bp, Artificial Sequence
  Description of Artificial Sequence: Synthetic oligonucleotide
  Description of Combined DNA/RNA Molecule: Synthetic oligonucleotide
tgccacuguagaaaggcaugatu

SEQ ID NO: 2507 - DNA, 23 bp, Artificial Sequence
  Description of Artificial Sequence: Synthetic oligonucleotide
  Description of Combined DNA/RNA Molecule: Synthetic oligonucleotide
tgccacuguagaaaggcaugatu

SEQ ID NO: 2508 - DNA, 23 bp, Artificial Sequence
  Description of Artificial Sequence: Synthetic oligonucleotide
  Description of Combined DNA/RNA Molecule: Synthetic oligonucleotide
tgccacuguagaaaggcaugatu

SEQ ID NO: 2509 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2510 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2511 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2512 - DNA, 20 bp, Artificial Sequence
  Description of Artificial Sequence: Synthetic oligonucleotide
  Description of Combined DNA/RNA Molecule: Synthetic oligonucleotide
agctucttgtccagcuuuau

SEQ ID NO: 2513 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2514 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2515 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2516 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2517 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2518 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2519 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2520 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2521 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2522 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2523 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2524 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2525 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2526 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2527 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2528 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2529 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2530 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2531 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2532 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2533 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2534 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2535 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2536 - DNA, 20 bp, Artificial Sequence
  Description of Artificial Sequence: Synthetic oligonucleotide
  Description of Combined DNA/RNA Molecule: Synthetic oligonucleotide
agcttcttgtccagcuuuau

SEQ ID NO: 2537 - DNA, 20 bp, Artificial Sequence
  Description of Artificial Sequence: Synthetic oligonucleotide
  Description of Combined DNA/RNA Molecule: Synthetic oligonucleotide
agcttcttgtccagcuuuau

SEQ ID NO: 2538 - DNA, 20 bp, Artificial Sequence
  Description of Artificial Sequence: Synthetic oligonucleotide
  Description of Combined DNA/RNA Molecule: Synthetic oligonucleotide
agcttcttgtccagctuuau

SEQ ID NO: 2539 - DNA, 20 bp, Artificial Sequence
  Description of Artificial Sequence: Synthetic oligonucleotide
  Description of Combined DNA/RNA Molecule: Synthetic oligonucleotide
agcttcttgtccagctuuau

SEQ ID NO: 2540 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2541 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2542 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2543 - DNA, 20 bp, Artificial Sequence
  Description of Artificial Sequence: Synthetic oligonucleotide
  Description of Combined DNA/RNA Molecule: Synthetic oligonucleotide
agcttcttgtccagcuuuau

SEQ ID NO: 2544 - DNA, 20 bp, Artificial Sequence
  Description of Artificial Sequence: Synthetic oligonucleotide
  Description of Combined DNA/RNA Molecule: Synthetic oligonucleotide
agcttcttgtccagcuuuau

SEQ ID NO: 2545 - DNA, 20 bp, Artificial Sequence
  Description of Artificial Sequence: Synthetic oligonucleotide
  Description of Combined DNA/RNA Molecule: Synthetic oligonucleotide
agcttcttgtccagctuuau

SEQ ID NO: 2546 - DNA, 20 bp, Artificial Sequence
  Description of Artificial Sequence: Synthetic oligonucleotide
  Description of Combined DNA/RNA Molecule: Synthetic oligonucleotide
agcttcttgtccagctuuau

SEQ ID NO: 2547 - DNA, 20 bp, Artificial Sequence
  Description of Artificial Sequence: Synthetic oligonucleotide
  Description of Combined DNA/RNA Molecule: Synthetic oligonucleotide
agcttcttgtccagcuuuau

SEQ ID NO: 2548 - DNA, 20 bp, Artificial Sequence
  Description of Artificial Sequence: Synthetic oligonucleotide
  Description of Combined DNA/RNA Molecule: Synthetic oligonucleotide
agcttcttgtccagcuuuau

SEQ ID NO: 2549 - DNA, 20 bp, Artificial Sequence
  Description of Artificial Sequence: Synthetic oligonucleotide
  Description of Combined DNA/RNA Molecule: Synthetic oligonucleotide
agcttcttgtccagctuuau

SEQ ID NO: 2550 - DNA, 20 bp, Artificial Sequence
  Description of Artificial Sequence: Synthetic oligonucleotide
  Description of Combined DNA/RNA Molecule: Synthetic oligonucleotide
agcttcttgtccagctuuau

SEQ ID NO: 2551 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2552 - DNA, 23 bp, Artificial Sequence
  Description of Artificial Sequence: Synthetic oligonucleotide
  Description of Combined DNA/RNA Molecule: Synthetic oligonucleotide
tguccagcuuuauugggaggctu

SEQ ID NO: 2553 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2554 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2555 - DNA, 23 bp, Artificial Sequence
  Description of Artificial Sequence: Synthetic oligonucleotide
  Description of Combined DNA/RNA Molecule: Synthetic oligonucleotide
tccuucccugaagguuccucctu

SEQ ID NO: 2556 - DNA, 23 bp, Artificial Sequence
  Description of Artificial Sequence: Synthetic oligonucleotide
  Description of Combined DNA/RNA Molecule: Synthetic oligonucleotide
tccuucccugaagguuccucctu

SEQ ID NO: 2557 - DNA, 23 bp, Artificial Sequence
  Description of Artificial Sequence: Synthetic oligonucleotide
  Description of Combined DNA/RNA Molecule: Synthetic oligonucleotide
tccuucccugaagguuccucctu

SEQ ID NO: 2558 - DNA, 23 bp, Artificial Sequence
  Description of Artificial Sequence: Synthetic oligonucleotide
  Description of Combined DNA/RNA Molecule: Synthetic oligonucleotide
tccuucccugaagguuccucctu

SEQ ID NO: 2559 - DNA, 23 bp, Artificial Sequence
  Description of Artificial Sequence: Synthetic oligonucleotide
  Description of Combined DNA/RNA Molecule: Synthetic oligonucleotide
tccuucccugaagguuccucctu

SEQ ID NO: 2560 - DNA, 23 bp, Artificial Sequence
  Description of Artificial Sequence: Synthetic oligonucleotide
  Description of Combined DNA/RNA Molecule: Synthetic oligonucleotide
tccuucccugaagguuccucctu

SEQ ID NO: 2561 - DNA, 23 bp, Artificial Sequence
  Description of Artificial Sequence: Synthetic oligonucleotide
  Description of Combined DNA/RNA Molecule: Synthetic oligonucleotide
tccuucccugaagguuccucctu

SEQ ID NO: 2562 - DNA, 23 bp, Artificial Sequence
  Description of Artificial Sequence: Synthetic oligonucleotide
  Description of Combined DNA/RNA Molecule: Synthetic oligonucleotide
tccuucccugaagguuccucctu

SEQ ID NO: 2563 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2564 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2565 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2566 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2567 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2568 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2569 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2570 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2571 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2572 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2573 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2574 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2575 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2576 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2577 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2578 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2579 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2580 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2581 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2582 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2583 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2584 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2585 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2586 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2587 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2588 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2589 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2590 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2591 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2592 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2593 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2594 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2595 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2596 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2597 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2598 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2599 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2600 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2601 - DNA, 23 bp, Artificial Sequence
  Description of Artificial Sequence: Synthetic oligonucleotide
  Description of Combined DNA/RNA Molecule: Synthetic oligonucleotide
tagcuucuuguccagcuuuautu

SEQ ID NO: 2602 - DNA, 23 bp, Artificial Sequence
  Description of Artificial Sequence: Synthetic oligonucleotide
  Description of Combined DNA/RNA Molecule: Synthetic oligonucleotide
tuuuaagcaaccuacaggggctu

SEQ ID NO: 2603 - DNA, 23 bp, Artificial Sequence
  Description of Artificial Sequence: Synthetic oligonucleotide
  Description of Combined DNA/RNA Molecule: Synthetic oligonucleotide
tuuuuaagcaaccuacaggggtu

SEQ ID NO: 2604 - DNA, 23 bp, Artificial Sequence
  Description of Artificial Sequence: Synthetic oligonucleotide
  Description of Combined DNA/RNA Molecule: Synthetic oligonucleotide
tcuuuuaagcaaccuacagggtu

SEQ ID NO: 2605 - DNA, 23 bp, Artificial Sequence
  Description of Artificial Sequence: Synthetic oligonucleotide
  Description of Combined DNA/RNA Molecule: Synthetic oligonucleotide
tccuuuuaagcaaccuacaggtu

SEQ ID NO: 2606 - DNA, 23 bp, Artificial Sequence
  Description of Artificial Sequence: Synthetic oligonucleotide
  Description of Combined DNA/RNA Molecule: Synthetic oligonucleotide
tcccuuuuaagcaaccuacagtu

SEQ ID NO: 2607 - DNA, 23 bp, Artificial Sequence
  Description of Artificial Sequence: Synthetic oligonucleotide
  Description of Combined DNA/RNA Molecule: Synthetic oligonucleotide
tucccuuuuaagcaaccuacatu

SEQ ID NO: 2608 - DNA, 23 bp, Artificial Sequence
  Description of Artificial Sequence: Synthetic oligonucleotide
  Description of Combined DNA/RNA Molecule: Synthetic oligonucleotide
tgucccuuuuaagcaaccuactu

SEQ ID NO: 2609 - DNA, 23 bp, Artificial Sequence
  Description of Artificial Sequence: Synthetic oligonucleotide
  Description of Combined DNA/RNA Molecule: Synthetic oligonucleotide
tugucccuuuuaagcaaccuatu

SEQ ID NO: 2610 - DNA, 23 bp, Artificial Sequence
  Description of Artificial Sequence: Synthetic oligonucleotide
  Description of Combined DNA/RNA Molecule: Synthetic oligonucleotide
tcugucccuuuuaagcaaccutu

SEQ ID NO: 2611 - DNA, 23 bp, Artificial Sequence
  Description of Artificial Sequence: Synthetic oligonucleotide
  Description of Combined DNA/RNA Molecule: Synthetic oligonucleotide
tacugucccuuuuaagcaacctu

SEQ ID NO: 2612 - DNA, 23 bp, Artificial Sequence
  Description of Artificial Sequence: Synthetic oligonucleotide
  Description of Combined DNA/RNA Molecule: Synthetic oligonucleotide
tuacugucccuuuuaagcaactu

SEQ ID NO: 2613 - DNA, 23 bp, Artificial Sequence
  Description of Artificial Sequence: Synthetic oligonucleotide
  Description of Combined DNA/RNA Molecule: Synthetic oligonucleotide
tauacugucccuuuuaagcaatu

SEQ ID NO: 2614 - DNA, 23 bp, Artificial Sequence
  Description of Artificial Sequence: Synthetic oligonucleotide
  Description of Combined DNA/RNA Molecule: Synthetic oligonucleotide
taauacugucccuuuuaagcatu

SEQ ID NO: 2615 - DNA, 23 bp, Artificial Sequence
  Description of Artificial Sequence: Synthetic oligonucleotide
  Description of Combined DNA/RNA Molecule: Synthetic oligonucleotide
tgaauacugucccuuuuaagctu

SEQ ID NO: 2616 - DNA, 23 bp, Artificial Sequence
  Description of Artificial Sequence: Synthetic oligonucleotide
  Description of Combined DNA/RNA Molecule: Synthetic oligonucleotide
tagaauacugucccuuuuaagtu

SEQ ID NO: 2617 - DNA, 23 bp, Artificial Sequence
  Description of Artificial Sequence: Synthetic oligonucleotide
  Description of Combined DNA/RNA Molecule: Synthetic oligonucleotide
tgagaauacugucccuuuuaatu

SEQ ID NO: 2618 - DNA, 23 bp, Artificial Sequence
  Description of Artificial Sequence: Synthetic oligonucleotide
  Description of Combined DNA/RNA Molecule: Synthetic oligonucleotide
tugagaauacugucccuuuuatu

SEQ ID NO: 2619 - DNA, 23 bp, Artificial Sequence
  Description of Artificial Sequence: Synthetic oligonucleotide
  Description of Combined DNA/RNA Molecule: Synthetic oligonucleotide
tcugagaauacugucccuuuutu

SEQ ID NO: 2620 - DNA, 23 bp, Artificial Sequence
  Description of Artificial Sequence: Synthetic oligonucleotide
  Description of Combined DNA/RNA Molecule: Synthetic oligonucleotide
tacugagaauacugucccuuutu

SEQ ID NO: 2621 - DNA, 23 bp, Artificial Sequence
  Description of Artificial Sequence: Synthetic oligonucleotide
  Description of Combined DNA/RNA Molecule: Synthetic oligonucleotide
tgcacugagaauacugucccutu

SEQ ID NO: 2622 - DNA, 23 bp, Artificial Sequence
  Description of Artificial Sequence: Synthetic oligonucleotide
  Description of Combined DNA/RNA Molecule: Synthetic oligonucleotide
tagcacugagaauacuguccctu

SEQ ID NO: 2623 - DNA, 23 bp, Artificial Sequence
  Description of Artificial Sequence: Synthetic oligonucleotide
  Description of Combined DNA/RNA Molecule: Synthetic oligonucleotide
tgagcacugagaauacugucctu

SEQ ID NO: 2624 - DNA, 23 bp, Artificial Sequence
  Description of Artificial Sequence: Synthetic oligonucleotide
  Description of Combined DNA/RNA Molecule: Synthetic oligonucleotide
tagagcacugagaauacuguctu

SEQ ID NO: 2625 - DNA, 23 bp, Artificial Sequence
  Description of Artificial Sequence: Synthetic oligonucleotide
  Description of Combined DNA/RNA Molecule: Synthetic oligonucleotide
tgagagcacugagaauacugutu

SEQ ID NO: 2626 - DNA, 23 bp, Artificial Sequence
  Description of Artificial Sequence: Synthetic oligonucleotide
  Description of Combined DNA/RNA Molecule: Synthetic oligonucleotide
tggagagcacugagaauacugtu

SEQ ID NO: 2627 - DNA, 23 bp, Artificial Sequence
  Description of Artificial Sequence: Synthetic oligonucleotide
  Description of Combined DNA/RNA Molecule: Synthetic oligonucleotide
taggagagcacugagaauacutu

SEQ ID NO: 2628 - DNA, 23 bp, Artificial Sequence
  Description of Artificial Sequence: Synthetic oligonucleotide
  Description of Combined DNA/RNA Molecule: Synthetic oligonucleotide
tuaggagagcacugagaauactu

SEQ ID NO: 2629 - DNA, 23 bp, Artificial Sequence
  Description of Artificial Sequence: Synthetic oligonucleotide
  Description of Combined DNA/RNA Molecule: Synthetic oligonucleotide
tguaggagagcacugagaauatu

SEQ ID NO: 2630 - DNA, 23 bp, Artificial Sequence
  Description of Artificial Sequence: Synthetic oligonucleotide
  Description of Combined DNA/RNA Molecule: Synthetic oligonucleotide
tgguaggagagcacugagaautu

SEQ ID NO: 2631 - DNA, 23 bp, Artificial Sequence
  Description of Artificial Sequence: Synthetic oligonucleotide
  Description of Combined DNA/RNA Molecule: Synthetic oligonucleotide
tggguaggagagcacugagaatu

SEQ ID NO: 2632 - DNA, 23 bp, Artificial Sequence
  Description of Artificial Sequence: Synthetic oligonucleotide
  Description of Combined DNA/RNA Molecule: Synthetic oligonucleotide
tgggguaggagagcacugagatu

SEQ ID NO: 2633 - DNA, 23 bp, Artificial Sequence
  Description of Artificial Sequence: Synthetic oligonucleotide
  Description of Combined DNA/RNA Molecule: Synthetic oligonucleotide
tugggguaggagagcacugagtu

SEQ ID NO: 2634 - DNA, 23 bp, Artificial Sequence
  Description of Artificial Sequence: Synthetic oligonucleotide
  Description of Combined DNA/RNA Molecule: Synthetic oligonucleotide
tgugggguaggagagcacugatu

SEQ ID NO: 2635 - DNA, 23 bp, Artificial Sequence
  Description of Artificial Sequence: Synthetic oligonucleotide
  Description of Combined DNA/RNA Molecule: Synthetic oligonucleotide
tggugggguaggagagcacugtu

SEQ ID NO: 2636 - DNA, 23 bp, Artificial Sequence
  Description of Artificial Sequence: Synthetic oligonucleotide
  Description of Combined DNA/RNA Molecule: Synthetic oligonucleotide
taggugggguaggagagcacutu

SEQ ID NO: 2637 - DNA, 23 bp, Artificial Sequence
  Description of Artificial Sequence: Synthetic oligonucleotide
  Description of Combined DNA/RNA Molecule: Synthetic oligonucleotide
tgaggugggguaggagagcactu

SEQ ID NO: 2638 - DNA, 23 bp, Artificial Sequence
  Description of Artificial Sequence: Synthetic oligonucleotide
  Description of Combined DNA/RNA Molecule: Synthetic oligonucleotide
tugaggugggguaggagagcatu

SEQ ID NO: 2639 - DNA, 23 bp, Artificial Sequence
  Description of Artificial Sequence: Synthetic oligonucleotide
  Description of Combined DNA/RNA Molecule: Synthetic oligonucleotide
taugaggugggguaggagagctu

SEQ ID NO: 2640 - DNA, 23 bp, Artificial Sequence
  Description of Artificial Sequence: Synthetic oligonucleotide
  Description of Combined DNA/RNA Molecule: Synthetic oligonucleotide
tcaugaggugggguaggagagtu

SEQ ID NO: 2641 - DNA, 23 bp, Artificial Sequence
  Description of Artificial Sequence: Synthetic oligonucleotide
  Description of Combined DNA/RNA Molecule: Synthetic oligonucleotide
tgcaugaggugggguaggagatu

SEQ ID NO: 2642 - DNA, 23 bp, Artificial Sequence
  Description of Artificial Sequence: Synthetic oligonucleotide
  Description of Combined DNA/RNA Molecule: Synthetic oligonucleotide
tuuaagcaaccuacaggggcatu

SEQ ID NO: 2643 - DNA, 23 bp, Artificial Sequence
  Description of Artificial Sequence: Synthetic oligonucleotide
  Description of Combined DNA/RNA Molecule: Synthetic oligonucleotide
tuuuaagcaaccuacaggggctu

SEQ ID NO: 2644 - DNA, 23 bp, Artificial Sequence
  Description of Artificial Sequence: Synthetic oligonucleotide
  Description of Combined DNA/RNA Molecule: Synthetic oligonucleotide
tuuuuaagcaaccuacaggggtu

SEQ ID NO: 2645 - DNA, 23 bp, Artificial Sequence
  Description of Artificial Sequence: Synthetic oligonucleotide
  Description of Combined DNA/RNA Molecule: Synthetic oligonucleotide
tcuuuuaagcaaccuacagggtu

SEQ ID NO: 2646 - DNA, 23 bp, Artificial Sequence
  Description of Artificial Sequence: Synthetic oligonucleotide
  Description of Combined DNA/RNA Molecule: Synthetic oligonucleotide
tccuuuuaagcaaccuacaggtu

SEQ ID NO: 2647 - DNA, 23 bp, Artificial Sequence
  Description of Artificial Sequence: Synthetic oligonucleotide
  Description of Combined DNA/RNA Molecule: Synthetic oligonucleotide
tcccuuuuaagcaaccuacagtu

SEQ ID NO: 2648 - DNA, 23 bp, Artificial Sequence
  Description of Artificial Sequence: Synthetic oligonucleotide
  Description of Combined DNA/RNA Molecule: Synthetic oligonucleotide
tucccuuuuaagcaaccuacatu

SEQ ID NO: 2649 - DNA, 23 bp, Artificial Sequence
  Description of Artificial Sequence: Synthetic oligonucleotide
  Description of Combined DNA/RNA Molecule: Synthetic oligonucleotide
tgucccuuuuaagcaaccuactu

SEQ ID NO: 2650 - DNA, 23 bp, Artificial Sequence
  Description of Artificial Sequence: Synthetic oligonucleotide
  Description of Combined DNA/RNA Molecule: Synthetic oligonucleotide
tugucccuuuuaagcaaccuatu

SEQ ID NO: 2651 - DNA, 23 bp, Artificial Sequence
  Description of Artificial Sequence: Synthetic oligonucleotide
  Description of Combined DNA/RNA Molecule: Synthetic oligonucleotide
tcugucccuuuuaagcaaccutu

SEQ ID NO: 2652 - DNA, 23 bp, Artificial Sequence
  Description of Artificial Sequence: Synthetic oligonucleotide
  Description of Combined DNA/RNA Molecule: Synthetic oligonucleotide
tacugucccuuuuaagcaacctu

SEQ ID NO: 2653 - DNA, 23 bp, Artificial Sequence
  Description of Artificial Sequence: Synthetic oligonucleotide
  Description of Combined DNA/RNA Molecule: Synthetic oligonucleotide
tuacugucccuuuuaagcaactu

SEQ ID NO: 2654 - DNA, 23 bp, Artificial Sequence
  Description of Artificial Sequence: Synthetic oligonucleotide
  Description of Combined DNA/RNA Molecule: Synthetic oligonucleotide
tauacugucccuuuuaagcaatu

SEQ ID NO: 2655 - DNA, 23 bp, Artificial Sequence
  Description of Artificial Sequence: Synthetic oligonucleotide
  Description of Combined DNA/RNA Molecule: Synthetic oligonucleotide
taauacugucccuuuuaagcatu

SEQ ID NO: 2656 - DNA, 23 bp, Artificial Sequence
  Description of Artificial Sequence: Synthetic oligonucleotide
  Description of Combined DNA/RNA Molecule: Synthetic oligonucleotide
tgaauacugucccuuuuaagctu

SEQ ID NO: 2657 - DNA, 23 bp, Artificial Sequence
  Description of Artificial Sequence: Synthetic oligonucleotide
  Description of Combined DNA/RNA Molecule: Synthetic oligonucleotide
tagaauacugucccuuuuaagtu

SEQ ID NO: 2658 - DNA, 23 bp, Artificial Sequence
  Description of Artificial Sequence: Synthetic oligonucleotide
  Description of Combined DNA/RNA Molecule: Synthetic oligonucleotide
tgagaauacugucccuuuuaatu

SEQ ID NO: 2659 - DNA, 23 bp, Artificial Sequence
  Description of Artificial Sequence: Synthetic oligonucleotide
  Description of Combined DNA/RNA Molecule: Synthetic oligonucleotide
tugagaauacugucccuuuuatu

SEQ ID NO: 2660 - DNA, 23 bp, Artificial Sequence
  Description of Artificial Sequence: Synthetic oligonucleotide
  Description of Combined DNA/RNA Molecule: Synthetic oligonucleotide
tcugagaauacugucccuuuutu

SEQ ID NO: 2661 - DNA, 23 bp, Artificial Sequence
  Description of Artificial Sequence: Synthetic oligonucleotide
  Description of Combined DNA/RNA Molecule: Synthetic oligonucleotide
tacugagaauacugucccuuutu

SEQ ID NO: 2662 - DNA, 23 bp, Artificial Sequence
  Description of Artificial Sequence: Synthetic oligonucleotide
  Description of Combined DNA/RNA Molecule: Synthetic oligonucleotide
tgcacugagaauacugucccutu

SEQ ID NO: 2663 - DNA, 23 bp, Artificial Sequence
  Description of Artificial Sequence: Synthetic oligonucleotide
  Description of Combined DNA/RNA Molecule: Synthetic oligonucleotide
tagcacugagaauacuguccctu

SEQ ID NO: 2664 - DNA, 23 bp, Artificial Sequence
  Description of Artificial Sequence: Synthetic oligonucleotide
  Description of Combined DNA/RNA Molecule: Synthetic oligonucleotide
tgagcacugagaauacugucctu

SEQ ID NO: 2665 - DNA, 23 bp, Artificial Sequence
  Description of Artificial Sequence: Synthetic oligonucleotide
  Description of Combined DNA/RNA Molecule: Synthetic oligonucleotide
tagagcacugagaauacuguctu

SEQ ID NO: 2666 - DNA, 23 bp, Artificial Sequence
  Description of Artificial Sequence: Synthetic oligonucleotide
  Description of Combined DNA/RNA Molecule: Synthetic oligonucleotide
tgagagcacugagaauacugutu

SEQ ID NO: 2667 - DNA, 23 bp, Artificial Sequence
  Description of Artificial Sequence: Synthetic oligonucleotide
  Description of Combined DNA/RNA Molecule: Synthetic oligonucleotide
tggagagcacugagaauacugtu

SEQ ID NO: 2668 - DNA, 23 bp, Artificial Sequence
  Description of Artificial Sequence: Synthetic oligonucleotide
  Description of Combined DNA/RNA Molecule: Synthetic oligonucleotide
taggagagcacugagaauacutu

SEQ ID NO: 2669 - DNA, 23 bp, Artificial Sequence
  Description of Artificial Sequence: Synthetic oligonucleotide
  Description of Combined DNA/RNA Molecule: Synthetic oligonucleotide
tuaggagagcacugagaauactu

SEQ ID NO: 2670 - DNA, 23 bp, Artificial Sequence
  Description of Artificial Sequence: Synthetic oligonucleotide
  Description of Combined DNA/RNA Molecule: Synthetic oligonucleotide
tguaggagagcacugagaauatu

SEQ ID NO: 2671 - DNA, 23 bp, Artificial Sequence
  Description of Artificial Sequence: Synthetic oligonucleotide
  Description of Combined DNA/RNA Molecule: Synthetic oligonucleotide
tgguaggagagcacugagaautu

SEQ ID NO: 2672 - DNA, 23 bp, Artificial Sequence
  Description of Artificial Sequence: Synthetic oligonucleotide
  Description of Combined DNA/RNA Molecule: Synthetic oligonucleotide
tggguaggagagcacugagaatu

SEQ ID NO: 2673 - DNA, 23 bp, Artificial Sequence
  Description of Artificial Sequence: Synthetic oligonucleotide
  Description of Combined DNA/RNA Molecule: Synthetic oligonucleotide
tgggguaggagagcacugagatu

SEQ ID NO: 2674 - DNA, 23 bp, Artificial Sequence
  Description of Artificial Sequence: Synthetic oligonucleotide
  Description of Combined DNA/RNA Molecule: Synthetic oligonucleotide
tugggguaggagagcacugagtu

SEQ ID NO: 2675 - DNA, 23 bp, Artificial Sequence
  Description of Artificial Sequence: Synthetic oligonucleotide
  Description of Combined DNA/RNA Molecule: Synthetic oligonucleotide
tgugggguaggagagcacugatu

SEQ ID NO: 2676 - DNA, 23 bp, Artificial Sequence
  Description of Artificial Sequence: Synthetic oligonucleotide
  Description of Combined DNA/RNA Molecule: Synthetic oligonucleotide
tggugggguaggagagcacugtu

SEQ ID NO: 2677 - DNA, 23 bp, Artificial Sequence
  Description of Artificial Sequence: Synthetic oligonucleotide
  Description of Combined DNA/RNA Molecule: Synthetic oligonucleotide
taggugggguaggagagcacutu

SEQ ID NO: 2678 - DNA, 23 bp, Artificial Sequence
  Description of Artificial Sequence: Synthetic oligonucleotide
  Description of Combined DNA/RNA Molecule: Synthetic oligonucleotide
tgaggugggguaggagagcactu

SEQ ID NO: 2679 - DNA, 23 bp, Artificial Sequence
  Description of Artificial Sequence: Synthetic oligonucleotide
  Description of Combined DNA/RNA Molecule: Synthetic oligonucleotide
tugaggugggguaggagagcatu

SEQ ID NO: 2680 - DNA, 23 bp, Artificial Sequence
  Description of Artificial Sequence: Synthetic oligonucleotide
  Description of Combined DNA/RNA Molecule: Synthetic oligonucleotide
taugaggugggguaggagagctu

SEQ ID NO: 2681 - DNA, 23 bp, Artificial Sequence
  Description of Artificial Sequence: Synthetic oligonucleotide
  Description of Combined DNA/RNA Molecule: Synthetic oligonucleotide
tcaugaggugggguaggagagtu

SEQ ID NO: 2682 - DNA, 23 bp, Artificial Sequence
  Description of Artificial Sequence: Synthetic oligonucleotide
  Description of Combined DNA/RNA Molecule: Synthetic oligonucleotide
tgcaugaggugggguaggagatu

SEQ ID NO: 2683 - DNA, 23 bp, Artificial Sequence
  Description of Artificial Sequence: Synthetic oligonucleotide
  Description of Combined DNA/RNA Molecule: Synthetic oligonucleotide
tuuaagcaaccuacaggggcatu

SEQ ID NO: 2684 - DNA, 23 bp, Artificial Sequence
  Description of Artificial Sequence: Synthetic oligonucleotide
  Description of Combined DNA/RNA Molecule: Synthetic oligonucleotide
tgccacuguagaaaggcaugatu

SEQ ID NO: 2685 - DNA, 23 bp, Artificial Sequence
  Description of Artificial Sequence: Synthetic oligonucleotide
  Description of Combined DNA/RNA Molecule: Synthetic oligonucleotide
tgccacuguagaaaggcaugatu

SEQ ID NO: 2686 - DNA, 23 bp, Artificial Sequence
  Description of Artificial Sequence: Synthetic oligonucleotide
  Description of Combined DNA/RNA Molecule: Synthetic oligonucleotide
tgccacuguagaaaggcaugatu

SEQ ID NO: 2687 - DNA, 23 bp, Artificial Sequence
  Description of Artificial Sequence: Synthetic oligonucleotide
  Description of Combined DNA/RNA Molecule: Synthetic oligonucleotide
tgccacuguagaaaggcaugatu

SEQ ID NO: 2688 - DNA, 20 bp, Artificial Sequence
  Description of Artificial Sequence: Synthetic oligonucleotide
gcactgagaatactgtccct

SEQ ID NO: 2689 - DNA, 20 bp, Artificial Sequence
  Description of Artificial Sequence: Synthetic oligonucleotide
cactgagaatactgtccctt

SEQ ID NO: 2690 - DNA, 20 bp, Artificial Sequence
  Description of Artificial Sequence: Synthetic oligonucleotide
actgagaatactgtcccttt

SEQ ID NO: 2691 - DNA, 20 bp, Artificial Sequence
  Description of Artificial Sequence: Synthetic oligonucleotide
ctgagaatactgtccctttt

SEQ ID NO: 2692 - DNA, 20 bp, Artificial Sequence
  Description of Artificial Sequence: Synthetic oligonucleotide
tgagaatactgtccctttta

SEQ ID NO: 2693 - DNA, 20 bp, Artificial Sequence
  Description of Artificial Sequence: Synthetic oligonucleotide
gagaatactgtcccttttaa

SEQ ID NO: 2694 - DNA, 20 bp, Artificial Sequence
  Description of Artificial Sequence: Synthetic oligonucleotide
agaatactgtcccttttaag

SEQ ID NO: 2695 - DNA, 20 bp, Artificial Sequence
  Description of Artificial Sequence: Synthetic oligonucleotide
gaatactgtcccttttaagc

SEQ ID NO: 2696 - DNA, 20 bp, Artificial Sequence
  Description of Artificial Sequence: Synthetic oligonucleotide
aatactgtcccttttaagca

SEQ ID NO: 2697 - DNA, 20 bp, Artificial Sequence
  Description of Artificial Sequence: Synthetic oligonucleotide
atactgtcccttttaagcaa

SEQ ID NO: 2698 - DNA, 20 bp, Artificial Sequence
  Description of Artificial Sequence: Synthetic oligonucleotide
tactgtcccttttaagcaac

SEQ ID NO: 2699 - DNA, 20 bp, Artificial Sequence
  Description of Artificial Sequence: Synthetic oligonucleotide
actgtcccttttaagcaacc

SEQ ID NO: 2700 - DNA, 20 bp, Artificial Sequence
  Description of Artificial Sequence: Synthetic oligonucleotide
ctgtcccttttaagcaacct

SEQ ID NO: 2701 - DNA, 20 bp, Artificial Sequence
  Description of Artificial Sequence: Synthetic oligonucleotide
tgtcccttttaagcaaccta

SEQ ID NO: 2702 - DNA, 20 bp, Artificial Sequence
  Description of Artificial Sequence: Synthetic oligonucleotide
gtcccttttaagcaacctac

SEQ ID NO: 2703 - DNA, 20 bp, Artificial Sequence
  Description of Artificial Sequence: Synthetic oligonucleotide
tcccttttaagcaacctaca

SEQ ID NO: 2704 - DNA, 20 bp, Artificial Sequence
  Description of Artificial Sequence: Synthetic oligonucleotide
cccttttaagcaacctacag

SEQ ID NO: 2705 - DNA, 20 bp, Artificial Sequence
  Description of Artificial Sequence: Synthetic oligonucleotide
ccttttaagcaacctacagg

SEQ ID NO: 2706 - DNA, 20 bp, Artificial Sequence
  Description of Artificial Sequence: Synthetic oligonucleotide
cttttaagcaacctacaggg

SEQ ID NO: 2707 - DNA, 20 bp, Artificial Sequence
  Description of Artificial Sequence: Synthetic oligonucleotide
ttttaagcaacctacagggg

SEQ ID NO: 2708 - DNA, 20 bp, Artificial Sequence
  Description of Artificial Sequence: Synthetic oligonucleotide
tttaagcaacctacaggggc

SEQ ID NO: 2709 - DNA, 20 bp, Artificial Sequence
  Description of Artificial Sequence: Synthetic oligonucleotide
ttaagcaacctacaggggca

SEQ ID NO: 2710 - DNA, 20 bp, Artificial Sequence
  Description of Artificial Sequence: Synthetic oligonucleotide
taagcaacctacaggggcag

SEQ ID NO: 2711 - DNA, 20 bp, Artificial Sequence
  Description of Artificial Sequence: Synthetic oligonucleotide
aagcaacctacaggggcagc

SEQ ID NO: 2712 - DNA, 20 bp, Artificial Sequence
  Description of Artificial Sequence: Synthetic oligonucleotide
agcaacctacaggggcagcc

SEQ ID NO: 2713 - DNA, 20 bp, Artificial Sequence
  Description of Artificial Sequence: Synthetic oligonucleotide
gcaacctacaggggcagccc

SEQ ID NO: 2714 - DNA, 20 bp, Artificial Sequence
  Description of Artificial Sequence: Synthetic oligonucleotide
caacctacaggggcagccct

SEQ ID NO: 2715 - DNA, 20 bp, Artificial Sequence
  Description of Artificial Sequence: Synthetic oligonucleotide
aacctacaggggcagccctg

SEQ ID NO: 2716 - DNA, 20 bp, Artificial Sequence
  Description of Artificial Sequence: Synthetic oligonucleotide
acctacaggggcagccctgg

SEQ ID NO: 2717 - DNA, 20 bp, Artificial Sequence
  Description of Artificial Sequence: Synthetic oligonucleotide
  Description of Combined DNA/RNA Molecule: Synthetic oligonucleotide
gcactgagaatactgucccu

SEQ ID NO: 2718 - DNA, 20 bp, Artificial Sequence
  Description of Artificial Sequence: Synthetic oligonucleotide
  Description of Combined DNA/RNA Molecule: Synthetic oligonucleotide
cactgagaatactgtcccuu

SEQ ID NO: 2719 - DNA, 20 bp, Artificial Sequence
  Description of Artificial Sequence: Synthetic oligonucleotide
  Description of Combined DNA/RNA Molecule: Synthetic oligonucleotide
actgagaatactgtcccuuu

SEQ ID NO: 2720 - DNA, 20 bp, Artificial Sequence
  Description of Artificial Sequence: Synthetic oligonucleotide
  Description of Combined DNA/RNA Molecule: Synthetic oligonucleotide
ctgagaatactgtcccuuuu

SEQ ID NO: 2721 - DNA, 20 bp, Artificial Sequence
  Description of Artificial Sequence: Synthetic oligonucleotide
  Description of Combined DNA/RNA Molecule: Synthetic oligonucleotide
tgagaatactgtcccuuuua

SEQ ID NO: 2722 - DNA, 20 bp, Artificial Sequence
  Description of Artificial Sequence: Synthetic oligonucleotide
  Description of Combined DNA/RNA Molecule: Synthetic oligonucleotide
gagaatactgtccctuuuaa

SEQ ID NO: 2723 - DNA, 20 bp, Artificial Sequence
  Description of Artificial Sequence: Synthetic oligonucleotide
  Description of Combined DNA/RNA Molecule: Synthetic oligonucleotide
agaatactgtcccttuuaag

SEQ ID NO: 2724 - DNA, 20 bp, Artificial Sequence
  Description of Artificial Sequence: Synthetic oligonucleotide
  Description of Combined DNA/RNA Molecule: Synthetic oligonucleotide
gaatactgtccctttuaagc

SEQ ID NO: 2725 - DNA, 20 bp, Artificial Sequence
  Description of Artificial Sequence: Synthetic oligonucleotide
aatactgtcccttttaagca

SEQ ID NO: 2726 - DNA, 20 bp, Artificial Sequence
  Description of Artificial Sequence: Synthetic oligonucleotide
atactgtcccttttaagcaa

SEQ ID NO: 2727 - DNA, 20 bp, Artificial Sequence
  Description of Artificial Sequence: Synthetic oligonucleotide
tactgtcccttttaagcaac

SEQ ID NO: 2728 - DNA, 20 bp, Artificial Sequence
  Description of Artificial Sequence: Synthetic oligonucleotide
actgtcccttttaagcaacc

SEQ ID NO: 2729 - DNA, 20 bp, Artificial Sequence
  Description of Artificial Sequence: Synthetic oligonucleotide
  Description of Combined DNA/RNA Molecule: Synthetic oligonucleotide
ctgtcccttttaagcaaccu

SEQ ID NO: 2730 - DNA, 20 bp, Artificial Sequence
  Description of Artificial Sequence: Synthetic oligonucleotide
  Description of Combined DNA/RNA Molecule: Synthetic oligonucleotide
tgtcccttttaagcaaccua

SEQ ID NO: 2731 - DNA, 20 bp, Artificial Sequence
  Description of Artificial Sequence: Synthetic oligonucleotide
  Description of Combined DNA/RNA Molecule: Synthetic oligonucleotide
gtcccttttaagcaaccuac

SEQ ID NO: 2732 - DNA, 20 bp, Artificial Sequence
  Description of Artificial Sequence: Synthetic oligonucleotide
  Description of Combined DNA/RNA Molecule: Synthetic oligonucleotide
tcccttttaagcaaccuaca

SEQ ID NO: 2733 - DNA, 20 bp, Artificial Sequence
  Description of Artificial Sequence: Synthetic oligonucleotide
  Description of Combined DNA/RNA Molecule: Synthetic oligonucleotide
cccttttaagcaaccuacag

SEQ ID NO: 2734 - DNA, 20 bp, Artificial Sequence
  Description of Artificial Sequence: Synthetic oligonucleotide
ccttttaagcaacctacagg

SEQ ID NO: 2735 - DNA, 20 bp, Artificial Sequence
  Description of Artificial Sequence: Synthetic oligonucleotide
cttttaagcaacctacaggg

SEQ ID NO: 2736 - DNA, 20 bp, Artificial Sequence
  Description of Artificial Sequence: Synthetic oligonucleotide
ttttaagcaacctacagggg

SEQ ID NO: 2737 - DNA, 20 bp, Artificial Sequence
  Description of Artificial Sequence: Synthetic oligonucleotide
tttaagcaacctacaggggc

SEQ ID NO: 2738 - DNA, 20 bp, Artificial Sequence
  Description of Artificial Sequence: Synthetic oligonucleotide
ttaagcaacctacaggggca

SEQ ID NO: 2739 - DNA, 20 bp, Artificial Sequence
  Description of Artificial Sequence: Synthetic oligonucleotide
taagcaacctacaggggcag

SEQ ID NO: 2740 - DNA, 20 bp, Artificial Sequence
  Description of Artificial Sequence: Synthetic oligonucleotide
aagcaacctacaggggcagc

SEQ ID NO: 2741 - DNA, 20 bp, Artificial Sequence
  Description of Artificial Sequence: Synthetic oligonucleotide
agcaacctacaggggcagcc

SEQ ID NO: 2742 - DNA, 20 bp, Artificial Sequence
  Description of Artificial Sequence: Synthetic oligonucleotide
gcaacctacaggggcagccc

SEQ ID NO: 2743 - DNA, 20 bp, Artificial Sequence
  Description of Artificial Sequence: Synthetic oligonucleotide
  Description of Combined DNA/RNA Molecule: Synthetic oligonucleotide
caacctacaggggcagcccu

SEQ ID NO: 2744 - DNA, 20 bp, Artificial Sequence
  Description of Artificial Sequence: Synthetic oligonucleotide
  Description of Combined DNA/RNA Molecule: Synthetic oligonucleotide
aacctacaggggcagcccug

SEQ ID NO: 2745 - DNA, 20 bp, Artificial Sequence
  Description of Artificial Sequence: Synthetic oligonucleotide
  Description of Combined DNA/RNA Molecule: Synthetic oligonucleotide
acctacaggggcagcccugg

SEQ ID NO: 2746 - DNA, 20 bp, Artificial Sequence
  Description of Artificial Sequence: Synthetic oligonucleotide
  Description of Combined DNA/RNA Molecule: Synthetic oligonucleotide
agcttcttgtccagcuuuau

SEQ ID NO: 2747 - DNA, 20 bp, Artificial Sequence
  Description of Artificial Sequence: Synthetic oligonucleotide
  Description of Combined DNA/RNA Molecule: Synthetic oligonucleotide
gcacugagaatactgtccct

SEQ ID NO: 2748 - DNA, 20 bp, Artificial Sequence
  Description of Artificial Sequence: Synthetic oligonucleotide
  Description of Combined DNA/RNA Molecule: Synthetic oligonucleotide
cacugagaatactgtccctt

SEQ ID NO: 2749 - DNA, 20 bp, Artificial Sequence
  Description of Artificial Sequence: Synthetic oligonucleotide
  Description of Combined DNA/RNA Molecule: Synthetic oligonucleotide
acugagaatactgtcccttt

SEQ ID NO: 2750 - DNA, 20 bp, Artificial Sequence
  Description of Artificial Sequence: Synthetic oligonucleotide
  Description of Combined DNA/RNA Molecule: Synthetic oligonucleotide
cugagaatactgtccctttt

SEQ ID NO: 2751 - DNA, 20 bp, Artificial Sequence
  Description of Artificial Sequence: Synthetic oligonucleotide
  Description of Combined DNA/RNA Molecule: Synthetic oligonucleotide
ugagaatactgtccctttta

SEQ ID NO: 2752 - DNA, 20 bp, Artificial Sequence
  Description of Artificial Sequence: Synthetic oligonucleotide
gagaatactgtcccttttaa

SEQ ID NO: 2753 - DNA, 20 bp, Artificial Sequence
  Description of Artificial Sequence: Synthetic oligonucleotide
  Description of Combined DNA/RNA Molecule: Synthetic oligonucleotide
agaauactgtcccttttaag

SEQ ID NO: 2754 - DNA, 20 bp, Artificial Sequence
  Description of Artificial Sequence: Synthetic oligonucleotide
  Description of Combined DNA/RNA Molecule: Synthetic oligonucleotide
gaauactgtcccttttaagc

SEQ ID NO: 2755 - DNA, 20 bp, Artificial Sequence
  Description of Artificial Sequence: Synthetic oligonucleotide
  Description of Combined DNA/RNA Molecule: Synthetic oligonucleotide
aauactgtcccttttaagca

SEQ ID NO: 2756 - DNA, 20 bp, Artificial Sequence
  Description of Artificial Sequence: Synthetic oligonucleotide
  Description of Combined DNA/RNA Molecule: Synthetic oligonucleotide
auacugtcccttttaagcaa

SEQ ID NO: 2757 - DNA, 20 bp, Artificial Sequence
  Description of Artificial Sequence: Synthetic oligonucleotide
  Description of Combined DNA/RNA Molecule: Synthetic oligonucleotide
uacugtcccttttaagcaac

SEQ ID NO: 2758 - DNA, 20 bp, Artificial Sequence
  Description of Artificial Sequence: Synthetic oligonucleotide
  Description of Combined DNA/RNA Molecule: Synthetic oligonucleotide
acugucccttttaagcaacc

SEQ ID NO: 2759 - DNA, 20 bp, Artificial Sequence
  Description of Artificial Sequence: Synthetic oligonucleotide
  Description of Combined DNA/RNA Molecule: Synthetic oligonucleotide
cugucccttttaagcaacct

SEQ ID NO: 2760 - DNA, 20 bp, Artificial Sequence
  Description of Artificial Sequence: Synthetic oligonucleotide
  Description of Combined DNA/RNA Molecule: Synthetic oligonucleotide
ugucccttttaagcaaccta

SEQ ID NO: 2761 - DNA, 20 bp, Artificial Sequence
  Description of Artificial Sequence: Synthetic oligonucleotide
  Description of Combined DNA/RNA Molecule: Synthetic oligonucleotide
gucccttttaagcaacctac

SEQ ID NO: 2762 - DNA, 20 bp, Artificial Sequence
  Description of Artificial Sequence: Synthetic oligonucleotide
  Description of Combined DNA/RNA Molecule: Synthetic oligonucleotide
ucccutttaagcaacctaca

SEQ ID NO: 2763 - DNA, 20 bp, Artificial Sequence
  Description of Artificial Sequence: Synthetic oligonucleotide
  Description of Combined DNA/RNA Molecule: Synthetic oligonucleotide
cccuuttaagcaacctacag

SEQ ID NO: 2764 - DNA, 20 bp, Artificial Sequence
  Description of Artificial Sequence: Synthetic oligonucleotide
  Description of Combined DNA/RNA Molecule: Synthetic oligonucleotide
ccuuutaagcaacctacagg

SEQ ID NO: 2765 - DNA, 20 bp, Artificial Sequence
  Description of Artificial Sequence: Synthetic oligonucleotide
  Description of Combined DNA/RNA Molecule: Synthetic oligonucleotide
cuuuuaagcaacctacaggg

SEQ ID NO: 2766 - DNA, 20 bp, Artificial Sequence
  Description of Artificial Sequence: Synthetic oligonucleotide
  Description of Combined DNA/RNA Molecule: Synthetic oligonucleotide
uuuuaagcaacctacagggg

SEQ ID NO: 2767 - DNA, 20 bp, Artificial Sequence
  Description of Artificial Sequence: Synthetic oligonucleotide
  Description of Combined DNA/RNA Molecule: Synthetic oligonucleotide
uuuaagcaacctacaggggc

SEQ ID NO: 2768 - DNA, 20 bp, Artificial Sequence
  Description of Artificial Sequence: Synthetic oligonucleotide
  Description of Combined DNA/RNA Molecule: Synthetic oligonucleotide
uuaagcaacctacaggggca

SEQ ID NO: 2769 - DNA, 20 bp, Artificial Sequence
  Description of Artificial Sequence: Synthetic oligonucleotide
  Description of Combined DNA/RNA Molecule: Synthetic oligonucleotide
uaagcaacctacaggggcag

SEQ ID NO: 2770 - DNA, 20 bp, Artificial Sequence
  Description of Artificial Sequence: Synthetic oligonucleotide
aagcaacctacaggggcagc

SEQ ID NO: 2771 - DNA, 20 bp, Artificial Sequence
  Description of Artificial Sequence: Synthetic oligonucleotide
agcaacctacaggggcagcc

SEQ ID NO: 2772 - DNA, 20 bp, Artificial Sequence
  Description of Artificial Sequence: Synthetic oligonucleotide
gcaacctacaggggcagccc

SEQ ID NO: 2773 - DNA, 20 bp, Artificial Sequence
  Description of Artificial Sequence: Synthetic oligonucleotide
caacctacaggggcagccct

SEQ ID NO: 2774 - DNA, 20 bp, Artificial Sequence
  Description of Artificial Sequence: Synthetic oligonucleotide
  Description of Combined DNA/RNA Molecule: Synthetic oligonucleotide
aaccuacaggggcagccctg

SEQ ID NO: 2775 - DNA, 20 bp, Artificial Sequence
  Description of Artificial Sequence: Synthetic oligonucleotide
  Description of Combined DNA/RNA Molecule: Synthetic oligonucleotide
accuacaggggcagccctgg

SEQ ID NO: 2776 - DNA, 20 bp, Artificial Sequence
  Description of Artificial Sequence: Synthetic oligonucleotide
  Description of Combined DNA/RNA Molecule: Synthetic oligonucleotide
cuuguccagctttattggga

SEQ ID NO: 2777 - DNA, 20 bp, Artificial Sequence
  Description of Artificial Sequence: Synthetic oligonucleotide
  Description of Combined DNA/RNA Molecule: Synthetic oligonucleotide
agcuucttgtccagctttat

SEQ ID NO: 2778 - DNA, 20 bp, Artificial Sequence
  Description of Artificial Sequence: Synthetic oligonucleotide
  Description of Combined DNA/RNA Molecule: Synthetic oligonucleotide
auagcagcttcttgtccagc

SEQ ID NO: 2779 - DNA, 20 bp, Artificial Sequence
  Description of Artificial Sequence: Synthetic oligonucleotide
cggcctctgaagctcgggca

SEQ ID NO: 2780 - DNA, 21 bp, Artificial Sequence
  Description of Artificial Sequence: Synthetic oligonucleotide
  Description of Combined DNA/RNA Molecule: Synthetic oligonucleotide
tagcuucuuguccagcuuuuu

SEQ ID NO: 2781 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2782 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2783 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2784 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2785 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2786 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2787 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2788 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2789 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2790 - DNA, 23 bp, Artificial Sequence
  Description of Artificial Sequence: Synthetic oligonucleotide
  Description of Combined DNA/RNA Molecule: Synthetic oligonucleotide
tcacugagaauacugucccuutu

SEQ ID NO: 2791 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 2792 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 2793 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 2794 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 2795 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 2796 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 2797 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 2798 - DNA, 21 bp, Artificial Sequence
  Description of Artificial Sequence: Synthetic oligonucleotide
  Description of Combined DNA/RNA Molecule: Synthetic oligonucleotide
tcacugagaauacuguccctu

SEQ ID NO: 2799 - DNA, 20 bp, Artificial Sequence
  Description of Artificial Sequence: Synthetic oligonucleotide
aagggcatgaagcaggaaca

SEQ ID NO: 2800 - DNA, 20 bp, Artificial Sequence
  Description of Artificial Sequence: Synthetic oligonucleotide
gaagggcatgaagcaggaac

SEQ ID NO: 2801 - DNA, 20 bp, Artificial Sequence
  Description of Artificial Sequence: Synthetic oligonucleotide
agaagggcatgaagcaggaa

SEQ ID NO: 2802 - DNA, 20 bp, Artificial Sequence
  Description of Artificial Sequence: Synthetic oligonucleotide
  Description of Combined DNA/RNA Molecule: Synthetic oligonucleotide
uagaagggcatgaagcagga

SEQ ID NO: 2803 - DNA, 20 bp, Artificial Sequence
  Description of Artificial Sequence: Synthetic oligonucleotide
  Description of Combined DNA/RNA Molecule: Synthetic oligonucleotide
guagaagggcatgaagcagg

SEQ ID NO: 2804 - DNA, 20 bp, Artificial Sequence
  Description of Artificial Sequence: Synthetic oligonucleotide
  Description of Combined DNA/RNA Molecule: Synthetic oligonucleotide
uguagaagggcatgaagcag

SEQ ID NO: 2805 - DNA, 20 bp, Artificial Sequence
  Description of Artificial Sequence: Synthetic oligonucleotide
  Description of Combined DNA/RNA Molecule: Synthetic oligonucleotide
cuguagaagggcatgaagca

SEQ ID NO: 2806 - DNA, 20 bp, Artificial Sequence
  Description of Artificial Sequence: Synthetic oligonucleotide
  Description of Combined DNA/RNA Molecule: Synthetic oligonucleotide
acuguagaagggcatgaagc

SEQ ID NO: 2807 - DNA, 20 bp, Artificial Sequence
  Description of Artificial Sequence: Synthetic oligonucleotide
  Description of Combined DNA/RNA Molecule: Synthetic oligonucleotide
cacugtagaagggcaugaag

SEQ ID NO: 2808 - DNA, 20 bp, Artificial Sequence
  Description of Artificial Sequence: Synthetic oligonucleotide
  Description of Combined DNA/RNA Molecule: Synthetic oligonucleotide
ccacugtagaagggcaugaa

SEQ ID NO: 2809 - DNA, 20 bp, Artificial Sequence
  Description of Artificial Sequence: Synthetic oligonucleotide
  Description of Combined DNA/RNA Molecule: Synthetic oligonucleotide
uuccgactcctggccuuccg

SEQ ID NO: 2810 - DNA, 20 bp, Artificial Sequence
  Description of Artificial Sequence: Synthetic oligonucleotide
  Description of Combined DNA/RNA Molecule: Synthetic oligonucleotide
uccgactcctggcctuccgc

SEQ ID NO: 2811 - DNA, 20 bp, Artificial Sequence
  Description of Artificial Sequence: Synthetic oligonucleotide
ccgactcctggccttccgca

SEQ ID NO: 2812 - DNA, 20 bp, Artificial Sequence
  Description of Artificial Sequence: Synthetic oligonucleotide
  Description of Combined DNA/RNA Molecule: Synthetic oligonucleotide
accugaggatggaccgcggg

SEQ ID NO: 2813 - DNA, 20 bp, Artificial Sequence
  Description of Artificial Sequence: Synthetic oligonucleotide
  Description of Combined DNA/RNA Molecule: Synthetic oligonucleotide
ugugcttggctcctgccugg

SEQ ID NO: 2814 - DNA, 20 bp, Artificial Sequence
  Description of Artificial Sequence: Synthetic oligonucleotide
  Description of Combined DNA/RNA Molecule: Synthetic oligonucleotide
cuggacctgaggatggaccg

SEQ ID NO: 2815 - DNA, 20 bp, Artificial Sequence
  Description of Artificial Sequence: Synthetic oligonucleotide
  Description of Combined DNA/RNA Molecule: Synthetic oligonucleotide
uguuccgactcctggccuuc

SEQ ID NO: 2816 - DNA, 20 bp, Artificial Sequence
  Description of Artificial Sequence: Synthetic oligonucleotide
  Description of Combined DNA/RNA Molecule: Synthetic oligonucleotide
guuccgactcctggccuucc

SEQ ID NO: 2817 - DNA, 20 bp, Artificial Sequence
  Description of Artificial Sequence: Synthetic oligonucleotide
  Description of Combined DNA/RNA Molecule: Synthetic oligonucleotide
cgacucctggccttccgcac

SEQ ID NO: 2818 - DNA, 20 bp, Artificial Sequence
  Description of Artificial Sequence: Synthetic oligonucleotide
  Description of Combined DNA/RNA Molecule: Synthetic oligonucleotide
ccugctgtgcttggcuccug

SEQ ID NO: 2819 - DNA, 20 bp, Artificial Sequence
  Description of Artificial Sequence: Synthetic oligonucleotide
  Description of Combined DNA/RNA Molecule: Synthetic oligonucleotide
ucuugttacccccgccaugg

SEQ ID NO: 2820 - DNA, 20 bp, Artificial Sequence
  Description of Artificial Sequence: Synthetic oligonucleotide
  Description of Combined DNA/RNA Molecule: Synthetic oligonucleotide
ccugcctcagtgtctcggcc

SEQ ID NO: 2821 - DNA, 20 bp, Artificial Sequence
  Description of Artificial Sequence: Synthetic oligonucleotide
  Description of Combined DNA/RNA Molecule: Synthetic oligonucleotide
cccugcctcagtgtcucggc

SEQ ID NO: 2822 - DNA, 20 bp, Artificial Sequence
  Description of Artificial Sequence: Synthetic oligonucleotide
  Description of Combined DNA/RNA Molecule: Synthetic oligonucleotide
uuacccccgccatggagacg

SEQ ID NO: 2823 - DNA, 20 bp, Artificial Sequence
  Description of Artificial Sequence: Synthetic oligonucleotide
  Description of Combined DNA/RNA Molecule: Synthetic oligonucleotide
acccccgccatggagacguu

SEQ ID NO: 2824 - DNA, 20 bp, Artificial Sequence
  Description of Artificial Sequence: Synthetic oligonucleotide
  Description of Combined DNA/RNA Molecule: Synthetic oligonucleotide
gaccugaggatggaccgcgg

SEQ ID NO: 2825 - DNA, 20 bp, Artificial Sequence
  Description of Artificial Sequence: Synthetic oligonucleotide
ggacctgaggatggaccgcg

SEQ ID NO: 2826 - DNA, 20 bp, Artificial Sequence
  Description of Artificial Sequence: Synthetic oligonucleotide
  Description of Combined DNA/RNA Molecule: Synthetic oligonucleotide
uacccccgccatggagacgu

SEQ ID NO: 2827 - DNA, 20 bp, Artificial Sequence
  Description of Artificial Sequence: Synthetic oligonucleotide
  Description of Combined DNA/RNA Molecule: Synthetic oligonucleotide
gggaccctctgcactgggcu

SEQ ID NO: 2828 - DNA, 20 bp, Artificial Sequence
  Description of Artificial Sequence: Synthetic oligonucleotide
  Description of Combined DNA/RNA Molecule: Synthetic oligonucleotide
ccugggcgagagggtgucca

(The sequence listing continues in the following parts.)

The invention claimed is:

1. An oligonucleotide composition, comprising a plurality of oligonucleotides that are structurally identical, wherein:
   the level of the plurality of oligonucleotides in the composition is predetermined;
   the oligonucleotides of the plurality are about 10 to about 50 nucleotides in length;
   at least 5 internucleotidic linkages are chirally controlled; and
   the 5'-end nucleoside of each oligonucleotide of the plurality is

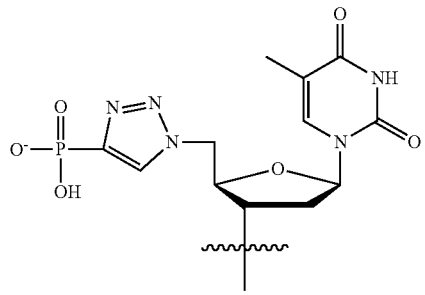

or a salt form thereof, or the 5'-end sugar of each oligonucleotide of the plurality is

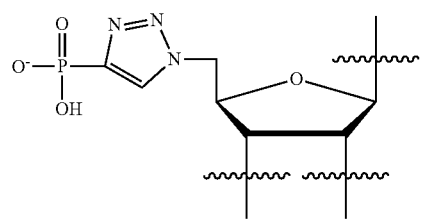

or a salt form thereof.

2. The composition of claim 1, wherein the level of the oligonucleotides of the plurality is $(90\%)^n$-100% of all oligonucleotides in the composition, wherein n is the number of chirally controlled internucleotidic linkages, and n is 5-25.

3. The composition of claim 1, wherein at least 20% of the internucleotidic linkages of each oligonucleotide of the plurality are independently chiral internucleotidic linkages.

4. The composition of claim 1, wherein at least 20% of the nucleotidic units of each oligonucleotide of the plurality independently comprise a 2'-substitution.

5. The composition of claim 4, wherein each oligonucleotide of the plurality independently comprises a 2'-F modified sugar.

6. The composition of claim 4, wherein each oligonucleotide of the plurality independently comprises a 2'-OR$^1$ modified sugar, wherein R$^1$ is optionally substituted $C_{1-6}$ alkyl.

7. The composition of claim 4, wherein each oligonucleotide of the plurality independently comprises a modified sugar comprising 2'-L-, wherein L connects C2 and C4 of the modified sugar.

8. The composition of claim 1, wherein the oligonucleotide comprises a target-binding sequence that is completely complementary to a target sequence, wherein the target-binding sequence has a length of at least 10, 11, 12, 13, 14, 15, 16, 17, 18, 19 or 20 bases, wherein each base is optionally substituted adenine, cytosine, guanosine, thymine, or uracil, and wherein the target sequence comprises one or more allelic sites, wherein an allelic site is a SNP or a mutation.

9. The composition of claim 1, wherein at least 80% of the internucleotidic linkages of each oligonucleotide of the plurality are independently chiral internucleotidic linkages.

10. The composition of claim 1, wherein at least 50% of the nucleotidic units of each oligonucleotide of the plurality independently comprise a 2'-substitution.

11. The composition of claim 10, wherein each oligonucleotide of the plurality independently comprises a 2'-F modified sugar.

12. The composition of claim 10, wherein each oligonucleotide of the plurality independently comprises a 2'-OMe modified sugar.

13. The composition of claim 10, wherein each oligonucleotide of the plurality independently comprises a 2'-MOE modified sugar.

14. The composition of claim 1, wherein each oligonucleotide of the plurality independently comprises a phosphorothioate internucleotidic linkage.

15. The composition of claim 1, wherein each oligonucleotide of the plurality independently comprises at least 5 chirally controlled phosphorothioate internucleotidic linkages.

16. The composition of claim 14, wherein the phosphorothioate internucleotidic linkage is a chirally controlled internucleotidic linkage in the Sp configuration.

17. The composition of claim 1, wherein each oligonucleotide of the plurality independently comprises at least 5 internucleotidic linkages in the Sp configuration.

18. The composition of claim 17, wherein each oligonucleotide of the plurality independently comprises at least 10 internucleotidic linkages in the Sp configuration.

19. The composition of claim 1, wherein at least 60% of chirally controlled internucleotidic linkages independently comprise a Sp linkage phosphorus.

20. The composition of claim 1, wherein at least 90% of chirally controlled internucleotidic linkages independently comprise a Sp linkage phosphorus.

* * * * *